United States Patent
Turcotte et al.

(10) Patent No.: US 12,491,220 B2
(45) Date of Patent: Dec. 9, 2025

(54) COMPOSITIONS CONTAINING INDOLE-DERIVED METABOLITES AND METHODS OF USE THEREOF

(71) Applicant: Imvela Corp., Brooklyn, NY (US)

(72) Inventors: Raphaël Turcotte, Brooklyn, NY (US);
Ravi Sheth, Brooklyn, NY (US); Jonna Heldrich, Brooklyn, NY (US);
Corentin Moevus, Brooklyn, NY (US)

(73) Assignee: Imvela Corp., Brooklyn, NY (US)

( * ) Notice: Subject to any disclaimer, the term of this patent is extended or adjusted under 35 U.S.C. 154(b) by 0 days.

(21) Appl. No.: 19/060,316

(22) Filed: Feb. 21, 2025

(65) Prior Publication Data

US 2025/0268956 A1    Aug. 28, 2025

Related U.S. Application Data

(60) Provisional application No. 63/738,662, filed on Dec. 24, 2024, provisional application No. 63/557,070, filed on Feb. 23, 2024.

(51) Int. Cl.
| | | |
|---|---|---|
| *A61K 35/744* | (2015.01) | |
| *A61K 9/00* | (2006.01) | |
| *A61P 17/04* | (2006.01) | |
| *A61P 17/14* | (2006.01) | |
| *A61P 29/00* | (2006.01) | |

(52) U.S. Cl.
CPC .......... *A61K 35/744* (2013.01); *A61K 9/0053* (2013.01); *A61P 17/04* (2018.01); *A61P 17/14* (2018.01); *A61P 29/00* (2018.01)

(58) Field of Classification Search
CPC .................................................. A61K 35/744
See application file for complete search history.

(56) References Cited

U.S. PATENT DOCUMENTS

| | | |
|---|---|---|
| 3,261,761 A | 7/1966 | Anderson et al. |
| 3,897,307 A | 7/1975 | Porubcan et al. |
| 4,205,132 A | 5/1980 | Sandine et al. |
| 8,906,668 B2 | 12/2014 | Henn et al. |
| 9,622,484 B2 | 4/2017 | Taghavi et al. |
| 2014/0037582 A1 | 2/2014 | Romero et al. |
| 2020/0316023 A1 | 10/2020 | Venkataraman et al. |
| 2020/0345799 A1 | 11/2020 | Brucker et al. |

(Continued)

FOREIGN PATENT DOCUMENTS

| | | |
|---|---|---|
| AU | 2021360828 A1 | 4/2022 |
| CA | 3 120 569 A1 | 5/2020 |

(Continued)

OTHER PUBLICATIONS

Englsih translation of Bio Bank Health Inc., KR 102351146 B1, 2021.*

(Continued)

*Primary Examiner* — Rosanne Kosson
(74) *Attorney, Agent, or Firm* — Wolf, Greenfield & Sacks, P.C.

(57) ABSTRACT

Some aspects of the disclosure relate to compositions comprising fermentates of bacterial strains capable of producing indole-containing compounds such as ILA and IAld. Some aspects relate to nutritional supplements, and food products containing such fermentates, and methods of use thereof.

14 Claims, 15 Drawing Sheets

Specification includes a Sequence Listing.

(56) References Cited

U.S. PATENT DOCUMENTS

| | | |
|---|---|---|
| 2020/0405781 A1 | 12/2020 | Holzapfel et al. |
| 2021/0386802 A1 | 12/2021 | Brucker et al. |
| 2022/0183326 A1 | 6/2022 | Sheth et al. |
| 2024/0299469 A1 | 9/2024 | Colosimo et al. |

FOREIGN PATENT DOCUMENTS

| | | |
|---|---|---|
| CA | 3 219 618 A1 | 11/2022 |
| CN | 102154164 B | 12/2012 |
| CN | 111172080 B | 5/2021 |
| JP | 2022526446 A | 5/2022 |
| KR | 20230104155 A | 7/2023 |
| WO | WO 99/67238 A2 | 12/1999 |
| WO | WO 2011/014644 A1 | 2/2011 |
| WO | WO 2012/098358 A1 | 7/2012 |
| WO | WO 2014/029578 A1 | 2/2014 |
| WO | WO 2017/095968 A1 | 6/2017 |
| WO | WO 2019/152791 A1 | 8/2019 |
| WO | WO 2019/175777 A1 | 9/2019 |
| WO | WO 2019/175780 A1 | 9/2019 |
| WO | WO 2019/175782 A1 | 9/2019 |
| WO | WO 2019/175783 A1 | 9/2019 |
| WO | WO 2020/210553 A1 | 10/2020 |
| WO | WO 2022/003120 A1 | 1/2022 |
| WO | WO 2022/067052 A1 | 3/2022 |
| WO | WO 2023/220288 A1 | 11/2023 |
| WO | WO 2023/225667 A2 | 11/2023 |

OTHER PUBLICATIONS

International Search Report and Written Opinion mailed Jun. 16, 2025 for International Application No. PCT/US2025/016818.

[No Author Listed], GenBank Accession No. CP083725.1, Pediococcus acidilactici strain MT25 chromosome, complete genome. Sep. 2, 20216. Retrieved from: https://www.ncbi.nlm.nih.gov/nuccore/CP083725.1/, 1 page.

Saadoun et al., Effect of fermentation with single and co-culture of lactic acid bacteria on okara: evaluation of bioactive compounds and volatile profiles. Food Funct. Apr. 7, 2021;12(7):3033-3043. doi: 10.1039/d0fo02916e. Epub Mar. 12, 2021.

Invitation to Pay Additional Fees mailed Apr. 25, 2025 for International Application No. PCT/US2025/016818.

[No Author Listed], A&B Ingredients PA5051 Pediococcus Acidilactici Probiotic Relieves Canine Dermatitis. Mar. 2, 2017. Retrieved from: https://abingredients.com/resources/press/pa5051_probiotic_relieves_canine_dermatitis.html. 4 pages.

Acuff et al., Evaluation of graded levels of Bacillus coagulans GBI-30, 6086 on apparent nutrient digestibility, stool quality, and intestinal health indicators in healthy adult dogs. J Anim Sci. May 1, 2021;99(5):skab137. doi: 10.1093/jas/skab137.

Altschul et al., Gapped BLAST and PSI-BLAST: a new generation of protein database search programs. Nucleic Acids Res. Sep. 1, 1997;25(17):3389-402. doi: 10.1093/nar/25.17.3389.

Bastos et al., Bacillus subtilis and Bacillus licheniformis reduce faecal protein catabolites concentration and odour in dogs. BMC Vet Res. Apr. 19, 2020;16(1):116. doi: 10.1186/s12917-020-02321-7.

Bissonnette et al., Tapinarof in the treatment of psoriasis: A review of the unique mechanism of action of a novel therapeutic aryl hydrocarbon receptor-modulating agent. J Am Acad Dermatol. Apr. 2021;84(4):1059-1067. doi: 10.1016/j.jaad.2020.10.085. Epub Nov. 3, 2020.

Boniolo et al., Oxygen supply in Bacillus thuringiensis fermentations: bringing new insights on their impact on sporulation and δ-endotoxin production. Appl Microbiol Biotechnol. May 2012;94(3):625-36. doi: 10.1007/s00253-011-3746-9. Epub Mar. 7, 2012.

Brown et al., Measurement of bacterial replication rates in microbial communities. Nat Biotechnol. Dec. 2016;34(12):1256-1263. doi: 10.1038/nbt.3704. Epub Nov. 7, 2016.

Chakraborty et al., An Insight into the Gelatinization Properties Influencing the Modified Starches Used in the Food Industry: A review. Food Bioproc Tech. Jan. 3, 2022;15:1195-1223. doi:10.1007/s11947-022-02761-z. Epub Feb. 3, 2022.

Dodd et al., A gut bacterial pathway metabolizes aromatic amino acids into nine circulating metabolites. Nature. Nov. 30, 2017;551(7682):648-652. doi: 10.1038/nature24661. Epub Nov. 22, 2017. Author Manuscript, 25 pages.

Ehrlich et al., Indole-3-lactic acid associated with Bifidobacterium-dominated microbiota significantly decreases inflammation in intestinal epithelial cells. BMC Microbiol. Nov. 23, 2020;20(1):357. doi: 10.1186/s12866-020-02023-y.

Emerson et al., Schrodinger's microbes: Tools for distinguishing the living from the dead in microbial ecosystems. Microbiome. Aug. 16, 2017;5(1):86. doi: 10.1186/s40168-017-0285-3. PMID: 28810907; PMCID: PMC5558654.

Esbelin et al., Desiccation: An environmental and food industry stress that bacteria commonly face. Food Microbiol. Feb. 2018;69:82-88. doi: 10.1016/j.fm.2017.07.017. Epub Jul. 24, 2017.

Fang et al., Limosilactobacillus reuteri Attenuates Atopic Dermatitis via Changes in Gut Bacteria and Indole Derivatives from Tryptophan Metabolism. Int J Mol Sci. Jul. 13, 2022;23(14):7735. doi: 10.3390/ijms23147735.

Gaitanis et al., AhR ligands, malassezin, and indolo[3,2-b]carbazole are selectively produced by Malassezia furfur strains isolated from seborrheic dermatitis. J Invest Dermatol. Jul. 2008;128(7):1620-5. doi: 10.1038/sj.jid.5701252. Epub Jan. 24, 2008.

Grześkowiak et al., Microbiota and probiotics in canine and feline welfare. Anaerobe. Aug. 2015;34:14-23. doi: 10.1016/j.anaerobe.2015.04.002. Epub Apr. 8, 2015.

Han et al., Diet-Host-Microbiota Interactions Shape Aryl Hydrocarbon Receptor Ligand Production to Modulate Intestinal Homeostasis. Annu Rev Nutr. Oct. 11, 2021;41:455-478. doi: 10.1146/annurev-nutr-043020-090050.

Huang et al., The impact of indole-3-lactic acid on immature intestinal innate immunity and development: a transcriptomic analysis. Sci Rep. Apr. 13, 2021;11(1):8088. doi: 10.1038/s41598-021-87353-1.

Hubbard et al., Indole and Tryptophan Metabolism: Endogenous and Dietary Routes to Ah Receptor Activation. Drug Metab Dispos. Oct. 2015;43(10):1522-35. doi: 10.1124/dmd.115.064246. Epub Jun. 3, 2015.

Kim et al., Effects of Indole-3-Lactic Acid, a Metabolite of Tryptophan, on IL-4 and IL-13-Induced Human Skin-Equivalent Atopic Dermatitis Models. Int J Mol Sci. Nov. 4, 2022;23(21):13520. doi: 10.3390/ijms232113520.

Koay et al., Ingestion of resistant starch by mice markedly increases microbiome-derived metabolites. FASEB J. Jul. 2019;33(7):8033-8042. doi: 10.1096/fj.201900177R. Epub Mar. 29, 2019.

Konopelski et al., Biological Effects of Indole-3-Propionic Acid, a Gut Microbiota-Derived Metabolite, and Its Precursor Tryptophan in Mammals' Health and Disease. Int J Mol Sci. Jan. 22, 2022;23(3):1222. doi: 10.3390/ijms23031222.

Konopelski et al., Indole-3-propionic acid, a tryptophan-derived bacterial metabolite, increases blood pressure via cardiac and vascular mechanisms in rats. Am J Physiol Regul Integr Comp Physiol. Dec. 1, 2021;321(6):R969-R981. doi: 10.1152/ajpregu.00142.2021. Epub Nov. 10, 2021.

Langan et al., Microbiota-Derived Metabolites, Indole-3-aldehyde and Indole-3-acetic Acid, Differentially Modulate Innate Cytokines and Stromal Remodeling Processes Associated with Autoimmune Arthritis. Int J Mol Sci. Feb. 18, 2021;22(4):2017. doi: 10.3390/ijms22042017.

Li et al., Bacteroides thetaiotaomicron relieves colon inflammation by activating aryl hydrocarbon receptor and modulating CD4+T cell homeostasis. Int Immunopharmacol. Jan. 2021;90:107183. doi: 10.1016/j.intimp.2020.107183. Epub Nov. 20, 2020.

Li et al., Effects of drying strategies on sporulation and titer of microbial ecological agents with Bacillus subtilis. Front Nutr. Sep. 27, 2022;9:1025248. doi: 10.3389/fnut.2022.1025248.

Li et al., New Insights Into Gut-Bacteria-Derived Indole and Its Derivatives in Intestinal and Liver Diseases. Front Pharmacol. Dec. 13, 2021;12:769501. doi: 10.3389/fphar.2021.769501.

(56) References Cited

OTHER PUBLICATIONS

Li et al., Optimization of sporulation and purification methods for sporicidal efficacy assessment on Bacillus spores. J Ind Microbiol Biotechnol. Jul. 30, 2022;49(4):kuac014. doi: 10.1093/jimb/kuac014.
Li et al., The Role of the Microbiome and Microbiome-Derived Metabolites in Atopic Dermatitis and Non-Histaminergic Itch. Am J Clin Dermatol. Sep. 2020;21(Suppl 1):44-50. doi: 10.1007/s40257-020-00538-8.
Liu et al., Activation of aryl hydrocarbon receptor in Langerhans cells by a microbial metabolite of tryptophan negatively regulates skin inflammation. J Dermatol Sci. Dec. 2020;100(3):192-200. doi: 10.1016/j.jdermsci.2020.10.004. Epub Oct. 9, 2020.
Lopez-Santamarina et al., Probiotics as a Possible Strategy for the Prevention and Treatment of Allergies. A Narrative Review. Foods. Mar. 25, 2021;10(4):701. doi: 10.3390/foods10040701.
Mikawa et al., Enhancement of natural killer cell activity by oral administration of a fermented soybean product in dogs. Open Vet J. Jul.-Sep. 2021;11(3):394-400. doi: 10.5455/OVJ.2021.v11.i3.10. Epub Aug. 8, 2021.
Owumi et al., 3-Indolepropionic acid upturned male reproductive function by reducing oxido-inflammatory responses and apoptosis along the hypothalamic-pituitary-gonadal axis of adult rats exposed to chlorpyrifos. Toxicology. Nov. 2021;463:152996. doi: 10.1016/j.tox.2021.152996. Epub Oct. 19, 2021.
Paeslack et al., Microbiota-derived tryptophan metabolites in vascular inflammation and cardiovascular disease. Amino Acids. Oct. 2022;54(10):1339-1356. doi: 10.1007/s00726-022-03161-5. Epub Apr. 22, 2022.
Pearson et al., Improved tools for biological sequence comparison. Proc Natl Acad Sci U S A. Apr. 1988;85(8):2444-8. doi: 10.1073/pnas.85.8.2444.
Penna et al., Bacillus stearothermophilus sporulation response to different composition media. Pda J Pharm Sci Technol. Sep.-Oct. 1998;52(5):198-208.
Pernomian et al., The Aryl Hydrocarbon Receptor (AHR) as a Potential Target for the Control of Intestinal Inflammation: Insights from an Immune and Bacteria Sensor Receptor. Clin Rev Allergy Immunol. Dec. 2020;59(3):382-390. doi: 10.1007/s12016-020-08789-3.
Petrillo et al., The temperature of growth and sporulation modulates the efficiency of spore- display in Bacillus subtilis. Microb Cell Fact. Oct. 1, 2020;19(1):185. doi: 10.1186/s12934-020-01446-6.
Powell et al., Indoles from the commensal microbiota act via the AHR and IL-10 to tune the cellular composition of the colonic epithelium during aging. Proc Natl Acad Sci U S A. Sep. 1, 2020;117(35):21519-21526. doi: 10.1073/pnas.2003004117. Epub Aug. 17, 2020.
Rabbee et al., *Bacillus velezensis*: A Valuable Member of Bioactive Molecules within Plant Microbiomes. Molecules. Mar. 16, 2019;24(6):1046. doi: 10.3390/molecules24061046.
Rabbee et al., *Bacillus velezensis*: A Beneficial Biocontrol Agent or Facultative Phytopathogen for Sustainable Agriculture. Agronomy. Mar. 13, 2023; 13(3): 840. doi: 10.3390/agronomy13030840.
Roager et al., Microbial tryptophan catabolites in health and disease. Nat Commun. Aug. 17, 2018;9(1):3294. doi: 10.1038/s41467-018-05470-4.
Schauf et al., Effect of Calsporin® (Bacillus subtilis C-3102) addition to the diet on faecal quality and nutrient digestibility in healthy adult dogs. Journal of Applied Animal Nutrition. 2019;7:e3. doi: 10.1017/Jan.2019.2.
Silverberg N, Atopic dermatitis prevention and treatment. Cutis. Sep. 2017;100(3):173;177;192.
Singh et al., Strategies for Fermentation Medium Optimization: An In-Depth Review. Front Microbiol. Jan. 6, 2017;7:2087. doi: 10.3389/fmicb.2016.02087.
Sinha et al., Dietary fibre directs microbial tryptophan metabolism via metabolic interactions in the gut microbiota. Nat Microbiol. Aug. 2024;9(8):1964-1978. doi: 10.1038/s41564-024-01737-3. Epub Jun. 25, 2024. Suppl Info, 12 pages.
Soliman et al., Everything you need to know about inflammation. MedicalNewsToday. Dec. 11, 2023. Retrieved online Apr. 29, 2025 from: https://www.medicalnewstoday.com/articles/248423. 13 pages.
Sprunck et al., Indole-3-lactic acid is a weak auxin analogue but not an anti-auxin. J Plant Growth Regul. Oct. 1995; 14:191-197. doi: 10.1007/BF00204911.
Tavares et al., Bacillus subtilis endospores at high purity and recovery yields: optimization of growth conditions and purification method. Curr Microbiol. Mar. 2013;66(3):279-85. doi: 10.1007/s00284-012-0269-2. Epub Nov. 27, 2012. PMID: 23183956.
Toutain Pl, Pharmacokinetic/pharmacodynamic integration in drug development and dosage-regimen optimization for veterinary medicine. AAPS PharmSci. 2002;4(4):E38. doi: 10.1208/ps040438. 29 pages.
Uberoi et al., Commensal microbiota regulates skin barrier function and repair via signaling through the aryl hydrocarbon receptor. Cell Host Microbe. Aug. 11, 2021;29(8):1235-1248.e8. doi: 10.1016/j.chom.2021.05.011. Epub Jul. 1, 2021. Suppl Info, 8 pages.
Vazquez-Mendoza et al., Antimicrobial and bactericidal impacts of Bacillus amyloliquefaciens CECT 5940 on fecal shedding of pathogenic bacteria in dairy calves and adult dogs. Microb Pathog. Jan. 2018;114:458-463. doi: 10.1016/j.micpath.2017.11.040. Epub Nov. 24, 2017.
Xu et al., Water sorption characteristics of freeze-dried bacteria in low-moisture foods. Int J Food Microbiol. Feb. 2, 2022;362:109494. doi: 10.1016/j.ijfoodmicro.2021.109494. Epub Nov. 25, 2021. Author Manuscript, 33 pages.
Yang et al., Microaerobic Fermentation of Lactobacillus acidophilus within Gut Microbiome Physiological Conditions by BioFlo® Bioprocess Control Stations. Eppendorf. Sep. 2019; 412. 8 pages.
Yin et al., Improving probiotic spore yield using rice straw hydrolysate. Lett Appl Microbiol. Feb. 2021;72(2):149-156. doi: 10.1111/lam.13387. Epub Nov. 8, 2020.
Yu et al., A tryptophan metabolite of the skin microbiota attenuates inflammation in patients with atopic dermatitis through the aryl hydrocarbon receptor. J Allergy Clin Immunol. Jun. 2019;143(6):2108-2119.e12. doi: 10.1016/j.jaci.2018.11.036. Epub Dec. 20, 2018. 45.
Zelante et al., Regulation of host physiology and immunity by microbial indole-3-aldehyde. Curr Opin Immunol. Jun. 2021;70:27-32. doi: 10.1016/j.coi.2020.12.004. Epub Jan. 14, 2021.
ZHANG., Melt-Extruded Eudragit® FS-Based Granules for Colonic Drug Delivery. AAPS PharmSciTech. Feb. 2016; 17(1):56-67. doi: 10.1208/s12249-015-0357-2. Epub Jul. 11, 2015.
Zhao et al., From gut to skin: exploring the potential of natural products targeting microorganisms for atopic dermatitis treatment. Food Funct. Aug. 29, 2023;14(17):7825-7852. doi: 10.1039/d3fo02455e.
Zheng et al., A taxonomic note on the genus Lactobacillus: Description of 23 novel genera, emended description of the genus Lactobacillus Beijerinck 1901, and union of Lactobacilluseae and Leuconostocaceae. Int J Syst Evol Microbiol. Apr. 2020;70(4):2782-2858. doi: 10.1099/ijsem.0.004107. Epub Apr. 15, 2020.

\* cited by examiner

COMPOSITIONS CONTAINING INDOLE-DERIVED METABOLITES AND METHODS OF USE THEREOF

RELATED APPLICATIONS

This application claims the benefit under 35 U.S.C. § 119(e) of the earlier filing dates of U.S. Provisional Application No. 63/557,070, filed Feb. 23, 2024, and U.S. Provisional Application No. 63/738,662, filed Dec. 24, 2024, the contents of each of which are incorporated by reference herein in their entirety.

GOVERNMENT LICENSE RIGHTS

This invention was made with government support under Award #2054208 from the National Science Foundation (NSF). The government has certain rights in the invention.

REFERENCE TO AN ELECTRONIC SEQUENCE LISTING

The contents of the electronic sequence listing (I055870006US03-SEQ-NTJ.xml; Size: 24,928,554 bytes; and Date of Creation: Feb. 21, 2025) are herein incorporated by reference in their entirety.

BACKGROUND

Ingestion of safe bacteria with the intention of benefiting one's health is a centuries old practice that has seen a surge of interest in the early 21st century due to a better mechanistic understanding of the influence of the microbiome on organismal health. Application of these beneficial microbes, such as probiotics and postbiotics, is now being used in companion animals, namely canines, with the aim to modulate immune responses to combat undesirable symptoms e.g., itching, diarrhea, vomiting.

SUMMARY

Aspects of the disclosure relate to compositions and methods for reducing inflammation in mammals, such as companion dogs. Provided are compositions comprising bacterial fermentates that include indole-containing metabolites (e.g., indole-3-lactic acid (ILA) and indole-3-carboxaldehyde (IAld)). Without wishing to be bound by any particular theory, such indole-containing molecules are thought to act as agonists of the aryl hydrocarbon receptor (AhR), with signal transduction following stimulation having immunoregulatory effects and modulating inflammation. The presence of ILA and/or IAld, and optionally other indole-containing compounds that act as AhR agonists, is thus expected to improve homeostasis by stimulating the AhR in a subject. Also without wishing to be bound by another particular theory, ILA is thought to be converted into indole-3-propionic acid (IPA) by host microorganisms (e.g., microbes in the gut), with such produced IPA providing antioxidant and anti-inflammatory effects independently of AhR stimulation. Accordingly, the benefits of fermentates and/or compositions comprising fermentates are not limited to those arising from the presence of ILA and IAld alone.

It was discovered, surprisingly, that while a bacterial strain may be capable of producing multiple indole-containing compounds from tryptophan as a substrate, the extent of ILA and IAld production varies with fermentation conditions, such that preferential production of ILA or IAld can be achieved by varying conditions in separate fermentations. Glucose concentration was found to affect the production of ILA, such that ILA abundance in a fermentate could be increased by increasing glucose concentration. Production of IAld, however, was influenced by the abundance of nitrogen sources (e.g., yeast extract and peptones), such that production of higher amounts of IAld could be achieved by increasing the amount of nitrogen in a fermentation medium. And, while IAld could also be increased by reducing glucose concentrations (e.g., to levels below 4 g/L), low glucose concentrations limit the availability of carbon for bacterial metabolism. Providing glucose in intermediate concentrations, together with nitrogen, however, allowed for robust IAld production with reduced abundance of ILA, compared to a separate fermentation in which high glucose concentrations are used to promote ILA production.

It was thus determined that separate fermentations under distinct conditions allows for separately (i) preferential and high production of ILA, and (ii) preferential and high production of IAld, allowing for the production of postbiotic compositions containing high amounts of both ILA and IAld by separate fermentations to produce high amounts of each, and then combining the fermentates. Additionally, producing separate fermentates under separate conditions allows for the production of fermentate mixtures with desired ratios of ILA and IAld for formulation in a composition (e.g., nutritional supplement or food product) for administration with desired doses of ILA and IAld. In contrast to previous fermentation of a bacterium in a single batch, where conditions favorable to production of one metabolite may hinder the other and vice versa, the preferential production of different compounds in separate fermentations allows for the production of postbiotic compositions comprising high amounts of multiple beneficial compounds, such as ILA and IAld, as well as production of postbiotic compositions comprising desired ratios of ILA and IAld.

Thus, in some aspects, provided are methods of preparing a composition containing high concentrations of both ILA and IAld, by separately fermenting a single bacterial strain under different conditions, such that separate fermentates containing high concentrations of different metabolites are produced and may be combined to produce a composition with improved AhR agonist activity. *Pediococcus acidilactici* is one such bacterium that produces varying amounts of ILA and IAld under different fermentation conditions. For example, supplementation of fermentation medium with 4-15 g/L glucose, and inclusion of polysorbate 80, vitamin B12, and manganese improved ILA concentration, whereas IAld concentration was highest when polysorbate 80, vitamin B12, and manganese were omitted, and fermentation media contained less than 4 g/L glucose. As another example, *Lactiplantibacillus plantarum, Bifidobacterium adolescentis, Bifidobacterium bifidum, Bifidobacterium longum, Lactobacillus acidophilus, Lactobacillus delbrueckii, Lactobacillus helveticus, Lactobacillus reuteri*, and *Lactococcus lactis* are capable of ILA production. Additionally, other bacterial strains belonging to species *Bacillus subtilis, Weizmannia coagulans, Bacillus pumilus, Bacillus licheniformis*, and *Bacillus velezensis* produce other indole-containing compounds, such as indole-3-acetic acid (IAA).

In addition to the benefits of AhR agonist activity from indoles, e.g., ILA and IAld, fermentates may be produced using bacterial strains that produce low levels of undesired indole-containing compounds or do not produce such undesired compounds at all. In comparison to use of tryptophan itself, which may be converted into a number of compounds by gut microbiota, the use of fermentates comprising specified compounds but that lack or have only low levels of undesired compounds allows such fermentate-containing compositions to avoid unwanted side effects of tryptophan metabolism into such undesired compounds (e.g., indoxyl sulfate).

Accordingly, some aspects of the disclosure relate to a postbiotic composition comprising a first fermentate and a second fermentate of a bacterial strain, the bacterial strain comprising a 16S rDNA sequence with at least 97% sequence identity to the nucleotide sequence of SEQ ID NO: 1 (*Pediococcus acidilactici*) or SEQ ID NO: 7 (*Lactiplantibacillus plantarum*), and wherein the first fermentate comprises indole-3-lactic acid (ILA) and the second fermentate comprises indole-3-carboxaldehyde (IAld). In some embodiments, the bacterial strain comprises a 16S rDNA sequence with at least 99% sequence identity to SEQ ID NO: 1. In some embodiments, the bacterial strain belongs to the species *Pediococcus acidilactici*. In some embodiments, the bacterial strain comprises a genome with at least 95.0% average nucleotide identity (ANI) and an alignment fraction (AF) of at least 20.0% to the reference genome of SEQ ID NO: 8. In some embodiments, the bacterial strain comprises a genome with at least 95.0% average nucleotide identity and an alignment fraction of at least 50.0% to the reference genome of SEQ ID NO: 8. In some embodiments, the first fermentate is produced by incubating the bacterial strain under aerobic or microaerobic conditions in a fermentation medium comprising: 1 g/L to 12 g/L tryptophan; 4 g/L to 15 g/L glucose; and one or more of polysorbate 80, manganese, and vitamin B12. In some embodiments, the second fermentate is produced by incubating the bacterial strain under the following conditions: 1 g/L to 12 g/L tryptophan; less than 4 g/L glucose; and no detectable polysorbate 80, no detectable manganese, and no detectable vitamin B12. In some embodiments, a bacterial strain belonging to the species *Clostridium sporogenes* produces indole-3-propionic acid (IPA) in the presence of the postbiotic composition.

Some aspects relate to a postbiotic composition comprising two or more fermentates of one or more bacterial strains, wherein a first fermentate comprises indole-3-lactic acid (ILA), and a second fermentate comprises indole-3-carboxaldehyde (IAld).

In some embodiments, the postbiotic composition further comprises indole-3-pyruvic acid (IPyA), indole-3-propionic acid (IPA), 3-indoleacrylic acid (IA), and/or indole-3-acetic acid (IAA).

In some embodiments, the first fermentate and/or the second fermentate further comprises indole-3-pyruvic acid (IPyA) and/or indole-3-propionic acid (IPA). In some embodiments, the postbiotic composition does not comprise indole-3-acetic acid (IAA).

In some embodiments, the postbiotic composition further comprises one or more additional fermentates of one or more additional bacterial strains selected from the group consisting of *Bacillus licheniformis, Bacillus pumilus, Bacillus subtilis, Bacillus velezensis, Weizmannia coagulans*, and *Lactiplantibacillus plantarum*. In some embodiments, the one or more additional fermentates comprise ILA. In some embodiments, the one or more additional fermentates comprise IAld. In some embodiments, the one or more additional fermentates comprise IPyA and/or IPA. In some embodiments, the postbiotic composition comprises at least 0.1% (w/w) ILA. In some embodiments, the postbiotic composition comprises at least 0.015% (w/w) IAld.

In some embodiments, the postbiotic composition further comprises IPyA and/or IPA. In some embodiments, the postbiotic composition comprises at least 10% w/w IPyA relative to ILA. In some embodiments, the postbiotic composition comprises at least 1% w/w IPA relative to IAld. In some embodiments, the postbiotic composition comprises at least 10% w/w IAA relative to ILA.

In some embodiments, the postbiotic composition comprises less than 200% w/w tryptophan relative to ILA. In some embodiments, the postbiotic composition does not comprise indoxyl sulfate. In some embodiments, the postbiotic composition comprises less than 10% w/w indole-3-acetic acid (IAA) relative to ILA. In some embodiments, the postbiotic composition comprises less than 0.5% w/w tryptamine relative to ILA. In some embodiments, the postbiotic composition comprises less than 0.5% w/w indole-3-acetamide relative to ILA.

In some embodiments, each of the fermentates is in powdered form. In some embodiments, each of the fermentates is lyophilized or spray-dried.

In some embodiments, each of the fermentates is present in an amount of 0.1 to 1000 mg. In some embodiments, the postbiotic composition comprises a total amount of fermentates of 0.2 to 2000 mg.

In some embodiments, the postbiotic composition further comprises an excipient. In some embodiments, the excipient is a tapioca-based maltodextrin.

In some embodiments, the postbiotic composition is in a form for topical administration. In some embodiments, the postbiotic composition is in a form for oral administration. In some embodiments, the postbiotic composition is in the form of a dry flowable powder.

In some embodiments, the postbiotic composition reduces inflammation in a subject. In some embodiments, the postbiotic composition treats or prevents a symptom of inflammation in a subject. In some embodiments, the postbiotic composition treats or prevents diarrhea in a subject. In some embodiments, the postbiotic composition treats or prevents vomiting in a subject. In some embodiments, the postbiotic composition treats or prevents itching in a subject. In some embodiments, the postbiotic composition treats or prevents a symptom of allergy in a subject.

In some embodiments, the subject is a carnivore. In some embodiments, the subject is a mammal. In some embodiments, the subject is a domesticated animal. In some embodiments, the subject is a dog, cat, rabbit, guinea pig, hamster, or ferret. In some embodiments, the subject is a dog.

Some aspects relate to a nutritional supplement or food product comprising a postbiotic composition described herein. In some embodiments, the nutritional supplement or food product comprises a meat or animal-derived material. In some embodiments, the meat or animal-derived material is beef, chicken, eggs, turkey, lamb, fish, blood marrow, and/or bone marrow. In some embodiments, the nutritional supplement or food product comprises a grain. In some embodiments, the grain is wheat, corn, rice, oats, and/or barley. In some embodiments, the nutritional supplement or food product comprises a fiber. In some embodiments, the fiber is sugar beet pulp, chicory pulp, chicory, coconut endosperm fiber, wheat fiber, fructooligosaccharides, galactooligosaccharides, and/or inulin.

In some embodiments, the nutritional supplement or food product comprises an algae. In some embodiments, the algae is *Ascophyllum nodosum, Spirulina*, and/or *Fucus vesiculosus*.

In some embodiments, the nutritional supplement or food product comprises a gelatinized starch matrix.

Some aspects relate to a topical preparation comprising a postbiotic composition as described herein. Form factors of compositions suitable for administration include, without limitation, shampoos (liquid cleansing preparations), creams (semi-solid, water-based emulsions), ointments (viscous, greasy preparations with an oil base), sprays (liquids formulated in aerosol or pump form), spot-on solutions (liquid preparations formulated for application to a single area of a surface), lotions (semi-solid, water-based emulsions less viscous than creams), gels (semi-solid preparations, which are typically clear), foams (aerated preparations that are dispensed as mousse), balms (waxy preparations for coating a surface), and powders (dry preparations for dusting a surface). In some embodiments, a postbiotic composition is in the form of a shampoo. In some embodiments, a postbiotic composition is in the form of a cream. In some embodiments, a postbiotic composition is in the form of an ointment. In some embodiments, a postbiotic composition is in the form of a spray. In some embodiments, a postbiotic composition is in the form of a spot-on solution. In some embodiments, a postbiotic composition is in the form of a lotion. In some embodiments, a postbiotic composition is in the form of a gel. In some embodiments, a postbiotic composition is in the form of a foam. In some embodiments, a postbiotic composition is in the form of a balm. In some embodiments, a postbiotic composition is in the form of a powder.

Some aspects relate to a method comprising administering a postbiotic composition, nutritional supplement or food product as described herein, to a subject in need thereof. In some embodiments, the administration is oral administration. In some embodiments, the administration is topical administration.

In some embodiments, the administering: (i) reduces inflammation in the subject; (ii) treats or prevents a symptom of inflammation in the subject; (iii) treats or prevents diarrhea in the subject; (iv) treats or prevents vomiting in the subject; (v) treats or prevents itching in the subject; and/or (vi) treats or prevents a symptom of allergy in the subject. In some embodiments, the administering: (i) treats or prevents skin inflammation, skin irritation, and/or skin damage in the subject; (ii) treats or prevents gut inflammation or gastrointestinal distress in the subject; (iii) treats or prevents neuroinflammation in the subject; (iv) treats or prevents weight-related inflammation in the subject; (v) limits weight gain in the subject; (vi) promotes weight loss in the subject; (vii) treats or prevents overweight status or obesity in the subject; (viii) treats or prevents anxiety in the subject; (ix) treats or prevents seasonal allergy in the subject; (x) treats or prevents food allergy in the subject; and/or (xi) improves coat quality in the subject.

In some embodiments, the subject is a carnivore. In some embodiments, the subject is a mammal. In some embodiments, the subject is a domesticated animal. In some embodiments, the subject is a dog, cat, rabbit, guinea pig, hamster, or ferret. In some embodiments, the subject is a dog. In some embodiments, the subject is a cat.

Some aspects relate to a method for producing a postbiotic composition, the method comprising: (i) fermenting a first bacterial strain comprising a 16S rDNA sequence with at least 97% sequence identity to the nucleotide sequence of SEQ ID NO: 1 (*Pediococcus acidlactici*) or SEQ ID NO: 7 (*Lactiplantibacillus plantarum*) in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld; and (iii) combining the first and second fermentates to produce a postbiotic composition comprising ILA and IAld. In some embodiments, the bacterial strain comprises a 16S rDNA sequence with at least 99% sequence identity to SEQ ID NO: 1. In some embodiments, the bacterial strain belongs to the species *Pediococcus acidilactici*. In some embodiments, the bacterial strain comprises a genome with at least 95.0% average nucleotide identity (ANI) and an alignment fraction (AF) of at least 20.0% to the reference genome of SEQ ID NO: 8. In some embodiments, the bacterial strain comprises a genome with at least 95.0% average nucleotide identity (ANI) and an alignment fraction (AF) of at least 50.0% to the reference genome of SEQ ID NO: 8. In some embodiments, the first fermentate is produced by incubating the bacterial strain under aerobic or microaerobic conditions in a fermentation medium comprising: 1 g/L to 12 g/L tryptophan; 4 g/L to 15 g/L glucose; and one or more of polysorbate 80, manganese, and vitamin B12. In some embodiments, the second fermentate is produced by incubating the bacterial strain under the following conditions: 1 g/L to 12 g/L tryptophan; less than 4 g/L glucose; and no detectable polysorbate 80, no detectable manganese, and no detectable vitamin B12. In some embodiments, a bacterial strain belonging to the species *Clostridium sporogenes* produces indole-3-propionic acid (IPA) in the presence of the postbiotic composition.

In some embodiments, the first and/or second fermentate further comprises indole-3-pyruvic acid (IPyA) and/or indole-3-propionic acid (IPA). In some embodiments, the first and/or second fermentate further comprises 3-indoleacrylic acid (IA), and/or indole-3-acetic acid (IAA).

In some embodiments, the method further comprises fermenting one or more additional bacterial strains to produce one or more additional fermentates, and combining the one or more additional fermentates with the first and second fermentates or the postbiotic composition, wherein the one or more additional bacterial strains are selected from the group consisting of *Bacillus licheniformis, Bacillus pumilus, Bacillus subtilis, Bacillus velezensis, Weizmannia coagulans*.

In some embodiments, the one or more additional fermentates comprise ILA and/or IAld. In some embodiments, the one or more additional fermentates comprise IPyA and/or IPA. In some embodiments, the postbiotic composition comprises at least 0.1% (w/w) ILA. In some embodiments, the postbiotic composition comprises at least 0.015% (w/w) IAld.

In some embodiments, the postbiotic composition further comprises IPyA and/or IPA. In some embodiments, the postbiotic composition comprises at least 10% w/w IPyA relative to ILA. In some embodiments, the postbiotic composition comprises at least 1% w/w IPA relative to IAld.

In some embodiments, the postbiotic composition comprises less than 200% w/w tryptophan relative to ILA. In some embodiments, the postbiotic composition does not comprise indole. In some embodiments, the postbiotic composition does not comprise indoxyl sulfate. In some embodiments, the postbiotic composition comprises less than 10% w/w indole-3-acetic acid (IAA) relative to ILA. In some embodiments, the postbiotic composition comprises less than 0.5% w/w tryptamine relative to ILA. In some embodiments, the postbiotic composition comprises less than 0.5% w/w indole-3-acetamide relative to ILA.

In some embodiments, the first fermentate is produced by incubating the bacterial strain under microaerobic conditions in a fermentation medium comprising: 1 g/L to 50 g/L tryptophan; 100 g/L to 200 g/L glucose; manganese; and 10 g/L to 125 g/L of one or more nitrogen sources. In some embodiments, the second fermentate is produced by incubating the bacterial strain under aerobic conditions in a fermentation medium comprising: 1 g/L to 50 g/L tryptophan; 1 g/L to 100 g/L glucose; manganese; and 125 g/L to 200 g/L of one or more nitrogen sources. In some embodiments, the one or more nitrogen sources comprise yeast extract or peptones.

In some embodiments: the first fermentate is produced by incubating the bacterial strain under microaerobic conditions in a fermentation medium comprising 1 g/L to 50 g/L tryptophan, 4 g/L to 200 g/L glucose, and one or more of polysorbate 80, manganese, and vitamin B12; and the second fermentate is produced by incubating the bacterial strain under aerobic conditions in a fermentation medium comprising 1 g/L to 50 g/L tryptophan, 4 g/L to 200 g/L glucose; and one or more of polysorbate 80, manganese, and vitamin B12. In some embodiments: the first fermentate is produced by incubating the bacterial strain under aerobic conditions in a fermentation medium comprising 1 g/L to 50 g/L tryptophan, 4 g/L to 200 g/L glucose, and one or more of polysorbate 80, manganese, and vitamin B12; and the second fermentate is produced by incubating the bacterial strain under aerobic conditions in a fermentation medium comprising 1 g/L to 50 g/L tryptophan, less than 4 g/L glucose, no detectable polysorbate 80, no detectable manganese, and no detectable vitamin B12.

In some embodiments, the second fermentate comprises more IAld than the first fermentate. In some embodiments, the first fermentate comprises more ILA than the second fermentate.

In some embodiments, the first fermentation medium and/or the second fermentation medium comprises tryptophan at a concentration of 1 to 12 g/L.

In some embodiments, the first fermentation medium comprises glucose at a concentration of at least 4 g/L. In some embodiments, the first fermentation medium or the comprises glucose at a concentration of at least 4 to 15 g/L. In some embodiments, the second fermentation medium comprises glucose at a concentration of less than 4 g/L.

In some embodiments, the first fermentation medium comprises polysorbate 80, manganese, and/or vitamin B12. In some embodiments, the second fermentation medium does not comprise polysorbate 80, does not comprise manganese, and does not comprise vitamin B12.

In some embodiments, the fermenting of (i) and/or the fermenting of (ii) is for 2 to 7 days. In some embodiments, the fermenting of (i) and/or the fermenting of (ii) is under aerobic or microaerobic conditions.

In some embodiments, the method further comprises separating bacterial cells from the first fermentate and/or second fermentate before combining the first and second fermentates. In some embodiments, the method further comprises heat-killing bacterial strains in the first fermentate and/or second fermentate before combining the first and second fermentates. In some embodiments, the method further comprises concentrating the first fermentate and/or second fermentate before combining the first and second fermentates. In some embodiments, the method further comprises drying the first fermentate and/or second fermentate before combining the first and second fermentates.

Some aspects relate to a postbiotic composition produced by a method described herein.

BRIEF DESCRIPTION OF THE DRAWINGS

The accompanying drawings, which constitute a part of this specification, illustrate several embodiments of the disclosure and together with the description, serve to explain the principles of the disclosure.

FIGS. 8A-9B show results of a double-blind, multi-group controlled study as described in Example 4, which was conducted to evaluate the efficacy of the postbiotic of Example 2, containing the first and second fermentates of Strain 1 in reducing canine itching. FIG. 8A shows change in seconds scratching per day, by group, as measured by activity monitor. Lines and error bars indicate the mean and standard deviation. Points represent individual participant data. FIG. 9B shows Taxa with significant log-fold changes in placebo control (top) and postbiotic (bottom) groups.

DETAILED DESCRIPTION

Figure 1:
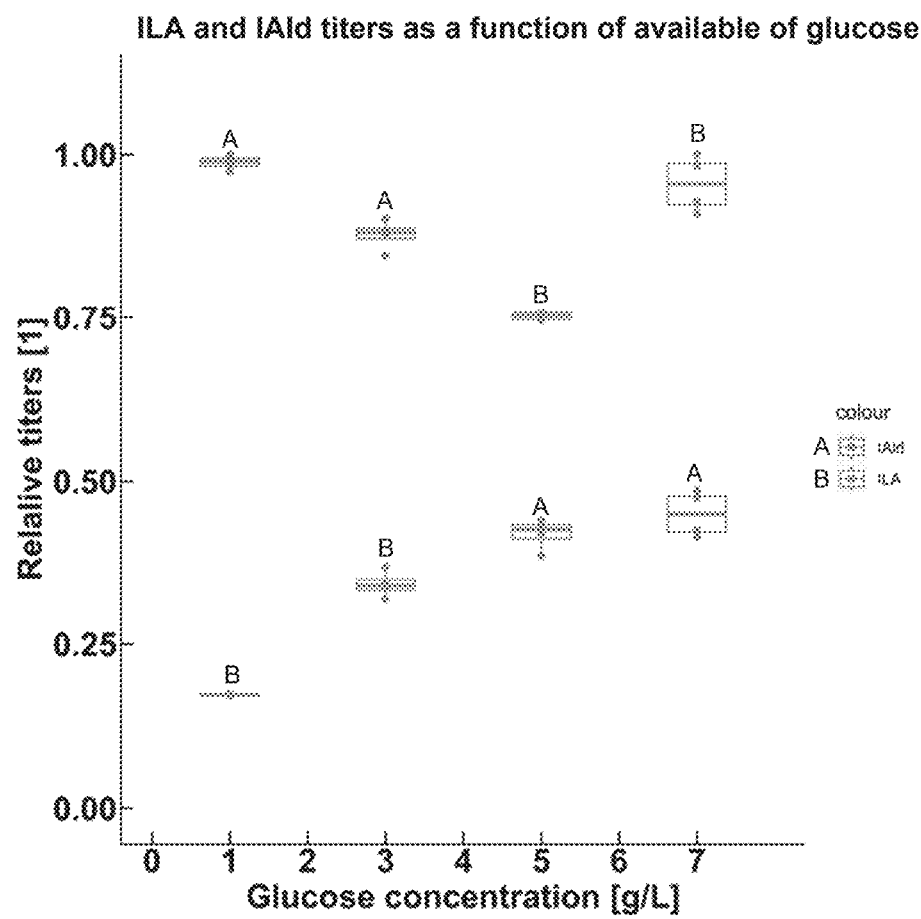
FIG. 1 shows relative indole-3-lactic acid (ILA) and indole-3-carboxaldehyde (IAld) titers obtained during fermentation with *Pediococcus acidilactici* at different glucose concentrations.

Aspects of the disclosure relate to compositions, nutritional supplements, and/or food products comprising fermentates of one or more bacterial strains that contain indole-containing molecules including indole-3-lactic acid (ILA) and indole-3-carboxaldehyde (IAld). Without wishing to be bound by any particular theory, indole-containing molecules produced by metabolism of L-tryptophan, such as ILA and IAld, are thought to act as agonists for the aryl hydrocarbon receptor (AhR). Ligand-binding to AhR facilitates a conformational change exposing the nuclear localization signal, causing translocation to the nucleus, and dimerization of ligand-bound AhR with AHR-nuclear translocator (ARNT) to produce a transcription factor complex that causes chromatin remodeling and transcription of target genes, including IL6, IL22, vascular endothelial growth factor A (VEGFA), cytochrome P450 1A1 (CYP1A1), cytochrome P450 1B1 (CYP1B1), and prostaglandin G/H synthase 2 (PTGS2). See, e.g., Hubbard et al., *Drug Metab Dispos*. (2015) 43(10):1522-1535. Indole-containing molecules (e.g., indole-3-carbinol, or indole) have been shown to inhibit proinflammatory responses in vivo and increase barrier function in intestinal epithelial cells. Without wishing to be bound by a particular theory, the compositions described herein comprising fermentates including ILA and IAld are useful for stimulation of AhRs, particularly canine AhR, thereby promoting homeostasis by alleviating inflammation and promoting tissue barrier integrity. Fermentates of other bacterial strains may also comprise ILA or IAld, and/or other indole-containing compounds when appropriately cultured, such as indole-3-pyruvic acid (IpyA), indole-3-propionic acid (IPA), 3-indoleacrylic acid (IA), and indole-3-acetic acid (IAA).

Embodiments of compositions and methods described herein relate to combinations of ILA and IAld. It was discovered that these compounds act as AhR agonists, in particular for canine AhRs on cultured canine cells. Bacterial strains, such as *Pediococcus acidilactici* and *Lactiplantibacillus plantarum*, were able to produce both ILA and IAld. It was also discovered that common fermentation conditions (e.g., adequate tryptophan concentration, similar duration, similar temperature) could be used to produce both compounds, but variations in glucose concentration and supplementation with manganese, polysorbate 80, and vitamin B12 could be used to direct fermentation towards preferential production of one compound or the other. For example, glucose concentrations between 4-15 g/L and inclusion of manganese, polysorbate 80, and vitamin B12 supplementation provided the highest amount of ILA, while glucose concentrations below 4 g/L and lack of manganese, polysorbate 80, and vitamin B12 supplementation provided the highest amounts of IAld. Separate fermentations under different conditions allow for separate preferential and high production of each compound, with combinations of the resulting fermentates providing compositions rich in both ILA and IAld. Such high concentrations of both ILA and IAld is contrasted with that achieved using a single fermentation, as the Examples demonstrate that conditions favorable to production of ILA may hinder production of IAld and vice versa (see Example 1). These and other fermentates of other bacterial strains, such as *Bacillus subtilis, Weizmannia coagulans, Bacillus pumilus, Bacillus licheniformis*, and *Bacillus velezensis*, may be used to produce postbiotic compositions comprising ILA and IAld, and optionally other indole-containing compounds such as IPA, IPyA, IA, and IAA.

Compositions comprising bacteria and/or fermentates thereof may be in any suitable form, such as a dry powder that may be combined with other compositions (e.g., combination with food prior to a meal). Compositions comprising bacteria may also be present as part of another composition, such as a pill, capsule, tablet, chewable matrix, nutritional supplement, and/or food product.

This disclosure is not limited in its application to the details of construction and the arrangement of components set forth in the following description or illustrated in the drawings. The disclosure is capable of other embodiments and of being practiced or of being carried out in various ways. Also, the phraseology and terminology used herein is for the purpose of description and should not be regarded as limiting. The use of "including," "comprising," or "having," "containing," "involving," and variations thereof herein, is meant to encompass the items listed thereafter and equivalents thereof as well as additional items.

Bacterial Strains and Fermentates Thereof

Some aspects relate to compositions comprising a bacterial fermentate mixture comprising two or more bacterial fermentates, the first fermentate comprising ILA, and the second fermentate comprising more IAld than the first fermentate. First and second fermentates may be produced by the same bacterial strain, or different bacterial strains.

Some aspects relate to compositions (and/or nutritional supplements and/or food products comprising a composition) comprising both a first fermentate of a bacterial strain and a second fermentate of the same bacterial strain, where the first fermentate comprises ILA, and the second fermentate comprises IAld.

Some aspects relate to compositions (and/or nutritional supplements and/or food products comprising a composition) comprising both a first fermentate of a bacterial strain of *Pediococcus acidilactici*, and a second fermentate of the same bacterial strain of *Pediococcus acidilactici*, where the first fermentate comprises ILA, and the second fermentate comprises IAld.

Some aspects relate to compositions (and/or nutritional supplements and/or food products comprising a composition) comprising both a first fermentate of a bacterial strain comprising a 16S rDNA sequence with at least 97% sequence identity to SEQ ID NO: 1, and a second fermentate of the same bacterial strain comprising the same 16S rDNA sequence, where the first fermentate comprises ILA, and the second fermentate comprises IAld. In some embodiments, a bacterial strain, e.g., that produces a fermentate, has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 1.

Some aspects relate to compositions (e.g., postbiotic compositions) (and/or nutritional supplements and/or food products comprising a composition) comprising both a first fermentate of a bacterial strain of *Lactiplantibacillus plantarum*, and a second fermentate of the same bacterial strain of *Lactiplantibacillus plantarum*, where the first fermentate comprises ILA, and the second fermentate comprises IAld.

Some aspects relate to compositions (e.g., postbiotic compositions) (and/or nutritional supplements and/or food products comprising a composition) comprising both a first fermentate of a bacterial strain comprising a 16S rDNA sequence with at least 97% sequence identity to SEQ ID NO: 7, and a second fermentate of the same bacterial strain comprising the same 16S rDNA sequence, where the first fermentate comprises ILA, and the second fermentate comprises IAld. In some embodiments, a bacterial strain, e.g., that produces a fermentate, has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 7.

Where reference is made to a first fermentate and a second fermentate, the first and second fermentates are to be understood as not being identical in composition, and may contain additional indole-containing compounds beyond those specified. In some embodiments, the first fermentate comprises ILA at a higher amount than IAld. In some embodiments, the second fermentate comprises IAld at a higher amount than ILA. In some embodiments, the first fermentate comprises ILA at a higher amount than IAld, and the second fermentate comprises IAld at a higher amount than ILA.

In some embodiments, a composition (e.g., postbiotic composition) further comprises one or more additional fermentates of one or more additional bacterial strains. Additional fermentates of additional bacterial strains may comprise, for instance, ILA and/or IAld, thereby contributing to increased ILA and/or IAld content of the composition.

In some embodiments, an additional fermentate comprises ILA. In some embodiments, an additional fermentate comprises IAld. In some embodiments, an additional fermentate comprises ILA and IAld.

Additional fermentates of additional bacterial strains may comprise one or more other indole-containing compounds. Such other indole-containing compounds may also contribute to AhR stimulation and its consequent benefits in mitigating inflammation and other symptoms thereof.

In some embodiments, an additional fermentate comprises IPyA. In some embodiments, an additional fermentate comprises IPA. In some embodiments, an additional fermentate comprises IPyA and IPA.

In some embodiments, an additional fermentate comprises IA. In some embodiments, an additional fermentate comprises IAA. In some embodiments, an additional fermentate comprises IA and IAA.

Exemplary bacterial strains capable of producing indole-containing compounds, including ILA, IAld, IPyA, IPA, IA, and/or IAA, are provided below in Table 1. Any bacterial strain corresponding to those of Table 1 (e.g., belonging to the same species, comprising a 16S rDNA sequence with a specified percentage identity to a reference 16S rDNA sequence, and/or comprising a genome with a specified average nucleotide identity (ANI) and alignment fraction (AF) to a reference genome) may be used in production of one or more fermentates (e.g., first fermentate, second fermentate, and/or additional fermentate).

TABLE 1

Exemplary bacterial strains capable of producing indole-containing compounds.

| Bacterial strain (closest species) | SEQ ID NO. of 16S rDNA | SEQ ID NO. of Genome (N50 score) | Species Representative Genome(s) (GTDB Release 220) |
|---|---|---|---|
| 1 (*Pediococcus acidilactici*) | 1 | 8 (314354) | GCF_000146325.1 GCF_024970065.1 |
| 2 (*Bacillus licheniformis*) | 2 | 9 (605102) | GCF_000011645.1 |
| 3 (*Bacillus pumilus*) | 3 | 10 (797020) | GCF_900186955.1 GCA_001938995.1 GCF_002744245.1 GCF_003431975.1 GCF_009937765.1 GCF_024498355.1 |
| 4 (*Bacillus subtilis*) | 4 | 11 (632443) | GCF_000009045.1 GCF_002153395.1 |
| 5 (*Bacillus velezensis*) | 5 | 12 (714467) | GCF_001461825.1 |
| 6 (*Weizmannia coagulans*) | 6 | 13 (58861) | GCF_000290615.1 |
| 7 (*Lactiplantibacillus plantarum*) | 7 | 14 (77972) | GCF_014131735.1 GCA_000463075.2 |
| 8 (*Bifidobacterium adolescentis*) | 15 | | GCF_000010425.1 |
| 9 (*Bifidobacterium bifidum*) | 16 | | GCF_001025135.1 |
| 10 (*Bifidobacterium longum*) | 17 | | GCF_000196555.1 GCA_905202265.1 |
| 11 (*Lactobacillus acidophilus*) | 18 | | GCF_001591845.1 |
| 12 (*Lactobacillus delbrueckii*) | 19 | | GCF_001433875.1 GCA_004556255.1 |
| 13 (*Lactobacillus helveticus*) | 20 | | GCF_00160855.1 |
| 14 (*Lactobacillus reuteri*) | 21 | | GCF_000016825.1 GCF_003072625.1 GCF_013694365.1 GCF_020784725.1 GCF_012971035.1 GCF_020784195.1 |
| 15 (*Lactococcus lactis*) | 22 | | GCF_029023865.1 |

In some embodiments, a composition comprises one or more fermentates (e.g., first, second, and/or additional fermentates) of a bacterial strain comprising at 16S rDNA sequence with at least 97% sequence identity to SEQ ID NO: 1. In some embodiments, a composition comprises one or more fermentates (e.g., first, second, and/or additional fermentates) of a bacterial strain comprising at 16S rDNA sequence with at least 97% sequence identity to SEQ ID NO: 2. In some embodiments, a composition comprises one or more fermentates (e.g., first, second, and/or additional fermentates) of a bacterial strain comprising at 16S rDNA sequence with at least 97% sequence identity to SEQ ID NO: 3. In some embodiments, a composition comprises one or more fermentates (e.g., first, second, and/or additional fermentates) of a bacterial strain comprising at 16S rDNA sequence with at least 97% sequence identity to SEQ ID NO: 4. In some embodiments, a composition comprises one or more fermentates (e.g., first, second, and/or additional fermentates) of a bacterial strain comprising at 16S rDNA sequence with at least 97% sequence identity to SEQ ID NO: 5. In some embodiments, a composition comprises one or more fermentates (e.g., first, second, and/or additional fermentates) of a bacterial strain comprising at 16S rDNA sequence with at least 97% sequence identity to SEQ ID NO: 6. In some embodiments, a composition comprises one or more fermentates (e.g., first, second, and/or additional fermentates) of a bacterial strain comprising at 16S rDNA sequence with at least 97% sequence identity to SEQ ID NO: 7. In some embodiments, a composition comprises one or more fermentates (e.g., first, second, and/or additional fermentates) of a bacterial strain comprising at 16S rDNA sequence with at least 97% sequence identity to SEQ ID NO: 15. In some embodiments, a composition comprises one or more fermentates (e.g., first, second, and/or additional fermentates) of a bacterial strain comprising at 16S rDNA sequence with at least 97% sequence identity to SEQ ID NO: 16. In some embodiments, a composition comprises one or more fermentates (e.g., first, second, and/or additional fermentates) of a bacterial strain comprising at 16S rDNA sequence with at least 97% sequence identity to SEQ ID NO: 17. In some embodiments, a composition comprises one or more fermentates (e.g., first, second, and/or additional fermentates) of a bacterial strain comprising at 16S rDNA sequence with at least 97% sequence identity to SEQ ID NO: 18. In some embodiments, a composition comprises one or more fermentates (e.g., first, second, and/or additional fermentates) of a bacterial strain comprising at 16S rDNA sequence with at least 97% sequence identity to SEQ ID NO: 19. In some embodiments, a composition comprises one or more fermentates (e.g., first, second, and/or additional fermentates) of a bacterial strain comprising at 16S rDNA sequence with at least 97% sequence identity to SEQ ID NO: 20. In some embodiments, a composition comprises one or more fermentates (e.g., first, second, and/or additional fermentates) of a bacterial strain comprising at 16S rDNA sequence with at least 97% sequence identity to SEQ ID NO: 21. In some embodiments, a composition comprises one or more fermentates (e.g., first, second, and/or additional fermentates) of a bacterial strain comprising at 16S rDNA sequence with at least 97% sequence identity to SEQ ID NO: 22.

In some embodiments, a composition comprises one or more fermentates (e.g., first, second, and/or additional fermentates) of a bacterial strain comprising at 16S rDNA sequence with at least 99% sequence identity to SEQ ID NO: 1. In some embodiments, a composition comprises one or more fermentates (e.g., first, second, and/or additional fermentates) of a bacterial strain comprising at 16S rDNA sequence with at least 99% sequence identity to SEQ ID NO: 2. In some embodiments, a composition comprises one or more fermentates (e.g., first, second, and/or additional fermentates) of a bacterial strain comprising at 16S rDNA sequence with at least 99% sequence identity to SEQ ID NO: 3. In some embodiments, a composition comprises one or more fermentates (e.g., first, second, and/or additional fermentates) of a bacterial strain comprising at 16S rDNA sequence with at least 99% sequence identity to SEQ ID NO: 4. In some embodiments, a composition comprises one or more fermentates (e.g., first, second, and/or additional fermentates) of a bacterial strain comprising at 16S rDNA sequence with at least 99% sequence identity to SEQ ID NO: 5. In some embodiments, a composition comprises one or more fermentates (e.g., first, second, and/or additional fermentates) of a bacterial strain comprising at 16S rDNA sequence with at least 99% sequence identity to SEQ ID NO: 6. In some embodiments, a composition comprises one or more fermentates (e.g., first, second, and/or additional fermentates) of a bacterial strain comprising at 16S rDNA sequence with at least 99% sequence identity to SEQ ID NO: 7. In some embodiments, a composition comprises one or more fermentates (e.g., first, second, and/or additional fermentates) of a bacterial strain comprising at 16S rDNA sequence with at least 99% sequence identity to SEQ ID NO: 15. In some embodiments, a composition comprises one or more fermentates (e.g., first, second, and/or additional fermentates) of a bacterial strain comprising at 16S rDNA sequence with at least 99% sequence identity to SEQ ID NO: 16. In some embodiments, a composition comprises one or more fermentates (e.g., first, second, and/or additional fermentates) of a bacterial strain comprising at 16S rDNA sequence with at least 99% sequence identity to SEQ ID NO: 17. In some embodiments, a composition comprises one or more fermentates (e.g., first, second, and/or additional fermentates) of a bacterial strain comprising at 16S rDNA sequence with at least 99% sequence identity to SEQ ID NO: 18. In some embodiments, a composition comprises one or more fermentates (e.g., first, second, and/or additional fermentates) of a bacterial strain comprising at 16S rDNA sequence with at least 99% sequence identity to SEQ ID NO: 19. In some embodiments, a composition comprises one or more fermentates (e.g., first, second, and/or additional fermentates) of a bacterial strain comprising at 16S rDNA sequence with at least 99% sequence identity to SEQ ID NO: 20. In some embodiments, a composition comprises one or more fermentates (e.g., first, second, and/or additional fermentates) of a bacterial strain comprising at 16S rDNA sequence with at least 99% sequence identity to SEQ ID NO: 21. In some embodiments, a composition comprises one or more fermentates (e.g., first, second, and/or additional fermentates) of a bacterial strain comprising at 16S rDNA sequence with at least 99% sequence identity to SEQ ID NO: 22.

In some embodiments, a composition comprises one or more fermentates (e.g., first, second, and/or additional fermentates) of a bacterial strain belonging to *Pediococcus acidilactici*. In some embodiments, a composition comprises one or more fermentates (e.g., first, second, and/or additional fermentates) of a bacterial strain belonging to *Bacillus licheniformis*. In some embodiments, a composition comprises one or more fermentates (e.g., first, second, and/or additional fermentates) of a bacterial strain belonging to *Bacillus pumilus*. In some embodiments, a composition comprises one or more fermentates (e.g., first, second, and/or additional fermentates) of a bacterial strain belonging to *Bacillus subtilis*. In some embodiments, a composition comprises one or more fermentates (e.g., first, second, and/or additional fermentates) of a bacterial strain belonging to *Bacillus velezensis*. In some embodiments, a composition comprises one or more fermentates (e.g., first, second, and/or additional fermentates) of a bacterial strain belonging to *Weizmannia coagulans*. In some embodiments, a composition comprises one or more fermentates (e.g., first, second, and/or additional fermentates) of a bacterial strain belonging to *Lactiplantibacillus plantarum*. In some embodiments, a composition comprises one or more fermentates (e.g., first, second, and/or additional fermentates) of a bacterial strain belonging to *Bifidobacterium adolescentis*. In some embodiments, a composition comprises one or more fermentates (e.g., first, second, and/or additional fermentates) of a bacterial strain belonging to *Bifidobacterium bifidum*. In some embodiments, a composition comprises one or more fermentates (e.g., first, second, and/or additional fermentates) of a bacterial strain belonging to *Bifidobacterium longum*. In some embodiments, a composition comprises one or more fermentates (e.g., first, second, and/or additional fermentates) of a bacterial strain belonging to *Lactobacillus aci-*

*dophilus*. In some embodiments, a composition comprises one or more fermentates (e.g., first, second, and/or additional fermentates) of a bacterial strain belonging to *Lactobacillus delbrueckii*. In some embodiments, a composition comprises one or more fermentates (e.g., first, second, and/or additional fermentates) of a bacterial strain belonging to *Lactobacillus helveticus*. In some embodiments, a composition comprises one or more fermentates (e.g., first, second, and/or additional fermentates) of a bacterial strain belonging to *Lactobacillus reuteri*. In some embodiments, a composition comprises one or more fermentates (e.g., first, second, and/or additional fermentates) of a bacterial strain belonging to *Lactococcus lactis*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 1. In some embodiments, the bacterial strain comprising a 16S rDNA sequence with at least 97% sequence identity to SEQ ID NO: 1 belongs to the species *Pediococcus acidilactici*. In some embodiments, the bacterial strain comprising a 16S rDNA sequence with at least 99% sequence identity to SEQ ID NO: 1 belongs to the species *Pediococcus acidilactici*. In some embodiments, the bacterial strain comprising a 16S rDNA sequence with at least 97% sequence identity to SEQ ID NO: 1 comprises a genome with at least 95.0% average nucleotide identity (ANI) and an alignment fraction (AF) of at least 20.0% to the reference genome of SEQ ID NO: 8. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 8. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 8.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 2. In some embodiments, the bacterial strain comprises a 16S rDNA sequence with at least 99% sequence identity to SEQ ID NO: 2. In some embodiments, the bacterial strain comprising a 16S rDNA sequence with at least 97% sequence identity to SEQ ID NO: 2 belongs to the species *Bacillus licheniformis*. In some embodiments, the bacterial strain comprises a 16S rDNA sequence with at least 99% sequence identity to SEQ ID NO: 9. In some embodiments, the bacterial strain comprising a 16S rDNA sequence with at least 97% sequence identity to SEQ ID NO: 9 comprises a genome with at least 95.0% average nucleotide identity (ANI) and an alignment fraction (AF) of at least 20.0% to the reference genome of SEQ ID NO: 9. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 9. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 9.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 3. In some embodiments, the bacterial strain comprises a 16S rDNA sequence with at least 99% sequence identity to SEQ ID NO: 3. In some embodiments, the bacterial strain comprising a 16S rDNA sequence with at least 97% sequence identity to SEQ ID NO: 3 belongs to the species *Bacillus pumilus*. In some embodiments, the bacterial strain comprising a 16S rDNA sequence with at least 97% sequence identity to SEQ ID NO: 10 comprises a genome with at least 95.0% average nucleotide identity (ANI) and an alignment fraction (AF) of at least 20.0% to the reference genome of SEQ ID NO: 10. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 10. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 10.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 4. In some embodiments, the bacterial strain comprises a 16S rDNA sequence with at least 99% sequence identity to SEQ ID NO: 4. In some embodiments, the bacterial strain comprising a 16S rDNA sequence with at least 97% sequence identity to SEQ ID NO: 4 belongs to the species *Bacillus subtilis*. In some embodiments, the bacterial strain comprising a 16S rDNA sequence with at least 97% sequence identity to SEQ ID NO: 11 comprises a genome with at least 95.0% average nucleotide identity (ANI) and an alignment fraction (AF) of at least 20.0% to the reference genome of SEQ ID NO: 11. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 11. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 11.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 5. In some embodiments, the bacterial strain comprises a 16S rDNA sequence with at least 99% sequence identity to SEQ ID NO: 5. In some embodiments, the bacterial strain comprising a 16S rDNA sequence with at least 97% sequence identity to SEQ ID NO: 5 belongs to the species *Bacillus velezensis*. In some embodiments, the bacterial strain comprising a 16S rDNA sequence with at least 97% sequence identity to SEQ ID NO: 12 comprises a genome with at least 95.0% average nucleotide identity (ANI) and an alignment fraction (AF) of at least 20.0% to the reference genome of SEQ ID NO: 12. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 12. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 12.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 6. In some embodiments, the bacterial strain comprises a 16S rDNA sequence with at least 99% sequence identity to SEQ ID NO: 6. In some embodiments, the bacterial strain comprising a 16S rDNA sequence with at least 97% sequence identity to SEQ ID NO: 6 belongs to the species *Weizmannia coagulans*. In some embodiments, the bacterial strain comprising a 16S rDNA sequence with at least 97% sequence identity to SEQ ID NO: 13 comprises a genome with at least 95.0% average nucleotide identity (ANI) and an alignment fraction (AF) of at least 20.0% to the reference genome of SEQ ID NO: 13. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 13. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 13.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 7. In some embodiments, the bacterial strain comprises a 16S rDNA sequence with at least 99% sequence identity to SEQ ID NO: 7. In some embodiments, the bacterial strain comprising a 16S rDNA sequence with at least 97% sequence identity to SEQ ID NO: 7 belongs to the species *Lactiplantibacillus plantarum*. In some embodiments, the bacterial strain comprising a 16S rDNA sequence with at least 97% identity to SEQ ID NO: 14 comprises a genome with at least 95.0% average nucleotide identity (ANI) and an alignment fraction (AF) of at least 20.0% to the reference genome of SEQ ID NO: 14. In some embodiments, the bacterial strain comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 14. In some embodiments, the bacterial strain comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 14.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 15. In some embodiments, the bacterial strain comprising a 16S rDNA sequence with at least 97% sequence identity to SEQ ID NO: 15 belongs to the species *Bifidobacterium adolescentis*. In some embodiments, the bacterial strain comprising a 16S rDNA sequence with at least 99% sequence identity to SEQ ID NO: 15 belongs to the species *Bifidobacterium adolescentis*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 16. In some embodiments, the bacterial strain comprising a 16S rDNA sequence with at least 97% sequence identity to SEQ ID NO:

16 belongs to the species *Bifidobacterium bifidum*. In some embodiments, the bacterial strain comprising a 16S rDNA sequence with at least 99% sequence identity to SEQ ID NO: 16 belongs to the species *Bifidobacterium bifidum*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 17. In some embodiments, the bacterial strain comprising a 16S rDNA sequence with at least 97% sequence identity to SEQ ID NO: 17 belongs to the species *Bifidobacterium longum*. In some embodiments, the bacterial strain comprising a 16S rDNA sequence with at least 99% sequence identity to SEQ ID NO: 17 belongs to the species *Bifidobacterium longum*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 18. In some embodiments, the bacterial strain comprising a 16S rDNA sequence with at least 97% sequence identity to SEQ ID NO: 18 belongs to the species *Lactobacillus acidophilus*. In some embodiments, the bacterial strain comprising a 16S rDNA sequence with at least 99% sequence identity to SEQ ID NO: 18 belongs to the species *Lactobacillus acidophilus*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 19. In some embodiments, the bacterial strain comprising a 16S rDNA sequence with at least 97% sequence identity to SEQ ID NO: 19 belongs to the species *Lactobacillus delbrueckii*. In some embodiments, the bacterial strain comprising a 16S rDNA sequence with at least 99% sequence identity to SEQ ID NO: 19 belongs to the species *Lactobacillus delbrueckii*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 20. In some embodiments, the bacterial strain comprising a 16S rDNA sequence with at least 97% sequence identity to SEQ ID NO: 20 belongs to the species *Lactobacillus helveticus*. In some embodiments, the bacterial strain comprising a 16S rDNA sequence with at least 99% sequence identity to SEQ ID NO: 20 belongs to the species *Lactobacillus helveticus*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 21. In some embodiments, the bacterial strain comprising a 16S rDNA sequence with at least 97% sequence identity to SEQ ID NO: 21 belongs to the species *Lactobacillus reuteri*. In some embodiments, the bacterial strain comprising a 16S rDNA sequence with at least 99% sequence identity to SEQ ID NO: 21 belongs to the species *Lactobacillus reuteri*.

In some embodiments, a bacterial strain, e.g., that produces a fermentate (e.g., first, second, and/or additional fermentate), has a 16S rDNA sequence with at least 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, 99.9%, or 100% identity to SEQ ID NO: 22. In some embodiments, the bacterial strain comprising a 16S rDNA sequence with at least 97% sequence identity to SEQ ID NO: 22 belongs to the species *Lactococcus lactis*. In some embodiments, the bacterial strain comprising a 16S rDNA sequence with at least 99% sequence identity to SEQ ID NO: 22 belongs to the species *Lactococcus lactis*.

In some embodiments, a bacterial strain that belongs to a particular species has a genome with at least 95.0% average nucleotide identity (ANI) and an alignment fraction (AF) of at least 20.0% to a Species Representative Genome provided in Table 1.

In some embodiments, a bacterial strain belonging to the species *Pediococcus acidilactici* comprises a genome with at least 95.0% ANI and an AF of at least 20.0% to Accession No. CF_000146325.1 or GCF_024970065.1. In some embodiments, the AF is at least 50.0%.

In some embodiments, a bacterial strain belonging to the species *Bacillus licheniformis* comprises a genome with at least 95.0% ANI and an AF of at least 20.0% to Accession No. GCF_000011645.1. In some embodiments, the AF is at least 50.0%.

In some embodiments, a bacterial strain belonging to the species *Bacillus pumilus* comprises a genome with at least 95.0% ANI and an AF of at least 20.0% to Accession No. GCF_900186955.1, GCA_001938995.1, GCF_002744245.1, GCF_003431975.1, GCF_009937765.1, or GCF_024498355.1. In some embodiments, the AF is at least 50.0%.

In some embodiments, a bacterial strain belonging to the species *Bacillus subtilis* comprises a genome with at least 95.0% ANI and an AF of at least 20.0% to Accession No. CF_000009045.1 or GCF_002153395.1. In some embodiments, the AF is at least 50.0%.

In some embodiments, a bacterial strain belonging to the species *Bacillus velezensis* comprises a genome with at least 95.0% ANI and an AF of at least 20.0% to Accession No. GCF_001461825.1. In some embodiments, the AF is at least 50.0%.

In some embodiments, a bacterial strain belonging to the species *Weizmannia coagulans* comprises a genome with at least 95.0% ANI and an AF of at least 20.0% to Accession No. GCF_000290615.1. In some embodiments, the AF is at least 50.0%.

In some embodiments, a bacterial strain belonging to the species *Lactiplantibacillus plantarum* comprises a genome with at least 95.0% ANI and an AF of at least 20.0% to Accession No. GCF_014131735.1 or GCA_000463075.2. In some embodiments, the AF is at least 50.0%.

In some embodiments, a bacterial strain belonging to the species *Bifidobacterium adolescentis* comprises a genome with at least 95.0% ANI and an AF of at least 20.0% to Accession No. GCF_000010425.1. In some embodiments, the AF is at least 50.0%.

In some embodiments, a bacterial strain belonging to the species *Bifidobacterium bifidum* comprises a genome with at least 95.0% ANI and an AF of at least 20.0% to Accession No. GCF_001025135.1. In some embodiments, the AF is at least 50.0%.

In some embodiments, a bacterial strain belonging to the species *Bifidobacterium longum* comprises a genome with at least 95.0% ANI and an AF of at least 20.0% to Accession No. GCF_000196555.1 or GCA_905202265.1. In some embodiments, the AF is at least 50.0%.

In some embodiments, a bacterial strain belonging to the species *Lactobacillus acidophilus* comprises a genome with at least 95.0% ANI and an AF of at least 20.0% to Accession No. GCF_001591845.1. In some embodiments, the AF is at least 50.0%.

In some embodiments, a bacterial strain belonging to the species *Lactobacillus delbrueckii* comprises a genome with at least 95.0% ANI and an AF of at least 20.0% to Accession No. GCF_001433875.1 or GCA_004556255.1. In some embodiments, the AF is at least 50.0%.

In some embodiments, a bacterial strain belonging to the species *Lactobacillus helveticus* comprises a genome with at least 95.0% ANI and an AF of at least 20.0% to Accession No. GCF_00160855.1. In some embodiments, the AF is at least 50.0%.

In some embodiments, a bacterial strain belonging to the species *Lactobacillus reuteri* comprises a genome with at least 95.0% ANI and an AF of at least 20.0% to Accession No. GCF_000016825.1, GCF_003072625.1, GCF_013694365.1, GCF_020784725.1, GCF_012971035.1, or GCF_020784195.1. In some embodiments, the AF is at least 50.0%.

In some embodiments, a bacterial strain belonging to the species *Lactococcus lactis* comprises a genome with at least 95.0% ANI and an AF of at least 20.0% to Accession No. GCF_029023865.1. In some embodiments, the AF is at least 50.0%.

The bacterial strain comprising a 16S rDNA sequence provided by SEQ ID NO: 1 (also referred to herein as "Strain 1") has the highest homology with a bacterial strain of the species *Pediococcus acidilactici*:

```
Strain 1
16S ribosomal RNA coding sequence (16S rDNA)
                                       (SEQ ID NO: 1)
ATGAGAGTTTGATCTTGGCTCAGGATGAACGCTGGCGGCGTGCCTAATAC

ATGCAAGTCGAACGAACTTCCGTTAATTGATTATGACGTGCTTGCACTGA

ATGAGATTTTAACACGAAGTGAGTGGCGGACGGGTGAGTAACACGTGGGT

AACCTGCCCAGAAGCAGGGGATAACACCTGGAAACAGATGCTAATACCGT

ATAACAGAGAAAACCGCCTGGTTTTCTTTTAAAAGATGGCTCTGCTATCA

CTTCTGGATGGACCCGCGGCGCATTAGCTAGTTGGTGAGGTAACGGCTCA

CCAAGGCGATGATGCGTAGCCGACCTGAGAGGGTAATCGGCCACATTGGG

ACTGAGACACGGCCCAGACTCCTACGGGAGGCAGCAGTAGGGAATCTTCC

ACAATGGACGCAAGTCTGATGGAGCAACGCCGCGTGAGTGAAGAAGGGTT

TCGGCTCGTAAAGCTCTGTTGTTAAAGAAGAACGTGGGTGAGAGTAACTG

TTCACCCAGTGACGGTATTTAACCAGAAAGCCACGGCTAACTACGTGCCA
```

```
GCAGCCGCGGTAATACGTAGGTGGCAAGCGTTATCCGGATTTATTGGGCG

TAAAGCGAGCGCAGGCGGTCTTTTAAGTCTAATGTGAAAGCCTTCGGCTC

AACCGAAGAAGTGCATTGGAAACTGGGAGACTTGAGTGCAGAAGAGGACA

GTGGAACTCCATGTGTAGCGGTGAAATGCGTAGATATATGGAAGAACACC

AGTGGCGAAGGCGGCTGTCTGGTCTGTAACTGACGCTGAGGCTCGAAAGC

ATGGGTAGCGAACAGGATTAGATACCCTGGTAGTCCATGCCGTAAACGAT

GATTACTAAGTGTTGGAGGGTTTCCGCCCTTCAGTGCTGCAGCTAACGCA

TTAAGTAATCCGCCTGGGGAGTACGACCGCAAGGTTGAAACTCAAAAGAA

TTGACGGGGGCCCGCACAAGCGGTGGAGCATGTGGTTTAATTCGAAGCTA

CGCGAAGAACCTTACCAGGTCTTGACATCTTCTGCCAACCTAAGAGATTA

GGCGTTCCCTTCGGGGACAGAATGACAGGTGGTGCATGGTTGTCGTCAGC

TCGTGTCGTGAGATGTTGGGTTAAGTCCCGCAACGAGCGCAACCCTTATT

ACTAGTTGCCAGCATTCAGTTGGGCACTCTAGTGAGACTGCCGGTGACAA

ACCGGAGGAAGGTGGGGACGACGTCAAATCATCATGCCCCTTATGACCTG

GGCTACACACGTGCTACAATGGATGGTACAACGAGTTGCGAAACCGCGAG

GTTTAGCTAATCTCTTAAAACCATTCTCAGTTCGGACTGTAGGCTGCAAC

TCGCCTACACGAAGTCGGAATCGCTAGTAATCGCGGATCAGCATGCCGCG

GTGAATACGTTCCCGGGCCTTGTACACACCGCCCGTCACACCATGAGAGT

TTGTAACACCCAAAGCCGGTGGGGTAACCTTTTAGGAGCTAGCCGTCTAA

GGTGGGACAGATGATTAGGGTGAAGTCGTAACAAGGTAGCCGTAGGAGAA

CCTGCGGCTGGATCACCTCCTT
```

The bacterial strain comprising a 16S rDNA sequence provided by SEQ ID NO: 2 (also referred to herein as "Strain 2") has the highest homology with a bacterial strain of the species *Bacillus licheniformis*:

```
Strain 2
16S ribosomal RNA coding sequence (16S rDNA)
                                       (SEQ ID NO: 2)
CACTTACAGATGGACCCGCGGCGCATTAGCTAGTTGGTGAGGTAACGGCT

CACCAAGGCGACGATGCGTAGCCGACCTGAGAGGGTGATCGGCCACACTG

GGACTGAGACACGGCCCAGACTCCTACGGGAGGCAGCAGTAGGGAATCTT

CCGCAATGGACGAAAGTCTGACGGAGCAACGCCGCGTGAGTGATGAAGGT

TTTCGGATCGTAAAACTCTGTTGTTAGGGAAGAACAAGTACCGTTCGAAT

AGGGCGGTACCTTGACGGTACCTAACCAGAAAGCCACGGCTAACTACGTG

CCAGCAGCCGCGGTAATACGTAGGTGGCAAGCGTTGTCCGGAATTATTGG

GCGTAAAGCGCGCGCAGGCGGTTTCTTAAGTCTGATGTGAAAGCCCCCGG

CTCAACCGGGGAGGGTCATTGGAAACTGGGGAACTTGAGTGCAGAAGAGG

AGAGTGGAATTCCACGTGTAGCGGTGAAATGCGTAGAGATGTGGAGGAAC

ACCAGTGGCGAAGGCGACTCTCTGGTCTGTAACTGACGCTGAGGCGCGAA

AGCGTGGGGAGCGAACAGGATTAGATACCCTGGTAGTCCACGCCGTAAAC

GATGAGTGCTAAGTGTTAGAGGGTTTCCGCCCTTTAGTGCTGCAGCAAAC

GCATTAAGCACTCCGCCTGGGGAGTACGGTCGCAAGACTGAAACTCAAAG

GAATTGACGGGGGCCCGCACAAGCGGTGGAGCATGTGGTTTAATTCGAAG
```

-continued
CAACGCGAAGAACCTTACCAGGTCTTGACATCCTCTGACAACCCTAGAGA

TAGGGCTTCCCCTTCGGGGGCAGAGTGACAGGTGGTGCATGGTTGTCGTC

AGCTCGTGTCGTGAGATGTTGGGTTAAGTCCCGCAACGAGCGCAACCCTT

GATCTTAGTTGCCAGCATTCAGTTGGGCACTCTAAGGTGACTGCCGGTGA

CAAACCGGAGGAAGGTGGGGATGACGTCAAATCATCATGCCCCTTATGAC

CTGGGCTACACACGTGCTACAATGGGCAGAACAAAGGGCAGCGAAGCCGC

GAGGCTAAGCCAATCCCACAAATCTGTTCTCAGTTCGGATCGCAGTCTGC

AACTCGACTGCGTGAAGCTGGAATCGCTAGTAATCGCGGATCAGCATGCC

GCGGTGAATACGTTCCCGGGCCTTGTACACACCGCCCGTCACACCACGAG

AGTTTGTAACACCCGAAGTCGGTGAGGTAACCTTTTGGAGCCAGCCGCCG

AAGGTGGGACAGATGATTGGGGTGAAGTCGTAACAAGGTAGCCGTATCGG

AAGGTGCGGCTGGATCACCTCCTTT

The bacterial strain comprising a 16S rDNA sequence provided by SEQ ID NO: 3 (also referred to herein as "Strain 3") has the highest homology with a bacterial strain of the species *Bacillus pumilus*:

```
Strain 3
16S ribosomal RNA coding sequence (16S rDNA)
                                        (SEQ ID NO: 3)
GAGTTTGATCCTGGCTCAGGACGAACGCTGGCGGCGTGCCTAATACATGC

AAGTCGAGCGAACAGAAGGGAGCTTGCTCCCGGATGTTAGCGGCGGACGG

GTGAGTAACACGTGGGTAACCTGCCTGTAAGACTGGGATAACTCCGGGAA

ACCGGAGCTAATACCGGATAGTTCCTTGAACCGCATGGTTCAAGGATGAA

AGACGGTTTCGGCTGTCACTTACAGATGGACCCGCGGCGCATTAGCTAGT

TGGTGGGGTAATGGCTCACCAAGGCGACGATGCGTAGCCGACCTGAGAGG

GTGATCGGCCACACTGGGACTGAGACACGGCCCAGACTCCTACGGGAGGC

AGCAGTAGGGAATCTTCCGCAATGGACGAAAGTCTGACGGAGCAACGCCG

CGTGAGTGATGAAGGTTTTCGGATCGTAAAGCTCTGTTGTTAGGGAAGAA

CAAGTGCGAGAGTAACTGCTCGCACCTTGACGGTACCTAACCAGAAAGCC

ACGGCTAACTACGTGCCAGCAGCCGCGGTAATACGTAGGTGGCAAGCGTT

GTCCGGAATTATTGGGCGTAAAGGGCTCGCAGGCGGTTTCTTAAGTCTGA

TGTGAAAGCCCCCGGCTCAACCGGGGAGGGTCATTGGAAACTGGGAAACT

TGAGTGCAGAAGAGGAGAGTGGAATTCCACGTGTAGCGGTGAAATGCGTA

GAGATGTGGAGGAACACCAGTGGCGAAGGCGACTCTCTGGTCTGTAACTG

ACGCTGAGGAGCGAAAGCGTGGGGAGCGAACAGGATTAGATACCCTGGTA

GTCCACGCCGTAAACGATGAGTGCTAAGTGTTAGGGGGTTTCCGCCCCTT

AGTGCTGCAGCTAACGCATTAAGCACTCCGCCTGGGGAGTACGGTCGCAA

GACTGAAACTCAAAGGAATTGACGGGGCCCGCACAAGCGGTGGAGCATG

TGGTTTAATTCGAAGCAACGCGAAGAACCTTACCAGGTCTTGACATCCTC

TGACAACCCTAGAGATAGGGCTTTCCCTTCGGGGACAGAGTGACAGGTGG

TGCATGGTTGTCGTCAGCTCGTGTCGTGAGATGTTGGGTTAAGTCCCGCA

ACGAGCGCAACCCTTGATCTTAGTTGCCAGCATTTAGTTGGGCACTCTAA

GGTGACTGCCGGTGACAAACCGGAGGAAGGTGGGGATGACGTCAAATCAT

CATGCCCCTTATGACCTGGGCTACACACGTGCTACAATGGACAGAACAAA

GGGCTGCGAGACCGCAAGGTTTAGCCAATCCCATAAATCTGTTCTCAGTT

CGGATCGCAGTCTGCAACTCGACTGCGTGAAGCTGGAATCGCTAGTAATC

GCGGATCAGCATGCCGCGGTGAATACGTTCCCGGGCCTTGTACACACCGC

CCGTCACACCACGAGAGTTTGCAACACCCGAAGTCGGTGAGGTAACCTTT

ATGGAGCCAGCCGCCGAAGGTGGGCAGATGATTGGGGTGAAGTCGTAAC

AAGGTAGCCGTATCGGAAGGTGCGGCTGGATCACCTCCTTT
```

The bacterial strain comprising a 16S rDNA sequence provided by SEQ ID NO: 4 (also referred to herein as "Strain 4") has the highest homology with a bacterial strain of the species *Bacillus subtilis*:

```
Strain 4
16S ribosomal RNA coding sequence (16S rDNA)
                                        (SEQ ID NO: 4)
TCGGAGAGTTTGATCCTGGCTCAGGACGAACGCTGGCGGCGTGCCTAATA

CATGCAAGTCGAGCGGACAGATGGGAGCTTGCTCCCTGATGTTAGCGGCG

GACGGGTGAGTAACACGTGGGTAACCTGCCTGTAAGACTGGGATAACTCC

GGGAAACCGGGGCTAATACCGGATGGTTGTTTGAACCGCATGGTTCAAAC

ATAAAAGGTGGCTTCGGCTACCACTTACAGATGGACCCGCGGCGCATTAG

CTAGTTGGTGAGGTAACGGCTCACCAAGGCGACGATGCGTAGCCGACCTG

AGAGGGTGATCGGCCACACTGGGACTGAGACACGGCCCAGACTCCTACGG

GAGGCAGCAGTAGGGAATCTTCCGCAATGGACGAAAGTCTGACGGAGCAA

CGCCGCGTGAGTGATGAAGGTTTTCGGATCGTAAAGCTCTGTTGTTAGGG

AAGAACAAGTACCGTTCGAATAGGGCGGTACCTTGACGGTACCTAACCAG

AAAGCCACGGCTAACTACGTGCCAGCAGCCGCGGTAATACGTAGGTGGCA

AGCGTTGTCCGGAATTATTGGGCGTAAAGGGCTCGCAGGCGGTTTCTTAA

GTCTGATGTGAAAGCCCCCGGCTCAACCGGGGAGGGTCATTGGAAACTGG

GGAACTTGAGTGCAGAAGAGGAGAGTGGAATTCCACGTGTAGCGGTGAAA

TGCGTAGAGATGTGGAGGAACACCAGTGGCGAAGGCGACTCTCTGGTCTG

TAACTGACGCTGAGGAGCGAAAGCGTGGGGAGCGAACAGGATTAGATACC

CTGGTAGTCCACGCCGTAAACGATGAGTGCTAAGTGTTAGGGGGTTTCCG

CCCCTTAGTGCTGCAGCTAACGCATTAAGCACTCCGCCTGGGGAGTACGG

TCGCAAGACTGAAACTCAAAGGAATTGACGGGGGCCCGCACAAGCGGTGG

AGCATGTGGTTTAATTCGAAGCAACGCGAAGAACCTTACCAGGTCTTGAC

ATCCTCTGACAATCCTAGAGATAGGACGTCCCCTTCGGGGGCAGAGTGAC

AGGTGGTGCATGGTTGTCGTCAGCTCGTGTCGTGAGATGTTGGGTTAAGT

CCCGCAACGAGCGCAACCCTTGATCTTAGTTGCCAGCATTCAGTTGGGCA

CTCTAAGGTGACTGCCGGTGACAAACCGGAGGAAGGTGGGGATGACGTCA

AATCATCATGCCCCTTATGACCTGGGCTACACACGTGCTACAATGGACAG

AACAAAGGGCAGCGAAACCGCGAGGTTAAGCCAATCCCACAAATCTGTTC

TCAGTTCGGATCGCAGTCTGCAACTCGACTGCGTGAAGCTGGAATCGCTA

GTAATCGCGGATCAGCATGCCGCGGTGAATACGTTCCCGGGCCTTGTACA
```

-continued

CACCGCCCGTCACACCACGAGAGTTTGTAACACCCGAAGTCGGTGAGGTA

ACCTTTTAGGAGCCAGCCGCCGAAGGTGGGACAGATGATTGGGGTGAAGT

CGTAACAAGGTAGCCGTATCGGAAGGTGCGGCTGGATCACCTCCTTT

The bacterial strain comprising a 16S rDNA sequence provided by SEQ ID NO: 5 (also referred to herein as "Strain 5") has the highest homology with a bacterial strain of the species *Bacillus velezensis*:

```
Strain 5
16S ribosomal RNA coding sequence (16S rDNA)
                                         (SEQ ID NO: 5)
ATGTTAGCGGCGGACGGGTGAGTAACACGTGGGTAACCTGCCTGTAAGAC
```

TGGGATAACTCCGGGAAACCGGGGCTAATACCGGATGGTTGTCTGAACCG

CATGGTTCAGACATAAAAGGTGGCTTCGGCTACCACTTACAGATGGACCC

GCGGCGCATTAGCTAGTTGGTGAGGTAACGGCTCACCAAGGCGACGATGC

GTAGCCGACCTGAGAGGGTGATCGGCCACACTGGGACTGAGACACGGCCC

AGACTCCTACGGGAGGCAGCAGTAGGGAATCTTCCGCAATGGACGAAAGT

CTGACGGAGCAACGCCGCGTGAGTGATGAAGGTTTTCGGATCGTAAAGCT

CTGTTGTTAGGGAAGAACAAGTGCCGTTCAAATAGGGCGGCACCTTGACG

GTACCTAACCAGAAAGCCACGGCTAACTACGTGCCAGCAGCCGCGGTAAT

ACGTAGGTGGCAAGCGTTGTCCGGAATTATTGGGCGTAAAGGGCTCGCAG

GCGGTTTCTTAAGTCTGATGTGAAAGCCCCCGGCTCAACCGGGGAGGGTC

ATTGGAAACTGGGGAACTTGAGTGCAGAAGAGGAGAGTGGAATTCCACGT

GTAGCGGTGAAATGCGTAGAGATGTGGAGGAACACCAGTGGCGAAGGCGA

CTCTCTGGTCTGTAACTGACGCTGAGGAGCGAAAGCGTGGGGAGCGAACA

GGATTAGATACCCTGGTAGTCCACGCCGTAAACGATGAGTGCTAAGTGTT

AGGGGGTTTCCGCCCCTTAGTGCTGCAGCTAACGCATTAAGCACTCCGCC

TGGGGAGTACGGTCGCAAGACTGAAACTCAAAGGAATTGACGGGGGCCCG

CACAAGCGGTGGAGCATGTGGTTTAATTCGAAGCAACGCGAAGAACCTTA

CCAGGTCTTGACATCCTCTGACAATCCTAGAGATAGGACGTCCCCTTCGG

GGGCAGAGTGACAGGTGGTGCATGGTTGTCGTCAGCTCGTGTCGTGAGAT

GTTGGGTTAAGTCCCGCAACGAGCGCAACCCTTGATCTTAGTTGCCAGCA

TTCAGTTGGGCACTCTAAGGTGACTGCCGGTGACAAACCGGAGGAAGGTG

GGGATGACGTCAAATCATCATGCCCCTTATGACCTGGGCTACACACGTGC

TACAATGGACAGAACAAAGGGCAGCGAAACCGCGAGGTTAAGCCAATCCC

ACAAATCTGTTCTCAGTTCGGATCGCAGTCTGCAACTCGACTGCGTGAAG

CTGGAATCGCTAGTAATCGCGGATCAGCATGCCGCGGTGAATACGTTCCC

GGGCCTTGTACACACCGCCCGTCACACCACGAGAGTTTGTAACACCCGAA

GTCGGTGAGGTAACCTTTATGGAGCCAGCCGCCGAAGGTGGGACAGATGA

TTGGGGTGAAGTCGTAACAAGGTAGCCGTATCGGAAGGTGCGGCTGGATC

ACCTCCTTT

The bacterial strain comprising a 16S rDNA sequence provided by SEQ ID NO: 6 (also referred to herein as "Strain 6") has the highest homology with a bacterial strain of the species *Weizmannia coagulans*:

```
Strain 6
16S ribosomal RNA coding sequence (16S rDNA)
                                         (SEQ ID NO: 6)
TCACTTACAGATGGGCCCGCGGCGCATTAGCTAGTTGGTGGGGTAACGGC
```

TCACCAAGGCAACGATGCGTAGCCGACCTGAGAGGGTGATCGGCCACATT

GGGACTGAGACACGGCCCAAACTCCTACGGGAGGCAGCAGTAGGGAATCT

TCCGCAATGGACGAAAGTCTGACGGAGCAACGCCGCGTGAGTGAAGAAGG

CCTTCGGGTCGTAAAACTCTGTTGCCGGGGAAGAACAAGTGCCGTTCGAA

CAGGGCGGCGCCTTGACGGTACCCGGCCAGAAAGCCACGGCTAACTACGT

GCCAGCAGCCGCGGTAATACGTAGGTGGCAAGCGTTGTCCGGAATTATTG

GGCGTAAAGCGCGCGCAGGCGGCTTCTTAAGTCTGATGTGAAATCTTGCG

GCTCAACCGCAAGCGGTCATTGGAAACTGGGAGGCTTGAGTGCAGAAGAG

GAGAGTGGAATTCCACGTGTAGCGGTGAAATGCGTAGAGATGTGGAGGAA

CACCAGTGGCGAAGGCGGCTCTCTGGTCTGTAACTGACGCTGAGGCGCGA

AAGCGTGGGGAGCAAACAGGATTAGATACCCTGGTAGTCCACGCCGTAAA

CGATGAGTGCTAAGTGTTAGAGGGTTTCCGCCCTTTAGTGCTGCAGCTAA

CGCATTAAGCACTCCGCCTGGGGAGTACGGCCGCAAGGCTGAAACTCAAA

GGAATTGACGGGGCCCGCACAAGCGGTGGAGCATGTGGTTTAATTCGAA

GCAACGCGAAGAACCTTACCAGGTCTTGACATCCTCTGACCTCCCTGGAG

ACAGGGCCTTCCCCTTCGGGGACAGAGTGACAGGTGGTGCATGGTTGTC

GTCAGCTCGTGTCGTGAGATGTTGGGTTAAGTCCCGCAACGAGCGCAACC

CTTGACCTTAGTTGCCAGCATTCAGTTGGGCACTCTAAGGTGACTGCCGG

TGACAAACCGGAGGAAGGTGGGGATGACGTCAAATCATCATGCCCCTTAT

GACCTGGGCTACACACGTGCTACAATGGATGGTACAAAGGGCTGCGAGAC

CGCGAGGTTAAGCCAATCCCAGAAAACCATTCCCAGTTCGGATTGCAGGC

TGCAACCCGCCTGCATGAAGCCGGAATCGCTAGTAATCGCGGATCAGCAT

GCCGCGGTGAATACGTTCCCGGGCCTTGTACACACCGCCCGTCACACCAC

GAGAGTTTGTAACACCCGAAGTCGGTGAGGTAACCTT

The bacterial strain comprising a 16S rDNA sequence provided by SEQ ID NO: 7 (also referred to herein as "Strain 7") has the highest homology with a bacterial strain of the species *Lactiplantibacillus plantarum*:

```
Strain 7
16S ribosomal RNA coding sequence (16S rDNA)
                                         (SEQ ID NO: 7)
TTTGAGAGTTTGATCCTGGCTCAGGACGAACGCTGGCGGCGTGCCTAATA
```

CATGCAAGTCGAACGAACTCTGGTATTGATTGGTGCTTGCATCATGATTT

ACATTTGAGTGAGTGGCGAACTGGTGAGTAACACGTGGGAAACCTGCCCA

GAAGCGGGGATAACACCTGGAAACAGATGCTAATACCGCATAACAACTT

GGACCGCATGGTCCGAGTTTGAAAGATGGCTTCGGCTATCACTTTTGGAT

GGTCCCGCGGCGTATTAGCTAGATGGTGAGGTAACGGCTCACCATGGCAA

TGATACGTAGCCGACCTGAGAGGGTAATCGGCCACATTGGGACTGAGACA

CGGCCCAAACTCCTACGGGAGGCAGCAGTAGGGAATCTTCCACAATGGAC

GAAAGTCTGATGGAGCAACGCCGCGTGAGTGAAGAAGGGTTTCGGCTCGT

-continued
AAAACTCTGTTGTTAAAGAAGAACATATCTGAGAGTAACTGTTCAGGTAT
TGACGGTATTTAACCAGAAAGCCACGGCTAACTACGTGCCAGCAGCCGCG
GTAATACGTAGGTGGCAAGCGTTGTCCGGATTTATTGGGCGTAAAGCGAG
CGCAGGCGGTTTTTTAAGTCTGATGTGAAAGCCTTCGGCTCAACCGAAGA
AGTGCATCGGAAACTGGGAAACTTGAGTGCAGAAGAGGACAGTGGAACTC
CATGTGTAGCGGTGAAATGCGTAGATATATGGAAGAACACCAGTGGCGAA
GGCGGCTGTCTGGTCTGTAACTGACGCTGAGGCTCGAAAGTATGGGTAGC
AAACAGGATTAGATACCCTGGTAGTCCATACCGTAAACGATGAATGCTAA
GTGTTGGAGGGTTTCCGCCCTTCAGTGCTGCAGCTAACGCATTAAGCATT
CCGCCTGGGGAGTACGGCCGCAAGGCTGAAACTCAAAGGAATTGACGGGG
GCCCGCACAAGCGGTGGAGCATGTGGTTTAATTCGAAGCTACGCGAAGAA
CCTTACCAGGTCTTGACATACTATGCAAATCTAAGAGATTAGACGTTCCC
TTCGGGGACATGGATACAGGTGGTGCATGGTTGTCGTCAGCTCGTGTCGT
GAGATGTTGGGTTAAGTCCCGCAACGAGCGCAACCCTTATTATCAGTTGC
CAGCATTAAGTTGGGCACTCTGGTGAGACTGCCGGTGACAAACCGGAGGA
AGGTGGGGATGACGTCAAATCATCATGCCCCTTATGACCTGGGCTACACA
CGTGCTACAATGGATGGTACAACGAGTTGCGAACTCGCGAGAGTAAGCTA
ATCTCTTAAAGCCATTCTCAGTTCGGATTGTAGGCTGCAACTCGCCTACA
TGAAGTCGGAATCGCTAGTAATCGCGGATCAGCATGCCGCGGTGAATACG
TTCCCGGGCCTTGTACACACCGCCCGTCACACCATGAGAGTTTGTAACAC
CCAAAGTCGGTGGGGTAACCTTTTAGGAACCAGCCGCCTAAGGTGGGACA
GATGATTAGGGTGAAGTCGTAACAAGGTAGCCGTAGGAGAACCTGCGGCT
GGATCACCTCCTT The bacterial strain comprising a 16S rDNA sequence provided by SEQ ID NO: 15 (also referred to herein as "Strain 8") has the highest homology with a bacterial strain of the species *Bifidobacterium adolescentis*:

```
Strain 8
16S ribosomal RNA coding sequence (16S rDNA)
                                    (SEQ ID NO: 15)
NNNNTTGTGGAGGGTTCGATTCTGGCTCAGGATNAACGCTNGCGGCGTGC
TTAACACATGCAAGTCGAACGGGATCGGCTNGAGCTTGCTCCGGCTGTGA
GAGTGGCGAACGGGTGAGTAATGCGTGACCGACCTGCCCCATACACCGGA
ATAGCTCCTGGAAACGGGTGGTAATGCCGGATGCTCCAGTTGGATGCATG
TCCTTCTGGGAAAGATTCTATCGGTATGGGATGGGGTCGCGTCCTATCAG
CTTGATGGCGGGGTAACGGCCCNCCATGGCTTCGACGGGNAGCCGGCCTG
AGAGGGCGACCGGCCACATTGGGACTGAGATACGGCCCNGACTCCTACGG
GAGGCAGCAGTGGGNAATATTGCACAATGGGCGCAAGCCTAATGCAGCGA
CGCCGCGTGCGGGATGACGGCCTTCGGGTTGTAAACCGCTTTTGACTGGG
AGCAAGCCTTCGGGGTGAGTGTACCTTTCGAATAAGCACCGGCTAACTAC
GTGCCAGCAGCCNCGGTAATACGTAGGGTGCNAGCGTTATCCGGAATTAT
TGGGCGTAAAGGGCTCGTAGGCGGTTCGTCGCGTCCGGTGTGAAAGTCCA
TCGCTTAACGGTGGNTCCGCGCCGGGTACGGGCGGNCTTGAGTGCGGTAG
```

-continued
```
GGNAGACTGGAATTCCNGGTGTAACGGTGGAATGTGTAGATATCGGGAAG
AACACCAATGGCGAAGGCAGGTCTCTGGGCNGTNACTGACGCTGAGGAGC
GAAAGCGTGGGGAGCGAACAGGATTAGATACCCTGGTAGTCCACGCCGTA
AACGGTGGATGCTGGATGTGGGGACCATTCCACGGTCTCCGTGTCGGAGC
CAACGCGTTAAGCATCCCGCCTGGGGAGTACGGCCGCAAGGCTAAAACTC
AAAGAAATTGACGGGNNCCNNCACAAGCGGCNGAGCATGCGGATTAATTC
GATNNAACGCGAAGAACCTTACCTGGGCTTGACATGTTCCCGACAGGCCC
CAGAGATGGGNNNTCCTTCGGGNCGGGNTCACAGGTGGNGCATGGTCGTC
GTCAGCTCGTGTCGTGAGATGTTGGGTTAAGTCCCGCAACGAGCGCAACC
CTCGCCCTGTGTTGCCAGCACGTCGTGGTGGNAACTCACGGGNGACCGCC
GGGGTCAACTCGGAGGAAGGTGGGNATGACGTCAGATCATCATGCCCCTT
ACGTCCAGGGCTTCACGCATGCTACAATGGCCGGTACAACGGGATGCGAC
CTCGTGAGGGGAGCGGATCCCTTAAAACCGGNCTCAGTTCGGATTGGAG
TCTGCAACCCGACTCCATGAAGGCGGAGTCGCTAGTAATCGCGGATCAGC
AACGCCGCGGTNAATGCGTTCCCGGGCCTTGTACACACCGCCCGTCAAGC
CATGAAAGTGGGTAGCACCCGAAGCCGGTGGCCCNACCTTTTTGGGGGGA
GCCGTCTAAGGTGAGNCTCGTGATNGG
```

The bacterial strain comprising a 16S rDNA sequence provided by SEQ ID NO: 16 (also referred to herein as "Strain 9") has the highest homology with a bacterial strain of the species *Bifidobacterium bifidum*:

```
Strain 9
16S ribosomal RNA coding sequence (16S rDNA)
                                    (SEQ ID NO: 16)
TTTTTGTGGAGGGTTCGATTCTGGCTCAGGATGAACGCTGGCGGCGTGCT
TAACACATGCAAGTCGAACGGGATCCATCAAGCTTGCTTGGTGGTGAGAG
TGGCGAACGGGTGAGTAATGCGTGACCGACCTGCCCCATGCTCCGGAATA
GCTCCTGGAAACGGGTGGTAATGCCGNATGTTCCACATGATCGCATGTGA
TTGTGGGAAAGATTCTATCGGCGTGGGATGGGGTCGNGTCCTATCAGCTT
GTTGGTGAGGTAACGGCTCACCAAGGCTTCGACGGGTAGCCGGCCTGAGA
GGGCGACCGGCCACATTGGGACTGAGATACGGCCCAGACTCCTACGGGAG
GCAGCAGTGGGGAATATTGCACAATGGGCGCAAGCCTGATGCAGCGACGC
CGCGTGAGGGATGGAGGCCTTCGGGTTGTAAACCTCTTTTGTTTGGGAGC
AAGCCTTCGGGTGAGTGTACCTTTCGAATAAGCGCCGGCTAACTACGTGC
CAGCAGCCGCGGTAATACGTAGGGNNNNAGCGTTATCCGGATTTATTGGG
CGTAAAGGGCTCGTAGGCGGCTCGTCGCGTCCGGTGTGAAAGTCCATCGC
TTAACGGTGGATCTGCGCCGGGTACGGGCGGCTGGAGTGCGGTAGGGGA
GACTGGAATTCCCGGTGTAACGGTGGAATGTGTAGATATCGGGAAGAACA
CCGATGGCGAAGGCAGGTCTCTGGGCNGTCACTGACGCTGAGGAGCNAAA
GCGTGGGGAGCGAACAGGATTAGATACCCTGGTAGTCCACGCCGTAAACG
GTGGACGCTGGATGTGGGGCACGTTCCACGTGTTCCGTGTCGGAGCTAAC
GCGTTAAGCGTCCCGCCTGGGGAGTACGGCCGCAAGGCTAAAACTCAAAG
```

```
AAATTGACGGGGGCCNGCACAAGCGGCGGAGCATGCGGATTAATTCGAAC

NAACGCGAAGAACCTTACCTGGGCTTGACATGTTCCCGACGACGCCAGAG

ATGGCGTTTCCCTTCGGGGGGGGTTCACAGGTGGTGCATGGTCGTCGTCA

GCTCGTGTCGTGAGATGTTGGGTTAAGTCCCGCAACGAGCGCAACCCTCG

CCCCGTGTTGCCAGCACGTTATGGTGGGAACTCACGGGNNACCGCCGGGG

TTAACNCGGAGGAAGGTGGGGATGACGTCAGATCATCATGCCCCTTACGT

CCAGGGCTTCACGCATGCTACAATGGCCGGTACAGCGGGATGCGACATGG

CGACATGGAGCGGATCCCTGAAAACCGGTCTCAGTTCGGATCGGAGCCTG

CAACCCGGCTCCGTGAAGGCGGAGTCGCTAGTAATCGCGGATCAGCAACG

CCGCGGTGAATGCGTTCCCGGGCCTTGTACACACCGCCCGTCAAGTCATG

AAAGTGGGCAGCACCCGAAGCCGGTGGCCTAACCCCTTGTGGGATGGAGC

CGTCTAAGGTGAGGCTCGTGNTTGGGACTAAGNNGTAACAAGNNNNNNGT

ACCGGAAGNNNNNNNNNGATCACCTCCTTTCT
```

The bacterial strain comprising a 16S rDNA sequence provided by SEQ ID NO: 17 (also referred to herein as "Strain 10") has the highest homology with a bacterial strain of the species *Bifidobacterium longum*:

```
Strain 10
16S ribosomal RNA coding sequence (16S rDNA)
                                     (SEQ ID NO: 17)
GATGAACGCTGGCGGCGTGCTTAACACATGCAAGTCGAACGGGATCCATC

AAGCTTGCTTGGTGGTGAGAGTGGCGAACGGGTGAGTAATGCGTGACCGA

CCTGCCCCATACACCGGAATAGCTCCTGGAAACGGGTGGTAATGCCGGAT

GTTCCAGTTGATCGCATGGTCTTCTGGGAAAGCTTTCGCGGTATGGGATG

GGGTCGCGTCCTATCAGCTTGACGGCGGGGTAACGGCCCACCGTGGCTTC

GACGGGTAGCCGGCCTGAGAGGGCGACCGGCCACATTGGGACTGAGATAC

GGCCCATACTCCTACGGGAGGCAGCAGTGGGGAATATTGCACAATGGGCG

CAAGCCTGATGCAGCGACGCCGCGTGAGGGATGGAGGCCTTCGGGTTGTA

AACCTCTTTTATCGGGGAGCAAGCGAGAGTGAGTTTACCCGTTGAATAAG

CACCGGCTAACTACGTGCCAGCAGCCGCGGTAATACGTAGGGTGCAAGCG

TTATCCGGAATTATTGGGCGTAAAGGGCTCGTAGGCGGTTCGTCGCGTCC

GGTGTGAAAGTCCATCGCTTAACGGTGGATCCGCGCCGGGTACGGGCGGG

CTTGAGTGCGGTAGGGGAGACTGGAATTCCCGGTGTAACGGTGGAATGTG

TAGATATCGGGAAGAACACCAATGGCGAAGGCAGGTCTCTGGGCCGTTAC

TGACGCTGAGGAGCGAAAGCGTGGGGAGCGAACAGGATTAGATACCCTGG

TAGTCCACGCCGTAAACGGTGGATGCAGGATGTGGGGCCCGTTCCACGGG

TTCCGTGTCGGAGCTAACGCGTTAAGCATCCCGCCTGGGGAGTACGGCCG

CAAGGCTAAAACTCAAAGAAATTGACGGGGCCCGCACAAGCGGCGGAGC

ATGCGGATTAATTCGATGCAACGCGAAGAACCTTACCTGGGCTTGACATG

TTCCCGACGGTCGTAGAGATACGGCTTCCCTTCGGGGGGGGTTCACAGGT

GGTGCATGGTCGTCGTCAGCTCGTGTCGTGAGATGTTGGGTTAAGTCCCG

CAACGAGCGCAACCCTCGCCCCGTGTTGCCAGCGGATTATGCCGGGAACT

CACGGGGGACCGCCGGGGTTAACTCGGAGGAAGGTGGGGATGACGTCAGA

TCATCATGCCCCTTACGTCCAGGGCTTCACGCATGCTACAATGGCCGGTA

CAACGGGATGCGACGCGGCGACGCGGAGCGGATCCCTGAAAACCGGTCTC

AGTTCGGATCGCAGTCTGCAACTCGACTGCGTGAAGGCGGAGTCGCTAGT

AATCGCGAATCAGCAACGTCGCGGTGAATGCGTTCCCGGGCCTTGTACAC

ACTGCCCGTCAAGTCATGAAAGTGGGCAGCACCCGAAGCCGGTGGCCTAA

CCCCTTGTGGGATGGAGCCGTCTAAGGTGAGGCTCGTGATTGGGACTAAG

TCGTAACAAGGTAGCCGTACCGGAAGG
```

The bacterial strain comprising a 16S rDNA sequence provided by SEQ ID NO: 18 (also referred to herein as "Strain 11") has the highest homology with a bacterial strain of the species *Lactobacillus acidophilus*:

```
Strain 11
16S ribosomal RNA coding sequence (16S rDNA)
                                     (SEQ ID NO: 18)
NNAAAACGAGAGTTTGATCCTGGCTCAGGACGAACGCTGGCGGCGTGCCT

AATACATGCAAGTCGAGCGAGCTGAACCAACAGATTCACTTCGGTGATGA

CGTTGGGNAACGCTAGCGGCGGATGGGTGAGTAACACGTGGGGAACCTGC

CCCATAGTCTGGGATACCACTTGGAAACAGGTGCTAATACCGGATAAGAA

AGCAGATCGCATGATCAGCTTATAAAAGGCGGCGTAAGCTGTCGCTATGG

NNTGGCCCCGCGGTGCATTAGCTAGTTGGTAGGGTAACGGCCTACCAAGG

CAATGATGCATAGCCGAGTTGAGAGACTGATCGGCCACATTGGGACTGAG

ACACGGCCCAAACTCCTACGGGAGGCAGCNGTAGGGAATCTTCCACAATG

GACGAAAGTCTGATGGAGCAACGCCGCGTGAGTGAAGAAGGTTTTCGGAT

CGTAAAGCTCTGTTGTTGGTGAAGAAGGATAGAGGTAGTAACTGGCCTTT

ATTTGACGGTAATCAACCAGAAAGTCACGGCTAACTACGTGCCAGCAGCC

GCGGTAATACGTAGGTGGCNAGCGTTGTCCGGATTTATTGGGCGTAAAGC

GAGCGCAGGCGGAAGAATAAGTCTGATGTGAAAGCCCTCGGCTTAACCGA

GGAACTGCATCGGAAACTGTTTTTCTTGAGTGCAGAAGAGGAGAGTGGAA

CTCCATGTGTAGCGGTGGAATGCGTAGATATATGGAAGAACACCAGTGGC

GAAGGCGGCTCTCTGGTCTGCAACTGACGCTGAGGCTCNNAAGCATGGGT

AGCGAACAGGATTAGATACCCTGGTAGTCCATGCCGTAAACGATGAGTGC

TAAGTGTTGGGAGGTTTCCGCCTCTCAGTGCTGCAGCTAACGCATTAAGC

ACTCCGCCTGGGGAGTACGACCGCAAGGTTGAAACTCAAAGGAATTGACG

GGGNCCCGCACAAGCGGTGGAGCATGTGGTTTAATTCGAAGCAACGCGAA

GAACCTTACCAGGTCTTGACATCTAGTGCAATCCGTAGAGATACGGNGTT

CCCTTCGGGGACACTAAGACAGGTGGTGCATGGCTGTCGTCAGCTCGTGT

CGTGAGATGTTGGGTTAAGTCCCGCAACGAGTGCAACCCTTGTCATTAGT

TGCCAGCATTAAGTTGGGCACTCTAATGAGACTGCCGGTGACAAACCGGA

GGAAGGTGGGGATGACGTCAAGTCATCATGCCCCTTATGACCTGGGCTAC

ACACGTGCTACAATGGACAGTACAACGAGGAGCAAGCCTGCGAAGGCAAG

CGAATCTCTTAAAGCTGTTCTCAGTTCGGACTGCAGTCTGCAACTCGACT

GCACGAAGCTGGAATCGCTAGTAATCGCGGATCAGCACGCCGCGGTGAAT
```

-continued
ACGTTCCCGGGCCTTGTACACACCGCCCGTCACACCATGGGAGTCTGCAA

TGCCCAAAGCCGGTGGCCTAACCTTCGGGAAGGAGCCGTCTAAGGCAGGG

CAGATGACNNNNNNNNNNNNNGTAACAAGNNNNNNNNNNNNNGAACCTGNNN

NNNGATCACCTCCTTTCTA

The bacterial strain comprising a 16S rDNA sequence provided by SEQ ID NO: 19 (also referred to herein as "Strain 12") has the highest homology with a bacterial strain of the species *Lactobacillus delbrueckii*:

```
Strain 12
16S ribosomal RNA coding sequence (16S rDNA)
                                    (SEQ ID NO: 19)
NTCAAATTGAGAGTTTGATCCTGGCTCAGGACGAACGCTGGCGGCGTGCC

TAATACATGCAAGTCGAGCGAGCTGAATTCAAAGATCCCTTCGGGGTGAT

TTGTTGGATGCTAGCGGCGGATGGGTGAGTAACACGTGGGCAATCTGCCC

TAAAGACTGGGATACCACTTGGAAACAGGTGCTAATACCGGATAACAACA

TGAATCGCATGATTCAAGTTTGAAAGGCGGCGYAAGCTGTCACTTTAGGA

TGAGCCCGCGGCGCATTAGCTAGTTGGTGGGGTAAAGGCCTACCAAGGCA

ATGATGCGTAGCCGAGTTGAGAGACTGATCGGCCACATTGGGACTGAGAC

ACGGCCNNAACTCCTACGGGAGGCAGCAGTAGGGAATCTTCCACAATGGA

CGCAAGTCTGATGGAGCAACGCCGCGTGAGTGAAGAAGGTCTTCGGATCG

TAAAGCTCTGTTGTTGGTGAAGAAGGATAGAGGCAGTAACTGGTCTTTAT

TTGACGGTAATCAACCAGAAAGTCACGGCTAACTACGTGCCAGCAGCCGC

GGTAATACGTAGGTGGCAAGCGTTGTCCGGATTTATTGGGCGTAAAGCGA

GCGCAGGCGGAATGATAAGTCTGATGTGAAAGCCNACGGCTYAACCGTGG

AACTGCATCGGAAACTGTCATTCTTGAGTGCAGAAGAGGAGAGTGGAACT

CCATGTGTAGCGGTGGAATGCGTAGATATATGGAAGAACACCAGTGGCGA

AGGCGGCTCTCTGGTCTGCAACTGACGCTGAGGCTCGAAAGCATGGGTAG

CGAACAGGATTAGATACCCTGGTAGTCCATGCCGTAAACGATGAGCGCTA

GGTGTTGGGGACTTTCCAGTCCTCAGTGCCGCAGCAAACGCATTAAGCNN

TCCGCCTGGGGAGTACGACCGCAAGGTTGAAACTCAAAGGAATTGACGGG

GGCCNGCACAAGCGGTGGAGCATGTGGTTTAATTCGAAGNAACGCGAAGA

ACCTTACCAGGTCTTGACATCCTGCGCTACACCTAGAGATAGGTNGTTCC

CTTCGGGGACGCAGAGACAGGTGGTGCATGGCTGTCGTCAGCTCGTGTCG

TGAGATGTTGGGTTAAGTCCCGCAACGAGCGCAACCCTTGTCTTTAGTTG

CCATCATTAAGTTGGGCACTCTAAAGAGACTGCCGGTGACAAACCGGAGG

AAGGTGGGGATGACGTCAAGTCATCATGCCCCTTATGACCTGGGCTACAC

ACGTGCTACAATGGGCAGTACAACGAGAAGCGAACCCGCGAGGGTAAGCG

GATCTCTTAAAGCTGYTCTCAGTTCGGACTGCAGGCTGCAACTCGCCTGC

ACGAAGCTGGAATCGCTAGTAATCGCGGATCAGCACGCCGCGGTGAATAC

GTTCCCGGGCCTTGTACACACCGCCCGTCACACCATGGAAGTCTGCAATG

CCCAAAGTCGGTGAGATAACCTTTATAGGAGTCAGCCGCCTAAGGCAGGG

CAGATGACNGGG
```

The bacterial strain comprising a 16S rDNA sequence provided by SEQ ID NO: 20 (also referred to herein as "Strain 13") has the highest homology with a bacterial strain of the species *Lactobacillus helveticus*:

```
Strain 13
16S ribosomal RNA coding sequence (16S rDNA)
                                    (SEQ ID NO: 20)
ACGAACGCTGGCGGCGTGCCTAATACATGCAAGTCGAGCGAGCAGAACCA

GCAGATTTACTTCGGTAATGACGCTGGGGACGCGAGCGGCGGATGGGTGA

GTAACACGTGGGGAACCTGCCCCATAGTCTGGGATACCACTTGGAAACAG

GTGCTAATACCGGATAAGAAAGCAGATCGCATGATCAGCTTATAAAAGGC

GGCGTAAGCTGTCGCTATGGGATGGCCCCGCGGTGCATTAGCTAGTTGGT

AAGGTAACGGCTTACCAAGGCAATGATGCATAGCCGAGTTGAGAGACTGA

TCGGCCACATTGGGACTGAGACACGGCCCAAACTCCTACGGGAGGCAGCA

GTAGGGAATCTTCCACAATGGACGCAAGTCTGATGGAGCAACGCCGCGTG

AGTGAAGAAGGTTTTCGGATCGTAAAGCTCTGTTGTTGGTGAAGAAGGAT

AGAGGTAGTAACTGGCCTTTATTTGACGGTAATCAACCAGAAAGTCACGG

CTAACTACGTGCCAGCAGCCGCGGTAATACGTAGGTGGCAAGCGTTGTCC

GGATTTATTGGGCGTAAAGCGAGCGCAGGCGGAAGAATAAGTCTGATGTG

AAAGCCCTCGGCTTAACCGAGGAACTGCATCGGAAACTGTTTTTCTTGAG

TGCAGAAGAGGAGAGTGGAATTCCATGTGTAGCGGTGGAATGCGTAGATA

TATGGAAGAACACCAGTGGCGAAGGCGACTCTCTGGTCTGCAACTGACGC

TGAGGCTCGAAAGCATGGGTAGCGAACAGGATTAGATACCCTGGTAGTCC

ATGCCGTAAACGATGAGTGCTAAGTGTTGGGAGGTTTCCGCCTCTCAGTG

CTGCAGCTAACGCATTAAGCACTCCGCCTGGGGAGTACGACCGCAAGGTT

GAAACTCAAAGGAATTGACGGGGCCCGCACAAGCGGTGGAGCATGTGGT

TTAATTCGAAGCAACGCGAAGAACCTTACCAGGTCTTGACATCTAGTGCC

ATCCTAAGAGATTAGGAGTTCCCTTCGGGGACGCTAAGACAGGTGGTGCA

TGGCTGTCGTCAGCTCGTGTCGTGAGATGTTGGGTTAAGTCCCGCAACGA

GCGCAACCCTTGTTATTAGTTGCCAGCATTAAGTTGGGCACTCTAATGAG

ACTGCCGGTGATAAACCGGAGGAAGGTGGGGATGACGTCAAGTCATCATG

CCCCTTATGACCTGGGCTACACACGTGCTACAATGGACAGTACAACGAGA

AGCGAGCCTGCGAAGGCAAGCGAATCTCTGAAAGCTGTTCTCAGTTCGGA

CTGCAGTCTGCAACTCGACTGCACGAAGCTGGAATCGCTAGTAATCGCGG

ATCAGAACGCCGCGGTGAATACGTTCCCGGGCCTTGTACACACCGCCCGT

CACACCATGGAAGTCTGCAATGCCCAAAGCCGGTGGCCTAACCTTCGGGA

AGGAGCCGTCTAAGGCAGGGCAGATGACTGGGGTGAA
```

The bacterial strain comprising a 16S rDNA sequence provided by SEQ ID NO: 21 (also referred to herein as "Strain 14") has the highest homology with a bacterial strain of the species *Lactobacillus reuteri*:

```
Strain 14
16S ribosomal RNA coding sequence (16S rDNA)
                                    (SEQ ID NO: 21)
AGAGTTTGATNNTGGCTCAGGATGAACGCCGGCGGTGTGCCTAATACATG

CAAGTCGTACGCACTGGCCCAACTGATTGATGGTGCTTGCACCTGATTGA
```

-continued
CGATGGATCACCAGTGAGTGGCGGACGGGTGAGTAACACGTAGGTAACCT

GCCCCGGAGCGGGGGATAACATTTGGAAACAGATGCTAATACCGCATAAC

AACAAAAGCCGCATGGCTTTTGTTTGAAAGATGGCTTTGGCTATCACTCT

GGGATGGACCTGCGGTGCATTAGCTAGTTGGTAAGGTAACGGCTTACCAA

GGCGATGATGCATAGCCGAGTTGAGAGACTGATCGGCCACAATGGAACTG

AGACACGGTCCATACTCCTACGGGAGGCAGCAGTAGGGAATCTTCCACAA

TGGGCGCAAGCCTGATGGAGCAACGCCGCGTGAGTGAAGAAGGGTTTCGG

CTCGTAAAGCTCTGTTGTTGGAGAAGAACGTGCGTGAGAGTAACTGTTCN

CGCAGTGACGGTATCCAACCAGAAAGTCACGGCTAACTACGTGCCAGCAG

CCGCGGTAATACGTAGGTGGCAAGCGTTATCCGGATTTATTGGGCGTAAA

GCGAGCGCAGGCGGTTGCTTAGGTCTGATGTGAAAGCCTTCGGCTTAACC

GAAGAAGTGCATCGGAAACCGGGCGACTTGAGTGCAGAAGAGGACAGTGG

AACTCCATGTGTAGCGGTGGAATGCGTAGATATATGGAAGAACACCAGTG

GCGAAGGCGGCTGTCTGGTCTGCAACTGACGCTGAGGCTCGAAAGCATGG

GTAGCGAACAGGATTAGATACCCTGGTAGTCCATGCCGTAAACGATGAGT

GCTAGGTGTTGGAGGGTTTCCGCCCTTCAGTGCCGGAGCTAACGCATTAA

GCACTCCGCCTGGGGAGTACGACCGCAAGGTTGAAACTCAAAGGAATTGA

CGGGGGCCCGCACAAGCGGTGGAGCATGTGGTTTAATTCGAAGCTACGCG

AAGAACCTTACCAGGTCTTGACATCTTGCGCTAACCTTAGAGATAAGGCG

TTNCCTTCGGGGACGCAATGACAGGTGGTGCATGGTCGTCGTCAGCTCGT

GTCGTGAGATGTTGGGTTAAGTCCTGCAACGAGCGCAACCCTTGTTACTA

GTTGCCAGCATTAAGTTGGGCACTCTAGTGAGACTGCCGGTGACAAACCG

GAGGAAGGTGGGGACGACGTCAGATCATCATGCCCCTTATGACCTGGGCT

ACACACGTGCTACAATGGACGGTACAACGAGTCGCAAGCTCGCGAGAGTA

AGCTAATCTCTTAAAGCCGTTCTCAGTTCGGACTGTAGGCTGCAACTCGC

CTACACGAAGTCGGAATCGCTAGTAATCGCGGATCAGCATGCCGCGGTGA

ATACGTTCCCGGGCCTTGTACACACCGCCCGTCACACCATGGGAGTTTGT

AACGCCCAAAGTCGGTGGCCTAACCTTTATGGAGGGAGCCGCCTAAGGCG

GGACAGATGACTGGGGTGAAGTCGTAACAAGGTAGCCGTAGGAGAGCCTG

CGGCTGGATCACCTCCTTTNT

The bacterial strain comprising a 16S rDNA sequence provided by SEQ ID NO: 22 (also referred to herein as "Strain 15") has the highest homology with a bacterial strain of the species *Lactococcus lactis*:

```
Strain 15
16S ribosomal RNA coding sequence (16S rDNA)
                                        (SEQ ID NO: 22)
NNTTATTTGAGAGTTTGATCCTGGCTCAGGACGAACGCTGGCGGCGTGCC

TAATACATGCAAGTTGAGCGCTGAAGGTTGGTACTTGTACCGACTGGATG

AGCAGCGAACGGGTGAGTAACGCGTGGGGAATCTGCCTTTGAGCGGGGA

CAACATTTGGAAACGAATGCTAATACCGCATAAAAACTTTAAACACAAGT

TTTAAGTTTGAAAGATGCAATTGCATCACTCAAAGATGATCCCGCGTTGT

ATTAGCTAGTTGGTGAGGTAAAGGCTCACCAAGGCGATGATACATAGCCG
```

-continued
ACCTGAGAGGGTGATCGGCCACATTGGGACTGAGACACGGCCCAAACTCC

TACGGGAGGCAGCAGTAGGGAATCTTCGGCAATGGACGAAAGTCTGACCG

AGCAACGCCGCGTGAGTGAAGAAGGTTTTCGGATCGTAAAACTCTGTTGG

TAGAGAAGAACGTTGGTGAGAGTGGAAAGCTCATCAAGTGACGGTAACTA

CCCAGAAAGGGACGGCTAACTACGTGCCAGCAGCCGCGGTAATACGTAGG

TCCCGAGCGTTGTCCGGATTTATTGGGCGTAAAGCGAGCGCAGGTGGTTT

ATTAAGTCTGGTGTAAAAGGCAGTGGCTCAACCATTGTATGCATTGGAAA

CTGGTAGACTTGAGTGCAGGAGAGGAGAGTGGAATTCCATGTGTAGCGGT

GAAATGCGTAGATATATGGAGGAACACCGGTGGCGAAAGCGGCTCTCTGG

CCTGTAACTGACACTGAGGCTCNNAAGCGTGGGGAGCAAACAGGATTAGA

TACCCTGGTAGTCCACGCCGTAAACGATGAGTGCTAGATGTAGGGAGCTA

TAAGTTCTCTGTATCGCAGCTAACGCAATAAGCACTCCGCCTGGGGAGTA

CGACCGCAAGGTTGAAACTCAAAGGAATTGACGGGGGCCNGCACAAGCGG

TGGAGCATGTGGTTTAATTCGAAGCAACGCGAAGAACCTTACCAGGTCTT

GACATACTCGTGCTATTCCTAGAGATAGGAAGTTCCTTCGGGACACGGGA

TACAGGTGGTGCATGGTTGTCGTCAGCTCGTGTCGTGAGATGTTGGGTTA

AGTCCCGCAACGAGCGCAACCCCTATTGTTAGTTGCCATCATTAAGTTGG

GCACTCTAACGAGACTGCCGGTGATAAACCGGAGGAAGGTGGGGATGACG

TCAAATCATCATGCCCCTTATGACCTGGGCTACACACGTGCTACAATGGA

TGGTACAACGAGTCGCGAGACAGTGATGTTTAGCTAATCTCTTAAAACCA

TTCTCAGTTCGGATTGTAGGCTGCAACTCGCCTACATGAAGTCGGAATCG

CTAGTAATCGCGGATCAGCACGCCGCGGTGAATACGTTCCCGGGCCTTGT

ACACACCGCCCGTCACACCACGGGAGTTGGGAGTACCCGAAGTAGGTTGC

CTAACCGCAAGGAGGGCGCTTCCTAAGGTAAGACCGATGACNNGGGNNNN

NNGTAACAAGNNNNNNNGTATCGGAAGNNNNNNNNNGATCACCTCCTTTC

TA
```

In some embodiments, a composition comprises fermentates of two or more bacterial strains belonging to the species *Pediococcus acidilactici*, wherein the bacterial strains belonging to the species *Pediococcus acidilactici* are different bacterial strains. In some embodiments, the composition comprises a fermentate of one bacterial strain belonging to *Pediococcus acidilactici*. In some embodiments, the composition comprises fermentates of two bacterial strains belonging to *Pediococcus acidilactici*. In some embodiments, the composition comprises fermentates of 2, 3, 4, 5, 6, 7, 8, 9, or 10 bacterial strains belonging to *Pediococcus acidilactici*. In some embodiments, the 16S rDNA sequence of the first bacterial strain belonging to *Pediococcus acidilactici* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Pediococcus acidilactici*.

In some embodiments, a composition comprises fermentates of two or more bacterial strains belonging to the species *Bacillus licheniformis*, wherein the bacterial strains belonging to the species *Bacillus licheniformis* are different bacterial strains. In some embodiments, the composition comprises a fermentate of one bacterial strain belonging to *Bacillus licheniformis*. In some embodiments, the composition comprises fermentates of two bacterial strains belonging to *Bacillus licheniformis*. In some embodiments, the composition comprises fermentates of 2, 3, 4, 5, 6, 7, 8, 9, or 10 bacterial strains belonging to *Bacillus licheniformis*. In some embodiments, the 16S rDNA sequence of the first bacterial strain belonging to *Bacillus licheniformis* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bacillus licheniformis*.

In some embodiments, a composition comprises fermentates of two or more bacterial strains belonging to the species *Bacillus pumilus*, wherein the bacterial strains belonging to the species *Bacillus pumilus* are different bacterial strains. In some embodiments, the composition comprises a fermentate of one bacterial strain belonging to *Bacillus pumilus*. In some embodiments, the composition comprises fermentates of two bacterial strains belonging to *Bacillus pumilus*. In some embodiments, the composition comprises fermentates of 2, 3, 4, 5, 6, 7, 8, 9, or 10 bacterial strains belonging to *Bacillus pumilus*. In some embodiments, the 16S rDNA sequence of the first bacterial strain belonging to *Bacillus pumilus* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bacillus pumilus*.

In some embodiments, a composition comprises fermentates of two or more bacterial strains belonging to the species *Bacillus subtilis*, wherein the bacterial strains belonging to the species *Bacillus subtilis* are different bacterial strains. In some embodiments, the composition comprises a fermentate of one bacterial strain belonging to *Bacillus subtilis*. In some embodiments, the composition comprises fermentates of two bacterial strains belonging to *Bacillus subtilis*. In some embodiments, the composition comprises fermentates of 2, 3, 4, 5, 6, 7, 8, 9, or 10 bacterial strains belonging to *Bacillus subtilis*. In some embodiments, the 16S rDNA sequence of the first bacterial strain belonging to *Bacillus subtilis* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bacillus subtilis*.

In some embodiments, a composition comprises fermentates of two or more bacterial strains belonging to the species *Bacillus velezensis*, wherein the bacterial strains belonging to the species *Bacillus velezensis* are different bacterial strains. In some embodiments, the composition comprises a fermentate of one bacterial strain belonging to *Bacillus velezensis*. In some embodiments, the composition comprises fermentates of two bacterial strains belonging to *Bacillus velezensis*. In some embodiments, the composition comprises fermentates of 2, 3, 4, 5, 6, 7, 8, 9, or 10 bacterial strains belonging to *Bacillus velezensis*. In some embodiments, the 16S rDNA sequence of the first bacterial strain belonging to *Bacillus velezensis* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bacillus velezensis*.

In some embodiments, a composition comprises fermentates of two or more bacterial strains belonging to the species *Weizmannia coagulans*, wherein the bacterial strains belonging to the species *Weizmannia coagulans* are different bacterial strains. In some embodiments, the composition comprises a fermentate of one bacterial strain belonging to *Weizmannia coagulans*. In some embodiments, the composition comprises fermentates of two bacterial strains belonging to *Weizmannia coagulans*. In some embodiments, the composition comprises fermentates of 2, 3, 4, 5, 6, 7, 8, 9, or 10 bacterial strains belonging to *Weizmannia coagulans*. In some embodiments, the 16S rDNA sequence of the first bacterial strain belonging to *Weizmannia coagulans* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Weizmannia coagulans*.

In some embodiments, a composition comprises fermentates of two or more bacterial strains belonging to the species *Lactiplantibacillus plantarum*, wherein the bacterial strains belonging to the species *Lactiplantibacillus plantarum* are different bacterial strains. In some embodiments, the composition comprises a fermentate of one bacterial strain belonging to *Lactiplantibacillus plantarum*. In some embodiments, the composition comprises fermentates of two bacterial strains belonging to *Lactiplantibacillus plantarum*. In some embodiments, the composition comprises fermentates of 2, 3, 4, 5, 6, 7, 8, 9, or 10 bacterial strains belonging to *Lactiplantibacillus plantarum*. In some embodiments, the 16S rDNA sequence of the first bacterial strain belonging to *Lactiplantibacillus plantarum* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactiplantibacillus plantarum*.

In some embodiments, a composition comprises fermentates of two or more bacterial strains belonging to the species *Bifidobacterium adolescentis*, wherein the bacterial strains belonging to the species *Bifidobacterium adolescentis* are different bacterial strains. In some embodiments, the composition comprises a fermentate of one bacterial strain belonging to *Bifidobacterium adolescentis*. In some embodiments, the composition comprises fermentates of two bacterial strains belonging to *Bifidobacterium adolescentis*. In some embodiments, the composition comprises fermentates of 2, 3, 4, 5, 6, 7, 8, 9, or 10 bacterial strains belonging to *Bifidobacterium adolescentis*. In some embodiments, the 16S rDNA sequence of the first bacterial strain belonging to *Bifidobacterium adolescentis* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bifidobacterium adolescentis*.

In some embodiments, a composition comprises fermentates of two or more bacterial strains belonging to the species *Bifidobacterium bifidum*, wherein the bacterial strains belonging to the species *Bifidobacterium bifidum* are different bacterial strains. In some embodiments, the composition comprises a fermentate of one bacterial strain belonging to *Bifidobacterium bifidum*. In some embodiments, the composition comprises fermentates of two bacterial strains belonging to *Bifidobacterium bifidum*. In some embodiments, the composition comprises fermentates of 2, 3, 4, 5, 6, 7, 8, 9, or 10 bacterial strains belonging to *Bifidobacte-* rium bifidum. In some embodiments, the 16S rDNA sequence of the first bacterial strain belonging to *Bifidobacterium bifidum* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bifidobacterium bifidum*.

In some embodiments, a composition comprises fermentates of two or more bacterial strains belonging to the species *Bifidobacterium longum*, wherein the bacterial strains belonging to the species *Bifidobacterium longum* are different bacterial strains. In some embodiments, the composition comprises a fermentate of one bacterial strain belonging to *Bifidobacterium longum*. In some embodiments, the composition comprises fermentates of two bacterial strains belonging to *Bifidobacterium longum*. In some embodiments, the composition comprises fermentates of 2, 3, 4, 5, 6, 7, 8, 9, or 10 bacterial strains belonging to *Bifidobacterium longum*. In some embodiments, the 16S rDNA sequence of the first bacterial strain belonging to *Bifidobacterium longum* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Bifidobacterium longum*.

In some embodiments, a composition comprises fermentates of two or more bacterial strains belonging to the species *Lactobacillus acidophilus*, wherein the bacterial strains belonging to the species *Lactobacillus acidophilus* are different bacterial strains. In some embodiments, the composition comprises a fermentate of one bacterial strain belonging to *Lactobacillus acidophilus*. In some embodiments, the composition comprises fermentates of two bacterial strains belonging to *Lactobacillus acidophilus*. In some embodiments, the composition comprises fermentates of 2, 3, 4, 5, 6, 7, 8, 9, or 10 bacterial strains belonging to *Lactobacillus acidophilus*. In some embodiments, the 16S rDNA sequence of the first bacterial strain belonging to *Lactobacillus acidophilus* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactobacillus acidophilus*.

In some embodiments, a composition comprises fermentates of two or more bacterial strains belonging to the species *Lactobacillus delbrueckii*, wherein the bacterial strains belonging to the species *Lactobacillus delbrueckii* are different bacterial strains. In some embodiments, the composition comprises a fermentate of one bacterial strain belonging to *Lactobacillus delbrueckii*. In some embodiments, the composition comprises fermentates of two bacterial strains belonging to *Lactobacillus delbrueckii*. In some embodiments, the composition comprises fermentates of 2, 3, 4, 5, 6, 7, 8, 9, or 10 bacterial strains belonging to *Lactobacillus delbrueckii*. In some embodiments, the 16S rDNA sequence of the first bacterial strain belonging to *Lactobacillus delbrueckii* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactobacillus delbrueckii*.

In some embodiments, a composition comprises fermentates of two or more bacterial strains belonging to the species *Lactobacillus helveticus*, wherein the bacterial strains belonging to the species *Lactobacillus helveticus* are different bacterial strains. In some embodiments, the composition comprises a fermentate of one bacterial strain belonging to *Lactobacillus helveticus*. In some embodiments, the composition comprises fermentates of two bacterial strains belonging to *Lactobacillus helveticus*. In some embodiments, the composition comprises fermentates of 2, 3, 4, 5, 6, 7, 8, 9, or 10 bacterial strains belonging to *Lactobacillus helveticus*. In some embodiments, the 16S rDNA sequence of the first bacterial strain belonging to *Lactobacillus helveticus* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactobacillus helveticus*.

In some embodiments, a composition comprises fermentates of two or more bacterial strains belonging to the species *Lactobacillus reuteri*, wherein the bacterial strains belonging to the species *Lactobacillus reuteri* are different bacterial strains. In some embodiments, the composition comprises a fermentate of one bacterial strain belonging to *Lactobacillus reuteri*. In some embodiments, the composition comprises fermentates of two bacterial strains belonging to *Lactobacillus reuteri*. In some embodiments, the composition comprises fermentates of 2, 3, 4, 5, 6, 7, 8, 9, or 10 bacterial strains belonging to *Lactobacillus reuteri*. In some embodiments, the 16S rDNA sequence of the first bacterial strain belonging to *Lactobacillus reuteri* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactobacillus reuteri*.

In some embodiments, a composition comprises fermentates of two or more bacterial strains belonging to the species *Lactococcus lactis*, wherein the bacterial strains belonging to the species *Lactococcus lactis* are different bacterial strains. In some embodiments, the composition comprises a fermentate of one bacterial strain belonging to *Lactococcus lactis*. In some embodiments, the composition comprises fermentates of two bacterial strains belonging to *Lactococcus lactis*. In some embodiments, the composition comprises fermentates of 2, 3, 4, 5, 6, 7, 8, 9, or 10 bacterial strains belonging to *Lactococcus lactis*. In some embodiments, the 16S rDNA sequence of the first bacterial strain belonging to *Lactococcus lactis* has no more than 99.9%, 99.8%, 99.7%, 99.6%, 99.5%, 99.4%, 99.3%, 99.2%, 99.1%, 99.0%, 98.8%, 98.6%, 98.5%, 98.4%, 98.2%, 98.0%, 97.8%, 97.6%, 97.5%, 97.4%, or 97.2% identity to 16S rDNA sequence of the second bacterial strain belonging to *Lactococcus lactis*.

In some embodiments, a composition comprises a fermentate of one or more additional bacterial strains, in addition to the first fermentate comprising ILA and the second fermentate comprising IAld. Additional bacterial strains that produce fermentates may be taxonomically or phylogenetically related to bacterial strains of *Pediococcus acidilactici, Bacillus licheniformis, Bacillus pumilus, Bacillus subtilis, Bacillus velezensis, Weizmannia coagulans,* and *Lactiplantibacillus plantarum*. In some embodiments, one or more additional bacterial strains belong to the species *Pediococcus acidilactici*. In some embodiments, one or more additional bacterial strains belong to the species *Bacillus licheniformis*. In some embodiments, one or more additional bacterial strains belong to the species *Bacillus pumi-*

*lus*. In some embodiments, one or more additional bacterial strains belong to the species *Bacillus subtilis*. In some embodiments, one or more additional bacterial strains belong to the species *Bacillus velezensis*. In some embodiments, one or more additional bacterial strains belong to the species *Weizmannia coagulans*. In some embodiments, one or more additional bacterial strains belong to the species *Lactiplantibacillus plantarum*. In some embodiments, one or more additional bacterial strains belong to the species *Bifidobacterium adolescentis*. In some embodiments, one or more additional bacterial strains belong to the species *Bifidobacterium bifidum*. In some embodiments, one or more additional bacterial strains belong to the species *Bifidobacterium longum*. In some embodiments, one or more additional bacterial strains belong to the species *Lactobacillus acidophilus*. In some embodiments, one or more additional bacterial strains belong to the species *Lactobacillus delbrueckii*. In some embodiments, one or more additional bacterial strains belong to the species *Lactobacillus helveticus*. In some embodiments, one or more additional bacterial strains belong to the species *Lactobacillus reuteri*. In some embodiments, one or more additional bacterial strains belong to the species *Lactococcus lactis*.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Pediococcus acidilactici*. In some embodiments, the 16S rDNA sequence of an additional bacterial strain belonging to *Pediococcus acidilactici* is not identical to SEQ ID NO: 1. In some embodiments, an additional bacterial strain belonging to *Pediococcus acidilactici* comprises a 16S rDNA sequence that has at least 97%, but less than 100%, sequence identity to the nucleic acid sequence of SEQ ID NO: 1. In some embodiments, each additional bacterial strain belonging to the species *Pediococcus acidilactici* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 8. In some embodiments, each additional bacterial strain belonging to the species *Pediococcus acidilactici* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 8.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bacillus licheniformis*. In some embodiments, the 16S rDNA sequence of an additional bacterial strain belonging to *Bacillus licheniformis* is not identical to SEQ ID NO: 2. In some embodiments, an additional bacterial strain belonging to *Bacillus licheniformis* comprises a 16S rDNA sequence that has at least 97%, but less than 100%, sequence identity to the nucleic acid sequence of SEQ ID NO: 2. In some embodiments, each additional bacterial strain belonging to the species *Bacillus licheniformis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 9. In some embodiments, each additional bacterial strain belonging to the species *Bacillus licheniformis* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 9.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bacillus pumilus*. In some embodiments, the 16S rDNA sequence of an additional bacterial strain belonging to *Bacillus pumilus* is not identical to SEQ ID NO: 3. In some embodiments, an additional bacterial strain belonging to *Bacillus pumilus* comprises a 16S rDNA sequence that has at least 97%, but less than 100%, sequence identity to the nucleic acid sequence of SEQ ID NO: 3. In some embodiments, each additional bacterial strain belonging to the species *Bacillus pumilus* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 10. In some embodiments, each additional bacterial strain belonging to the species *Bacillus pumilus* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 10.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bacillus subtilis*. In some embodiments, the 16S rDNA sequence of an additional bacterial strain belonging to *Bacillus subtilis* is not identical to SEQ ID NO: 4. In some embodiments, an additional bacterial strain belonging to *Bacillus subtilis* comprises a 16S rDNA sequence that has at least 97%, but less than 100%, sequence identity to the nucleic acid sequence of SEQ ID NO: 4. In some embodiments, each additional bacterial strain belonging to the species *Bacillus subtilis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 11. In some embodiments, each additional bacterial strain belonging to the species *Bacillus subtilis* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 11.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bacillus velezensis*. In some embodiments, the 16S rDNA sequence of an additional bacterial strain belonging to *Bacillus velezensis* is not identical to SEQ ID NO: 5. In some embodiments, an additional bacterial strain belonging to *Bacillus velezensis* comprises a 16S rDNA sequence that has at least 97%, but less than 100%, sequence identity to the nucleic acid sequence of SEQ ID NO: 5. In some embodiments, each additional bacterial strain belonging to the species *Bacillus velezensis* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 12. In some embodiments, each additional bacterial strain belonging to the species *Bacillus velezensis* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 12.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Weizmannia coagulans*. In some embodiments, the 16S rDNA sequence of an additional bacterial strain belonging to *Weizmannia coagulans* is not identical to SEQ ID NO: 6. In some embodiments, an additional bacterial strain belonging to *Weizmannia coagulans* comprises a 16S rDNA sequence that has at least 97%, but less than 100%, sequence identity to the nucleic acid sequence of SEQ ID NO: 6. In some embodiments, each additional bacterial strain belonging to the species *Weizmannia coagulans* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 13. In some embodiments, each additional bacterial strain belonging to the species *Weizmannia coagulans* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 13.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactiplantibacillus plantarum*. In some embodiments, the 16S rDNA sequence of an additional bacterial strain belonging to *Lactiplantibacillus plantarum* is not identical to SEQ ID NO: 7. In some embodiments, an additional bacterial strain belonging to *Lactiplantibacillus plantarum* comprises a 16S rDNA sequence that has at least 97%, but less than 100%, sequence identity to the nucleic acid sequence of SEQ ID NO: 7. In some embodiments, each additional bacterial strain belonging to the species *Lactiplantibacillus plantarum* comprises a genome with at least 95.0%, 95.1%, 95.2%, 95.3%, 95.4%, 95.5%, 95.6%, 95.7%, 95.8%, 95.9%, 96.0%, 96.1%, 96.2%, 96.3%, 96.4%, 96.5%, 96.6%, 96.7%, 96.8%, 96.9%, 97.0%, 97.1%, 97.2%, 97.3%, 97.4%, 97.5%, 97.6%, 97.7%, 97.8%, 97.9%, 98.0%, 98.1%, 98.2%, 98.3%, 98.4%, 98.5%, 98.6%, 98.7%, 98.8%, 98.9%, 99.0%, 99.1%, 99.2%, 99.3%, 99.4%, 99.5%, 99.6%, 99.7%, 99.8%, or 99.9% ANI to the reference genome of SEQ ID NO: 14. In some embodiments, each additional bacterial strain belonging to the species *Lactiplantibacillus plantarum* comprises a genome with an AF of at least 20%, 25%, 30%, 35%, 40%, 45%, 50%, 55%, 60%, 65%, 70%, 75%, 80%, 85%, 90%, 91%, 92%, 93%, 94%, 95%, 96%, 97%, 98%, or 99% to the reference genome of SEQ ID NO: 14.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bifidobacterium adolescentis*. In some embodiments, the 16S rDNA sequence of an additional bacterial strain belonging to *Bifidobacterium adolescentis* is not identical to SEQ ID NO: 15. In some embodiments, an additional bacterial strain belonging to *Bifidobacterium adolescentis* comprises a 16S rDNA sequence that has at least 97%, but less than 100%, sequence identity to the nucleic acid sequence of SEQ ID NO: 15.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bifidobacterium bifidum*. In some embodiments, the 16S rDNA sequence of an additional bacterial strain belonging to *Bifidobacterium bifidum* is not identical to SEQ ID NO: 16. In some embodiments, an additional bacterial strain belonging to *Bifidobacterium bifidum* comprises a 16S rDNA sequence that has at least 97%, but less than 100%, sequence identity to the nucleic acid sequence of SEQ ID NO: 16.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Bifidobacterium longum*. In some embodiments, the 16S rDNA sequence of an additional bacterial strain belonging to *Bifidobacterium longum* is not identical to SEQ ID NO: 17. In some embodiments, an additional bacterial strain belonging to *Bifidobacterium longum* comprises a 16S rDNA sequence that has at least 97%, but less than 100%, sequence identity to the nucleic acid sequence of SEQ ID NO: 17.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactobacillus acidophilus*. In some embodiments, the 16S rDNA sequence of an additional bacterial strain belonging to *Lactobacillus acidophilus* is not identical to SEQ ID NO: 18. In some embodiments, an additional bacterial strain belonging to *Lactobacillus acidophilus* comprises a 16S rDNA sequence that has at least 97%, but less than 100%, sequence identity to the nucleic acid sequence of SEQ ID NO: 18.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactobacillus delbrueckii*. In some embodiments, the 16S rDNA sequence of an additional bacterial strain belonging to *Lactobacillus delbrueckii* is not identical to SEQ ID NO: 19. In some embodiments, an additional bacterial strain belonging to *Lactobacillus delbrueckii* comprises a 16S rDNA sequence that has at least 97%, but less than 100%, sequence identity to the nucleic acid sequence of SEQ ID NO: 19.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactobacillus helveticus*. In some embodiments, the 16S rDNA sequence of an additional bacterial strain belonging to *Lactobacillus helveticus* is not identical to SEQ ID NO: 20. In some embodiments, an additional bacterial strain belonging to *Lactobacillus helveticus* comprises a 16S rDNA sequence that has at least 97%, but less than 100%, sequence identity to the nucleic acid sequence of SEQ ID NO: 20.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactobacillus reuteri*. In some embodiments, the 16S rDNA sequence of an additional bacterial strain belonging to *Lactobacillus reuteri* is not identical to SEQ ID NO: 21. In some embodiments, an additional bacterial strain belonging to *Lactobacillus reuteri* comprises a 16S rDNA sequence that has at least 97%, but less than 100%, sequence identity to the nucleic acid sequence of SEQ ID NO: 21.

In some embodiments, a composition comprises fermentates of 2, 3, 4, 5, 6, 7, 8, 9, 10, 11, 12, 13, 14, 15, 16, 17, 18, 19, or 20 additional bacterial strains belonging to the species *Lactococcus lactis*. In some embodiments, the 16S rDNA sequence of an additional bacterial strain belonging to *Lactococcus lactis* is not identical to SEQ ID NO: 22. In some embodiments, an additional bacterial strain belonging to *Lactococcus lactis* comprises a 16S rDNA sequence that has at least 97%, but less than 100%, sequence identity to the nucleic acid sequence of SEQ ID NO: 22.

Some embodiments of the compositions described herein comprise fermentates of two or more bacterial strains. In some embodiments, the composition comprises fermentates of at least 2, at least 3 at least 4, at least 5, at least 6, at least 7, at least 8, at least 9, at least 10, at least 11, at least 12, at least 13, at least 14, at least 15, at least 16, at least 17, at least 18, at least 19, or up to 20 total bacterial strains. In some embodiments, the composition comprises fermentates of 2-20, 2-19, 2-18, 2-17, 2-16, 2-15, 2-14, 2-13, 2-12, 2-11, 2-10, 2-9, 2-8, 2-7, 2-6, 2-5, 2-4, 2-3, 3-20, 3-19, 3-18, 3-17, 3-16, 3-15, 3-14, 3-13, 3-12, 3-11, 3-10, 3-9, 3-8, 3-7, 3-6, 3-5, 3-4, 4-20, 4-19, 4-18, 4-17, 4-16, 4-15, 4-14, 4-13, 4-12, 4-11, 4-10, 4-9, 4-8, 4-7, 4-6, 4-5, 5-20, 5-19, 5-18, 5-17, 5-16, 5-15, 5-14, 5-13, 5-12, 5-11, 5-10, 5-9, 5-8, 5-7, 5-6, 6-20, 6-19, 6-18, 6-17, 6-16, 6-15, 6-14, 6-13, 6-12, 6-11, 6-10, 6-9, 6-8, 6-7, 7-20, 7-19, 7-18, 7-17, 7-16, 7-15, 7-14, 7-13, 7-12, 7-11, 7-10, 7-9, 7-8, 8-20, 8-19, 8-18, 8-17, 8-16, 8-15, 8-14, 8-13, 8-12, 8-11, 8-10, 8-9, 9-20, 9-19, 9-18, 9-17, 9-16, 9-15, 9-14, 9-13, 9-12, 9-11, 9-10, 10-20, 10-19, 10-18, 10-17, 10-16, 10-15, 10-14, 10-13, 10-12, 10-11, 11-20, 11-19, 11-18, 11-17, 11-16, 11-15, 11-14, 11-13, 11-12, 12-20, 12-19, 12-18, 12-17, 12-16, 12-15, 12-14, 12-13, 13-20, 13-19, 13-18, 13-17, 13-16, 13-15, 13-14, 14-20, 14-19, 14-18, 14-17, 14-16, 14-15, 15-20, 15-19, 15-18, 15-17, 15-16, 16-20, 16-19, 16-18, 16-17, 17-20, 17-19, 17-18, 18-20, 18-19, or 19-20 total bacterial strains.

It will be appreciated that the terms "bacterial strains," "microbial strains" "microbes," "bacterial cells" and "microorganisms" are used interchangeably herein.

Bacterial strains identified as described herein were compared with sequences in publicly available nucleic acid databases, such as Basic Local Alignment Search Tool (BLAST) to determine closely related genera and species and were analyzed using taxonomic assignment tools, such as RDP Classifier, which assign bacterial taxonomy to representative sequences.

16S ribosomal DNA (16S rDNA) sequences encoding 16S ribosomal RNA (16S rRNA) are provided below for representative bacterial strains. The closest related identified bacterial species were determined based on whole genome sequence analysis and a combination of analysis of full length 16S rDNA sequences and the sequences of single-copy conserved genes compared to publicly available sequence databases. It should be appreciated that multiple bacterial strains disclosed herein may have the highest homology with the same species. In some embodiments, bacterial strains having the same or highly related 16S rDNA variable region sequences are nevertheless functionally and/or phenotypically distinct. For example, two strains may differ functionally and/or phenotypically by growth rate, antibiotic resistance, phage resistance, cell wall thickness, motility, competence, spore-forming ability, rates of metabolite (e.g., tryptophan) processing, ability to produce a given metabolite (e.g., ILA, IAld), and/or extent of production of a given metabolite. It should further be appreciated that the bacterial strains disclosed herein that have a 16S rDNA sequence with a nucleic acid sequence selected from the group consisting of SEQ ID NOs: 1-7, are also homologous to other strains based on their whole genome sequence, or subset of their whole genome sequence.

It should further be appreciated that the bacterial species described herein may be identified based on the nucleotide sequence of the full length 16S rDNA. Alternatively or in addition, the bacterial species described herein may be identified based on identification of 16S sequences through whole genome sequencing, and by comparing the sequences with 16S databases, or comparing the whole genome sequence, or a subset of their whole genome sequence to sequence databases.

It should be appreciated that the compositions (and/or nutritional supplements and/or food products comprising the same) may include fermentates of multiple strains of a particular species. In some embodiments, the composition includes multiple strains of a particular species that are obtained from independent sources but the strains have the same or highly related 16S rDNA sequences.

Some embodiments relate to bacterial strains with 16S rDNA sequences that have sequence identity to a nucleic acid sequence of any one of the sequences of the bacterial strains or bacterial species described herein.

"Identity" refers to the degree of sequence relatedness between or among sequences as determined by the number of matching positions between strings of two or more nucleotide sequences. "Percent (%) identity" or "percent (%) sequence identity" as it applies to nucleotide sequences is defined as the percentage of nucleotides in the candidate nucleotide sequence that are identical to the nucleotide sequence of a reference sequence after aligning the sequences and introducing gaps, as necessary, to achieve the maximum score allowed by the alignment algorithm and parameters.

Where an alignment between two sequences is contemplated, the first sequence (e.g., candidate sequence) is aligned to the second sequence (e.g., reference sequence) using the Needleman-Wunsch algorithm for global alignment of the two sequences. Needleman & Wunsch, *J Mol Biol*. 1970. 48:443-453. Where two nucleotide sequences are aligned, the alignment uses an EDNAFULL substitution scoring matrix, a Gap Open penalty of 10, a Gap Extend penalty of 0.5, and no End Gap penalties. The skilled artisan will appreciate that at the time of filing the instant specification, these parameters are the default parameters of the EMBOSS Needle pairwise comparison tool provided by European Bioinformatics Institute (see ebi.ac.uk). Other suitable alignment programs may be used to obtain a global alignment using these parameters, such as BLAST, or the Needleman-Wunsch algorithm may be implemented in a scripting language (e.g., Python).

The percent sequence identity that a candidate sequence (e.g., as present in a bacterial strain encompassed by a claim) has to a reference sequence (e.g., having a SEQ ID NO. specified herein and recited in a claim) is calculated by (i) aligning the candidate sequence to the reference sequence, (ii) determining the number of matching nucleotides between the aligned candidate and reference sequences, and (iii) dividing the number of matching nucleotides by the length of the reference sequence, including any internal gaps introduced into the reference sequence when the two sequences are aligned.

The skilled artisan will appreciate that to determine whether a candidate nucleotide sequence comprises a nucleotide sequence with a given percentage sequence identity to a reference sequence, the denominator (length of reference sequence plus internal gaps) in calculating percent identity need not include gaps shown extending past the ends of the reference sequence in an alignment. Such gaps are added where a candidate sequence contains additional nucleotides that extend beyond the portions of the candidate sequence that align to the 5' end or 3' end of the reference sequence.

Some embodiments relate to bacterial strains comprising a genome (i.e., a chromosome having a nucleotide sequence) with a specified average nucleotide identity (ANI) and/or alignment fraction (AF) to a reference genome. ANI refers to average nucleotide identity of a genome (e.g., as present in a bacterial strain recited in a claim) to a reference genome (e.g., as provided in an Accession No. or SEQ ID NO.), when comparing orthologous regions between the two genomes. The skilled artisan will understand that ANI is not a calculation of percent identity obtained by alignment of two full-length genome sequences. Rather, two genomes are compared to identify regions that are conserved between both genomes, and the average nucleotide identity of all conserved regions is calculated. Konstantinidis & Tiedje, *Proc Natl Acad Sci USA*. 2005. 102(7):2567-2572. Where ANI and/or AF are contemplated, these parameters are calculated using FastANI v1.34 and default configuration. See Jain et al., Nat Commun. 2018. 9(1):5114. A genome will be understood to require the following to be suitable for calculation of ANI to a reference genome: completeness as determined by detection of at least 100 single-copy BUSCO genes. See Simão et al., *Bioinformatics*. 2015. 31(19):3210-3212; Manni et al., *Mol Biol Evol*. 2021. 38(10):4647-4654.

The terms "identical," or percent "identity," in the context of two or more nucleic acids or amino acid sequences, refer to two or more sequences or subsequences that are the same. Two sequences are "substantially identical" if two sequences have a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% sequence identity) over a specified region of a nucleic acid or amino acid sequence or over the entire sequence, when compared and aligned for maximum correspondence over a comparison window, or designated region as measured using one of the following sequence comparison algorithms or by manual alignment and visual inspection. Optionally, the identity exists over a region that is at least about 50 nucleotides in length, or more preferably over a region that is 100 to 500 or 1000 or more nucleotides in length. In some embodiments, the recited degree of identity exists over the length of the 16S rRNA or 16S rDNA sequence.

In some embodiments, the bacterial strain has at least 60%, at least 70%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, at least 99.6%, at least 99.7%, at least 99.8%, at least 99.9%, or up to 100% sequence identity relative to any of the bacterial strains or bacterial species described herein over a specified region (such as a region of the 16S rDNA sequences provided herein) or over the entire sequence (such as the entire 16S rDNA). It would be appreciated by one of skill in the art that the term "sequence identity" or "percent sequence identity," in the context of two or more nucleic acid sequences or amino acid sequences, refers to a measure of similarity between two or more sequences or portion(s) thereof. In some embodiments, the identity exists over the length of the 16S rRNA or 16S rDNA sequence.

Additionally, or alternatively, two or more sequences may be assessed for the alignment between the sequences. An alignment of 100% or "total alignment" referring to two or more nucleic acids or amino acid sequences, refers to two or more sequences or subsequences that are the same. Two sequences are "substantially aligned" if two sequences have less than 100% alignment, such as a specified percentage of amino acid residues or nucleotides that are the same (e.g., at least 80%, 85%, 90%, 95%, 96%, 97%, 98%, 99%, 99.5%, 99.6%, 99.7%, 99.8% or 99.9% identical) over a specified region or over the entire sequence, when compared and aligned for maximum correspondence over a comparison window, or designated region as measured using one of the following sequence comparison algorithms or by manual alignment and visual inspection. Optionally, the alignment exists over a region that is at least about 50 nucleotides in length, or more preferably over a region that is 100 to 500 or 1000 or more nucleotides in length.

For sequence comparison, typically one sequence acts as a reference sequence, to which test sequences are compared. Methods of alignment of sequences for comparison, including measuring identity between sequences, are well known in the art. See, e.g., by the local homology algorithm of Smith and Waterman (1970) *Adv. Appl. Math.* 2:482c, by the homology alignment algorithm of Needleman and Wunsch, *J. Mol. Biol.* (1970) 48:443, by the search for similarity method of Pearson and Lipman. *Proc. Natl. Acad. Sci. USA* (1988) 85:2444, by computerized implementations of these algorithms (GAP, BESTFIT, FASTA, and TFASTA in the Wisconsin Genetics Software Package, Genetics Computer Group. Madison. WI), or by manual alignment and visual inspection (see. e.g., Brent et al., *Current Protocols in Molecular Biology*, John Wiley & Sons, Inc. (Ringbou ed., 2003)). Two examples of algorithms that are suitable for determining percent sequence identity and sequence similarity are the BLAST and BLAST 2.0 algorithms, which are described in Altschul et al., *Nuc. Acids Res*. (1977) 25:3389-3402; and Altschul et al., *J. Mol. Biol*. (1990) 215:403-410, respectively.

As will be appreciated by one of ordinary skill in the art, nomenclature regarding bacterial genus and species names may be reclassified to reflect phylogenetic relationships of microorganisms. See, e.g., Zheng et al., *Inter J. System. And Evol. Microbiol*. (2020) 70(4).

Bacterial strains may be obtained from or derived from any suitable source, such as from a food source or an environmental source. As used herein, the term "derived from" in the context of bacterial strains derived from a particular source refers to obtaining a bacterial strain from the source, which may involve isolating and/or propagating cells of a bacterial strain. In some embodiments, the bacterial strains are further manipulated, such as purified and/or analyzed, prior to use. As will be evident to one of ordinary skill in the art, reference to a bacterial strain or cells of a bacterial strain that is derived from a particular source encompasses progeny cells thereof.

Bacterial strains may be derived from a fermented food or beverage, such as cultured milk and yogurt, natto, cheese, kombucha, wine, beer, cider, miso, kimchi, sauerkraut, fermented sausage, among others. Additionally, bacterial strains may be derived from cultured plants or plant protein isolates, including plants or proteins isolated from cereal grains (e.g., oats), oil seeds (e.g., sunflower seeds), legumes, pulses, beans, broad beans, fava beans, peas, chickpeas, cow peas, pigeon peas, lentils, Bambara beans, vetches, and lupins.

In some embodiments, at least one bacterial strain may be purified. In some embodiments, at least one bacterial strain may be isolated. Any of the bacterial strains described herein may be isolated and/or purified, for example, from a source such as a food source (e.g., a fermented food or beverage product) or an environmental source (e.g., soil).

Compositions Comprising Fermentates

Provided are postbiotic compositions comprising fermentates of bacterial strains. As used herein, the term "fermentate" refers to a product obtained by fermenting a bacterial strain in an environment suitable for fermentation, such as a culture medium. A "postbiotic composition" comprises one or more fermentates, and may be in any suitable form (e.g., in a nutritional supplement, food product, and/or combined with one or more carriers). Postbiotic compositions are distinguished from probiotic compositions (containing live bacteria) at least by the inclusion of fermentates, which comprise products of fermentation, and so may exert activity separate from that of any live bacteria that may or may not be present in the postbiotic composition. In some embodiments, the fermentate comprises products produced by the bacterial strain(s) during fermentation. In some embodiments, the fermentate comprises products produced by the bacterial strain(s) during fermentation and components of the culture medium.

In some embodiments, the bacteria are propagated or manufactured using liquid fermenters, which can support the rapid growth of bacterial species. The fermenters may be, for example, stirred tank reactors or disposable wave bioreactors. Culture media such as BL media and EG media, or similar versions of these media, can be used to support the growth of the bacterial species. The bacterial fermentate can be purified and concentrated from the fermentation broth by suitable techniques, such as centrifugation and filtration. Alternatively or in addition, the bacterial fermentates can be dried and lyophilized by suitable techniques such as those known in the art.

Compositions (e.g., fermentates and/or postbiotic compositions) may comprise one or more compounds in amounts or concentrations at or above a desired threshold. Any suitable method may be used to determine the concentration of one or more compounds in a composition, such as gas chromatography-mass spectrometry (GC-MS) or liquid chromatography/mass spectrometry triple quadrupole (LC/MS-QQQ).

In some embodiments, a composition comprises 50 mg/L or more indole-3-lactic acid (ILA). In some embodiments, the concentration of ILA in the composition is at least 10 mg/L, at least 20 mg/L, at least 30 mg/L, or at least 40 mg/L. In some embodiments, the mass of ILA in the composition is 0.01 to 10 mg, 0.1 to 10 mg, 1 to 10 mg, 0.01 to 1 mg, or 0.01 to 0.1 mg. In some embodiments, the mass of ILA in the composition is 0.1 mg, 0.2 mg, 0.3 mg, 0.4 mg, 0.5 mg, 0.6 mg, 0.7 mg, 0.8 mg, 0.9 mg, or 1.0 mg.

In some embodiments, a composition comprises 10 mg/L or more indole-3-carboxaldehyde (IAld). In some embodiments, the concentration of IAld in the composition is at least 1 mg/L, at least 2 mg/L, at least 4 mg/L, at least 6 mg/L, or at least 8 mg/L. In some embodiments, the mass of IAld in the composition is 0.01 to 10 mg, 0.1 to 10 mg, 1 to 10 mg, 0.01 to 1 mg, or 0.01 to 0.1 mg. In some embodiments, the mass of IAld in the composition is 0.1 mg, 0.2 mg, 0.3 mg, 0.4 mg, 0.5 mg, 0.6 mg, 0.7 mg, 0.8 mg, 0.9 mg, or 1.0 mg.

In some embodiments, a composition comprises 50 mg/L or more indole-3-pyruvic acid (IPyA). In some embodiments, the concentration of IPyA in the composition is at least 10 mg/L, at least 20 mg/L, at least 30 mg/L, or at least 40 mg/L. In some embodiments, the mass of IPyA in the composition is 0.01 to 10 mg, 0.1 to 10 mg, 1 to 10 mg, 0.01 to 1 mg, or 0.01 to 0.1 mg. In some embodiments, the mass of IPyA in the composition is 0.1 mg, 0.2 mg, 0.3 mg, 0.4 mg, 0.5 mg, 0.6 mg, 0.7 mg, 0.8 mg, 0.9 mg, or 1.0 mg.

In some embodiments, a composition comprises 1.5 mg/L or more indole-3-propionic acid (IPA). In some embodiments, the concentration of IPA in the composition is at least 0.1 mg/L, at least 0.3 mg/L, at least 0.6 mg/L, at least 0.9 mg/L, or at least 1.2 mg/L. In some embodiments, the mass of IPA in the composition is 0.0003 to 0.3 mg, 0.003 to 0.3 mg, 0.03 to 0.3 mg, 0.0003 to 0.03 mg, or 0.0003 to 0.003 mg.

In some embodiments, a postbiotic composition comprises at least 0.1% (w/w) ILA. In some embodiments, the % (w/w) ILA is 0.1-10, 0.1-5, 0.1-2, 0.1-1, or 0.1-0.5.

In some embodiments, a postbiotic composition comprises at least 0.015% (w/w) IAld. In some embodiments, the % (w/w) IAld is 0.015-1.5, 0.015-0.75, 0.015-0.30, or 0.015-0.15.

In some embodiments, a postbiotic composition comprises at least 10% w/w IPyA relative to ILA. In some embodiments, the % (w/w) of IPyA relative to ILA is 10-100, 10-50, or 10-20.

In some embodiments, a postbiotic composition comprises at least 1% w/w IPA relative to IAld. In some embodiments, the % (w/w) of IPA relative to IAld is 1-100, 1-50, 1-20, or 1-10.

In some embodiments, a postbiotic composition comprises at least 10% w/w IAA relative to ILA. In some embodiments, the % (w/w) of IAA relative to ILA is 10-100, 10-50, or 10-20.

Compositions may comprise one or more undesired compounds in amounts or concentrations below a desired threshold. Similarly, compositions may be free of detectable amounts of one or more compounds.

In some embodiments, a composition comprises less than 1 g/L tryptophan. In some embodiments, the concentration of tryptophan in the composition is 2 g/L or less, 5 g/L or less, or 10 g/L or less. In some embodiments, the composition does not comprise a detectable amount of tryptophan.

In some embodiments, the composition does not comprise a detectable amount of indole.

In some embodiments, the composition does not comprise a detectable amount of indoxyl sulfate.

In some embodiments, a composition comprises less than 1 mg/L tryptamine. In some embodiments, the concentration of tryptamine in the composition is 2 g/L or less, 5 g/L or less, or 10 g/L or less.

In some embodiments, a composition comprises less than 1 mg/L indole-3-acetamide. In some embodiments, the concentration of indole-3-acetamide in the composition is 2 g/L or less, 5 g/L or less, or 10 g/L or less.

In some embodiments, a composition comprises less than 50 mg/L indole-3-acetic acid (IAA). In some embodiments, the concentration of IAA in the composition is 100 mg/L or less, 200 mg/L or less, 300 mg/L or less, 400 mg/L or less, or 500 mg/L or less. In some embodiments, the composition does not comprise a detectable amount of IAA.

In some embodiments, a postbiotic composition comprises less than 200% w/w tryptophan relative to ILA. In some embodiments, the % (w/w) of tryptophan relative to ILA is 175% or less, 150% or less, 125% or less, 100% or less, 75% or less, 50% or less, 25% or less, or 10% or less.

In some embodiments, a postbiotic composition comprises less than 10% w/w IAA relative to ILA. In some embodiments, the % (w/w) of IAA relative to ILA is 8% or less, 6% or less, 4% or less, 2% or less, or 1% or less.

In some embodiments, a postbiotic composition comprises less than 0.5% w/w tryptamine relative to ILA. In some embodiments, the % (w/w) of tryptamine relative to ILA is 0.4% or less, 0.3% or less, 0.2% or less, or 0.1% or less.

In some embodiments, a postbiotic composition comprises less than 0.5% w/w indole-3-acetamide relative to ILA. In some embodiments, the % (w/w) of indole-3-acetamide relative to ILA is 0.4% or less, 0.3% or less, 0.2% or less, or 0.1% or less.

In some embodiments, a composition acts as a substrate for production of IPA by a bacterial strain of a mammalian intestinal microbiome. In some embodiments, the mammalian intestinal microbiome is a canine intestinal microbiome. In some embodiments, a composition acts as a substrate for production of IPA by a bacterial strain belonging to the species *Clostridium sporogenes*. Any bacterial strain belonging to the species *Clostridium sporogenes* may be used to verify this activity, such as the type strain DSM 795.

A fermentate may or may not contain bacterial cells, and bacterial cells present in the fermentate may be living or dead. In some embodiments, a composition comprising a fermentate of a bacterial strain does not comprise bacterial cells of the bacterial strain. For example, a fermentate may be separated from the bacterial cells that produced the fermentate (e.g., a culture supernatant). Bacterial cells may be separated from fermentate by any suitable method, such as centrifugation or filtration.

In some embodiments, a composition comprising a fermentate of a bacterial strain also comprises bacterial cells of the bacterial strain. In some embodiments, a composition does not comprise live bacterial cells. In some embodiments, the bacterial cells are heat-killed or pasteurized.

In some embodiments, one or more fermentates are in powder form. In some embodiments, each fermentate of a composition is in powder form. In some embodiments, a composition is in powder form. Powder is a dry, bulk solid comprised of many discrete, solid, macroscopic particles, which may flow freely when the powder (or a container in which the powder is present) is shaken or tilted. The skilled artisan will appreciate that powder form fermentates may be incorporated into a composition (e.g., with a carrier and in a defined form), where the composition as a whole has a solid form that is not a powder.

Any suitable method may be used to convert a bacterial fermentate to powder form. Non-limiting examples of powder production processes include grinding and agglomeration (e.g., of solid fermentates), crystallization and spray drying (e.g., of liquid fermentates). Advantages of converting a fermentate to powder form include, without limitation, ease of incorporation into a product intended for consumption (e.g., nutritional supplement or food product intended for ingestion or dental supplement intended for chewing), distribution throughout a product to limit the fermentate mixture's effect on taste and texture, and reduction of water activity to improve stability of desired components of a fermentate mixture.

In some embodiments, a bacterial fermentate mixture in powder form has a water content of 10% or less, 9% or less, 8% or less, 7% or less, 6% or less, 5% or less, 4% or less, 3% or less, 2% or less, or 1% or less.

In some embodiments, one or more fermentates are spray-dried or lyophilized. In some embodiments, one or more fermentates are spray-dried. In some embodiments, each fermentate of a composition is spray-dried. In some embodiments, one or more fermentates are lyophilized. In some embodiments, each fermentate of a composition is lyophilized. Where a fermentate or composition is lyophilized and in powder form, powder may be lyophilized, or a lyophilized non-powder solid may be made into a powder form (e.g., by grinding and/or agglomeration).

Methods of lyophilizing compositions, specifically compositions comprising bacteria and fermentates thereof, are known in the art. See, e.g., U.S. Pat. Nos. 3,261,761; 4,205,132; and PCT Publication Nos. WO 2014/029578, WO 2012/098358, and WO 2019/226707, herein incorporated by reference to the extent they disclose lyophilization and other preservation methods. Fermentates may be lyophilized as a combination and/or the fermentates may be lyophilized separately and combined prior to incorporation into a composition, nutritional supplement, dental supplement, and/or food product. A fermentate may be combined with a nutrient or carrier prior to combining it with another fermentate or multiple lyophilized fermentates may be combined while in lyophilized form and the mixture of fermentates, once combined may subsequently be combined with a nutrient and/or excipient. In some embodiments, the fermentate or combination thereof is a lyophilized cake. In such embodiments, the fermentate(s) may be rehydrated or suspended and/or cultured prior to use. In some embodiments, the fermentate(s) in lyophilized form are used directly, for example, without rehydrating or suspension (e.g., directly added to a composition).

The process of spray-drying refers to production of a dry powder from a liquid comprising a component, such as a fermentate. See, e.g., Ledet et al., *Spray-Drying of Pharmaceuticals in "Lyophilized Biologics and Vaccines"* pages 273-194, Springer. In general, the process involves rapidly drying the fermentates with a hot gas. A fermentate may be combined with an excipient or nutrient prior to combining it with other fermentates, or multiple spray-dried fermentates may be combined while in spray-dried form and the mixture of fermentates, once combined, may be subsequently combined with an excipient, carrier, or nutrient.

The amount of fermentate in a composition is quantified according to dry weight of the fermentate. In some embodiments, a fermentate is present in a composition at an amount of 10 to 1000 mg. In some embodiments, a fermentate is present in a composition at an amount of 10 to 900 mg, 10 to 800 mg, 10 to 700 mg, 10 to 600 mg, 10 to 500 mg, 10 to 400 mg, 10 to 300 mg, 10 to 200 mg, or 10 to 100 mg. In some embodiments, a fermentate is present in a composition at an amount of 900 to 1000 mg, 800 to 1000 mg, 700 to 1000 mg, 600 to 1000 mg, 500 to 1000 mg, 400 to 1000 mg, 300 to 1000 mg, 200 to 1000 mg, or 100 mg to 1000 mg. In some embodiments, a fermentate is present in a composition in an amount of 10 to 100 mg, 100 to 200 mg, 200 to 300 mg, 300 to 400 mg, 400 to 500 mg, 500 to 600 mg, 600 to 700 mg, 700 to 800 mg, 800 to 900 mg, or 900 to 1000 mg.

In some embodiments, the total mass of fermentates in a composition is 10 to 1000 mg. In some embodiments, the total mass of fermentates in a composition is of 10 to 900 mg, 10 to 800 mg, 10 to 700 mg, 10 to 600 mg, 10 to 500 mg, 10 to 400 mg, 10 to 300 mg, 10 to 200 mg, or 10 to 100 mg. In some embodiments, the total mass of fermentates in a composition is 900 to 1000 mg, 800 to 1000 mg, 700 to 1000 mg, 600 to 1000 mg, 500 to 1000 mg, 400 to 1000 mg, 300 to 1000 mg, 200 to 1000 mg, or 100 mg to 1000 mg. In some embodiments, the total mass of fermentates in a composition is 10 to 100 mg, 100 to 200 mg, 200 to 300 mg, 300 to 400 mg, 400 to 500 mg, 500 to 600 mg, 600 to 700 mg, 700 to 800 mg, 800 to 900 mg, or 900 to 1000 mg.

In some embodiments, a fermentate is present in a composition at an amount of 0.1 to 1000 mg. In some embodiments, a fermentate is present in a composition at an amount of 0.1 to 900 mg, 0.1 to 800 mg, 0.1 to 700 mg, 0.1 to 600 mg, 0.1 to 500 mg, 0.1 to 400 mg, 0.1 to 300 mg, 0.1 to 200 mg, or 0.1 to 100 mg. In some embodiments, a fermentate is present in a composition in an amount of 0.1 to 100 mg, 100 to 200 mg, 200 to 300 mg, 300 to 400 mg, 400 to 500 mg, 500 to 600 mg, 600 to 700 mg, 700 to 800 mg, 800 to 900 mg, or 900 to 1000 mg.

In some embodiments, the total mass of fermentates in a composition is 0.2 to 2000 mg. In some embodiments, the total mass of fermentates in a composition is 0.2 to 1800 mg, 0.2 to 1600 mg, 0.2 to 1400 mg, 0.2 to 1200 mg, 0.2 to 1000 mg, 0.2 to 800 mg, 0.2 to 600 mg, 0.2 to 400 mg, or 0.2 to 200 mg. In some embodiments, the total mass of fermentates in a composition is 0.2 to 200 mg, 200 to 400 mg, 400 to 600 mg, 600 to 800 mg, 800 to 1000 mg, 1000 to 1200 mg, 1200 to 1400 mg, 1400 to 1600 mg, 1600 mg to 1800 mg.

In some embodiments, the fermentates are present in substantially equal masses in a composition. In some embodiments, the first fermentate is present in a composition in an amount that is 10% to 1000% the mass of the second fermentate. In some embodiments, the second fermentate is present in a composition in an amount that is 10% to 1000% the mass of the first fermentate. In some embodiments, a composition comprises a 1:1, 2:1, 3:1, 4:1, 5:1, 6:1, 7:1, 8:1, 9:1, or 10:1 ratio by mass of the first fermentate to the second fermentate.

Nutritional Supplements and Food Products

Some aspects relate to a nutritional supplement comprising any of the compositions (e.g., postbiotic compositions) or fermentates described herein. Some aspects relate to a food product comprising any of the compositions (e.g., postbiotic compositions) or fermentates described herein. Food products and nutritional supplements are, in general, intended for the consumption of a human or other animal, such as a companion animal (e.g., a dog), or a bird. As will be appreciated by one of ordinary skill in the art, a food product provides a primary caloric and nutritive source intended for consumption by a subject (e.g., a feed or treat). In contrast, a nutritional supplement is not intended to provide a primary caloric or nutritive source for a subject but rather provides a targeted effect. Nutritional supplements may provide additional nutrients or functional ingredients that complement a standard diet, e.g., a standard pet diet.

Any of the bacterial strains, fermentates thereof, or combinations thereof may be present in a nutritional supplement or food product. The compositions disclosed herein can be used in a food or beverage, such as a health food, a pet food, a functional food, a dietary supplement, a food or beverage for patients, or an animal feed.

Non-limiting examples of the forms of nutritional supplements include carbohydrate-containing foods such as rice food products; paste products such as fish, hams, sausages, paste products of seafood; pouch products. Further, the examples also include food products and nutritional supplements prepared in the forms of powders, granules, kibbles, tablets, capsules, liquids, pastes, chews, and jellies.

Any suitable form may be used for a food product or nutritional supplement. Non-limiting examples of form factors include chews with softer interiors than exteriors, kibbles, and spreads. Additional examples of form factors include a gelatinized starch matrix, extruded or injection-molded dental stick, extruded or injection-molded dental chew, chew having a soft interior, powder meal topper, water additive, dry kibble or food, wet food, frozen food, liquid spray, peanut butter spread, and soft jerky chew.

In some embodiments, the nutritional supplement is a chew having a soft interior. In some embodiments, the nutritional supplement is a kibble. In some embodiments, the kibble is an extruded kibble. Extruded and/or injection-molded chews, sticks, and kibbles are known in the art, and any suitable method may be used to manufacture such chews, sticks, and kibbles. In some embodiments, the food product, or nutritional supplement is a soft jerky chew. Jerky chews may be made from any suitable starting material, such as dried meat. In some embodiments, the food product or nutritional supplement is a spread. In some embodiments, the spread comprises one or more nuts. In some embodiments, the spread is a peanut butter spread. The skilled artisan will appreciate that a food product or supplement intended for consumption by a particular animal will not contain ingredients that are toxic to that animal (e.g., macadamia nuts for dogs).

In some embodiments, the nutritional supplement is an additive. Additives may be added to other foods or food products before consumption by an animal. In some embodiments, the nutritional supplement is a water additive. Water additives are added to drinking water. In some embodiments, the nutritional supplement is a meal topper. Meal toppers may be added directly to food before consumption, with or without incorporation before consumption. In some embodiments, the meal topper is in powder form (a powder meal topper). In some embodiments, the nutritional supplement is a liquid spray. Liquid sprays may be administered directly to an animal, or sprayed on food or in water, with or without incorporation before consumption.

In some embodiments, the food product or nutritional supplement is in the form of a wet food. In some embodiments, the food product or dental supplement is in the form of a frozen food. Wet foods and frozen foods may be in any suitable form, such as those described in Niamnuy, C., & Devahastin, S. (2010). 11 Pet Foods and Their Physicochemical Properties as Affected by Processing. Contemporary Food Engineering, 327.

In some embodiments, the nutritional supplement or food product comprises a fermentate or combination thereof, and a carrier. The carrier may contain any combination of nutrients, excipients, diluents, and/or binders. In some embodiments, the carrier comprises one or more of the following compounds: water, glycerol, ethylene glycol, 1,2-propylene glycol or 1,3-propylene glycol, sodium chloride, sodium benzoate, potassium sorbate, sodium sulfate, potassium sulfate, magnesium sulfate, sodium thiosulfate, calcium carbonate, sodium citrate, dextrin, maltodextrin, glucose, sucrose, sorbitol, lactose, whey, whey permeate, wheat flour, wheat bran, corn gluten meal, starch and cellulose. In some embodiments, the carrier is a gelatinized starch matrix. In some embodiments, the carrier is maltodextrin. Maltodextrin can be derived from any starch, such as rice, potato, corn, wheat, or cassava. In some embodiments, the carrier is a tapioca-based maltodextrin. Any suitable method may be used to obtain maltodextrin from tapioca, such as isolation from a tapioca plant.

In some embodiments, the carrier is present in a 2:1, 3:1, 4:1, 5:1, 6:1, 7:1, 8:1, 9:1, or 10:1 ratio by weight relative to the total amount of fermentates. In some embodiments, the carrier is present in a 1:2, 1:3, 1:4, 1:5, 1:6, 1:7, 1:8, 1:9, or 1:10 ratio by weight relative to the total amount of fermentates. In some embodiments, the carrier is present in a 2:1 ratio by weight relative to the total amount of fermentates. In some embodiments, the carrier is present in a 1:1 ratio by weight relative to the total amount of fermentates. In some embodiments, the carrier is present in a 2:1 ratio by weight relative to each fermentate. In some embodiments, the carrier is present in a 1:1 ratio by weight relative to each fermentate. In some embodiments, the carrier is present in a 1:1 ratio by weight relative to each of three fermentates. In some embodiments, the carrier is present in a 2:1 ratio by weight relative to each of two fermentates.

In some embodiments, the carrier is present in a 11:1, 12:1, 13:1, 14:1, 15:1, 16:1, 17:1, 18:1, 19:1, 20:1, 21:1, 22:1, 23:1, 24:1, 25:1, 26:1, 27:1, 28:1, 29:1, 30:1, 31:1, 32:1, 33:1, 34:1, 35:1, 36:1, 37:1, 38:1, 39:1, 40:1, 41:1, 42:1, 43:1, 44:1, 45:1, 46:1, 47:1, 48:1, 49:1, or 50:1 ratio by weight, relative to the total amount of fermentates.

In some embodiments, a nutritional supplement and/or food product comprises a composition comprising fermentate(s) at an incorporation rate of 0.01% to 20% w/w. As used herein, an "incorporation rate" refers to the weight of the fermentate-containing composition as a percentage of the total weight of the nutritional supplement, or food product. For example, 10 mg of a fermentate-containing composition in a 50 g supplement is present at an incorporation rate of 0.2% w/w. In some embodiments, the incorporation rate is 0.01% to 20% w/w. In some embodiments, the incorporation rate is 0.01% to 15% w/w. In some embodiments, the incorporation rate is 0.01% to 10% w/w. In some embodiments, the incorporation rate is 0.01% to 5% w/w. In some embodiments, the incorporation rate is 0.02% to 10%, 0.03% to 10%, 0.04% to 10%, 0.05% to 10%, 0.06% to 10%, 0.07% to 10%, 0.08% to 10%, 0.09% to 10%, 0.1% to 10%, 0.2% to 10%, 0.3% to 10%, 0.4% to 10%, 0.5% to 10%, 0.6% to 10%, 0.7% to 10%, 0.8% to 10%, 0.9% to 10%, 1% to 10%, 2% to 10%, 3% to 10%, 4% to 10%, 5% to 10%, 6% to 10%, 7% to 10%, 8% to 10%, or 9% to 10% w/w. In some embodiments, the incorporation rate is 0.1% to 10%, 0.1% to 9%, 0.1% to 8%, 0.1% to 7%, 0.1% to 6%, 0.1% to 5%, 0.1% to 4%, 0.1% to 3%, 0.1% to 2%, or 0.1% to 1% w/w. In some embodiments, the incorporation rate is 0.1% to 2%, 2% to 4%, 4% to 6%, 6% to 8%, 8% to 10%, 10% to 15%, or 15% to 20% w/w.

In some embodiments, a nutritional supplement and/or food product comprises a certain mass of a composition comprising fermentate(s). Defined masses of compositions are useful, for example, for supplements and/or food products that may be diluted in food or water before consumption. In some embodiments, 2 to 2,000 mg of a fermentate-containing composition is present in a nutritional supplement and/or food product. In some embodiments, 20 to 2,000, 20 to 1,800, 20 to 1,600, 20 to 1,400, 20 to 1,200, 20 to 1,000, 20 to 900, 20 to 800, 20 to 700, 20 to 600, 20 to 500, 20 to 400, 20 to 300, 20 to 200, 20 to 100, or 20 to 50 mg of the composition is present. In some embodiments, 50 to 2,000, 100 to 2,000, 200 to 2,000, 300 to 2,000, 400 to 2,000, 500 to 2,000, 600 to 2,000, 700 to 2,000, 800 to 2,000, 900 to 2,000, 1,000 to 2,000, 1,200 to 2,000, 1,400 to 2,000, 1,600 to 2,000, or 1,800 to 2,000 mg of the composition is present. In some embodiments, 100 to 200, 200 to 300, 300 to 400, 400 to 500, 500 to 600, 600 to 700, 700 to 800, 800 to 900, 1,000 to 1,200, 1,200 to 1,400, 1,400 to 1,600, 1,600 to 1,800, or 1,800 to 2,000 mg of the composition is present. In some embodiments, 0.01 to 0.1, 0.1 to 1, 1 to 10, 10 to 100, 100 to 1,000, or 1,000 to 10,000 mg of the composition is present.

In some embodiments, a nutritional supplement and/or food product is formulated for administration to subject to deliver a specified amount of one or more compounds, including ILA and IAld. A nutritional supplement and/or food product is formulated for administration to a canine subject at an ILA dose of 0.8 µg/kg per day to 8 mg/kg per day, and an IAld dose of 0.08 µg/kg per day to 800 µg/kg per day. In some embodiments, the ILA dose is 0.8 µg/kg per day to 8 µg/kg per day, 8 µg/kg per day to 80 µg/kg per day, 80 µg/kg per day to 800 µg/kg per day, or 800 µg/kg per day to 8 mg/kg per day. In some embodiments, the IAld dose is 0.08 µg/kg per day to 0.8 µg/kg per day, 0.8 µg/kg per day to 8 µg/kg per day, 8 µg/kg per day to 80 µg/kg per day, or 80 µg/kg per day to 800 µg/kg per day.

A nutritional supplement and/or food product may be formulated in a single dosage form that is administered at once, delivering an entire day's dose in the provision of one dosage form (e.g., one treat or one meal). A nutritional supplement and/or food product may be formulated in multiple dosage forms to be administered over the course of a day, such that a certain total amount of ILA and IAld administered in a day. For example, a nutritional supplement may be formulated to be administered three times per day, with each administration providing a third of the specified dose. In some embodiments, the nutritional supplement is formulated for administration in 1, 2, 3, 4, 5, 6, 7, 8, 9, or 10 doses per day.

A nutritional supplement and/or food product may comprise one or more nutrients. The nutrient may be a carbohydrate or carbohydrate source. Non-limiting examples of carbohydrate sources include grains, such as corn, rice, milo, sorghum, barley, alfalfa, oats, and wheat. In some embodiments, the nutrient is a grain. In some embodiments, the nutrient is wheat, corn, rice, oats, and/or barley. A nutritional supplement and/or food product may comprise a gelatinized starch matrix. Matrices of gelatinized starch may comprise any suitable starch, such as a starch listed herein or another starch known in the art.

A nutritional supplement and/or food product may comprise a fiber. Fibers may add bulk to a composition and may be fermented by intestinal bacteria to produce short-chain fatty acids and other metabolites. Non-limiting examples of fibers include beet pulp (e.g., sugar beet pulp), gum arabic, gum talha, psyllium, rice bran, carob bean gum, citrus pulp, pectin, fructooligosaccharide, mannaoligofructose, soy fiber, arabinogalactan, galactooligosaccharide, arabinoxylan, chicory pulp, chicory, coconut endosperm fiber, wheat fiber, and inulin.

A nutritional supplement and/or food product may comprise an algal strain. Algae may add one or more nutrients and/or bulk to a composition. Non-limiting examples of algal species include *Ascophylum nodosum*, *Spirulina* (e.g., *Arthrospira platensis*, *Arthrospira fusiformis*, and *Arthrospira maxima*), and/or *Fucus vsiculosus*.

A nutritional supplement and/or food product may comprise one or more inorganic minerals. Non-limiting examples of minerals include calcium carbonate, calcium, boron, selenium, calcium chloride, chloride, ferrous fumarate, zinc acetate, choline chloride, chromium, ferrous gluconate, zinc sulfate, chromium, tripicolinate, cobalt, magnesium oxide, zinc gluconate, dicalcium phosphate, copper, magnesium sulfate, ferrous sulfate, iodine, magnesium carbonate, monosodium phosphate, iron, chromium picolinate, potassium chloride, magnesium, calcium citrate, potassium citrate, manganese, calcium lactate, potassium sorbate, phosphorus, calcium gluconate, sodium bisulfate, potassium, chromium chloride, sodium hexametaphosphate, sodium, chromium nicotinate, tricalcium phosphate, zinc, and chromium citrate.

A nutritional supplement and/or food product may comprise one or more protein sources. Non-limiting examples of such protein sources include chicken meals, chicken, chicken byproduct meals, eggs, lamb, lamb meals, turkey, turkey meals, beef, beef by-products, viscera, fish, fish meal, enterals, kangaroo, white fish, venison, blood marrow, bone marrow, soybean meal, soy protein isolate, and soy protein concentrate.

A nutritional supplement, and/or food product may comprise one or more starches. Non-limiting examples of such starches include cereals, grains, corn, wheat, rice, oats, corn grits, sorghum, grain sorghum, milo, wheat bran, oat bran, amaranth, durum, and semolina.

A nutritional supplement and/or food product may comprise one or more dairy products. Dairy products include, without limitation, cream, milk, butter, and cheese.

A nutritional supplement and/or food product may comprise a meat or animal-derived material. In some embodiments, the meat or animal-derived material is beef, chicken, eggs, turkey, lamb, fish, blood marrow, bone marrow, or a combination of any thereof.

Fermentation Methods

Some aspects relate to methods of preparing compositions by fermenting one or more bacterial strains to produce fermentates and combining the fermentates to prepare a postbiotic composition. It was surprisingly discovered that certain bacterial strains, while independently capable of producing several distinct indole-containing compounds (e.g., ILA and IAld), could produce greater amounts of one compound using certain fermentation conditions. By fermenting bacterial strains separately under different conditions, individual fermentates containing substantial amounts of distinct indole-containing compounds may be produced and combined to produce a postbiotic composition comprising high amounts of each indole-containing compound.

For example, a method for producing a postbiotic composition comprises: (i) fermenting a first bacterial strain, the first bacterial strain comprising a 16S rDNA sequence with at least 97% sequence identity to the nucleotide sequence of SEQ ID NO: 1 or SEQ ID NO: 7, in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld, thereby producing a second fermentate comprising IAld; and (iii) combining the first and second fermentates to produce a postbiotic composition comprising ILA and IAld.

In some aspects, a method for producing a postbiotic composition comprises: (i) fermenting a first bacterial strain of *Pediococcus acidlactici* in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld, thereby producing a second fermentate comprising IAld; and (iii) combining the first and second fermentates to produce a postbiotic composition comprising ILA and IAld.

In some aspects, a method for producing a postbiotic composition comprises: (i) fermenting a first bacterial strain, the first bacterial strain comprising a 16S rDNA sequence with at least 97% sequence identity to the nucleotide sequence of SEQ ID NO: 1, in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld, thereby producing a second fermentate comprising IAld; and (iii) combining the first and second fermentates to produce a postbiotic composition comprising ILA and IAld.

In some aspects, a method for producing a postbiotic composition comprises: (i) fermenting a first bacterial strain of *Lactiplantibacillus plantarum* in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld, thereby producing a second fermentate comprising IAld; and (iii) combining the first and second fermentates to produce a postbiotic composition comprising ILA and IAld.

In some aspects, a method for producing a postbiotic composition comprises: (i) fermenting a first bacterial strain, the first bacterial strain comprising a 16S rDNA sequence with at least 97% sequence identity to the nucleotide sequence of SEQ ID NO: 7, in a first fermentation medium under conditions for production of indole-3-lactic acid (ILA), thereby producing a first fermentate comprising ILA; (ii) fermenting the first bacterial strain in a second fermentation medium under conditions for production of indole-3-carboxaldehyde (IAld), thereby producing a second fermentate comprising IAld, thereby producing a second fermentate comprising IAld; and (iii) combining the first and second fermentates to produce a postbiotic composition comprising ILA and IAld.

In the course of fermentation under conditions for producing ILA or IAld, the bacterial strain may also produce one or more additional indole-containing compounds, such that the fermentate further comprises one or more indole-containing compounds in addition to ILA or IAld.

In some embodiments, the fermentation is carried out under conditions for production of both ILA and IPyA. In some embodiments, the fermentation is carried out under conditions for production of both ILA and IPA. In some embodiments, the fermentation is carried out under conditions for production of ILA, IPA, and IPyA.

In some embodiments, the fermentation is carried out under conditions for production of both ILA and IA. In some embodiments, the fermentation is carried out under conditions for production of both ILA and IAA. In some embodiments, the fermentation is carried out under conditions for production of ILA, IA, and IAA.

In some embodiments, the fermentation is carried out under conditions for production of both IAld and IPyA. In some embodiments, the fermentation is carried out under conditions for production of both IAld and IPA. In some embodiments, the fermentation is carried out under conditions for production of IAld, IPA, and IPyA.

In some embodiments, the fermentation is carried out under conditions for production of both IAld and IA. In some embodiments, the fermentation is carried out under conditions for production of both IAld and IAA. In some embodiments, the fermentation is carried out under conditions for production of IAld, IA, and IAA.

Some embodiments of methods for preparing a postbiotic composition include conducting one or more additional fermentations to produce one or more additional fermentates, with such additional fermentate(s) being combined with the fermentates comprising ILA and IAld. Additional fermentations may be carried out, for instance, to separate bacterial strains that may inhibit production of one or more desired compounds by another strain when present in the same fermentation medium. Separating bacterial strains also reduces competition for resources between co-fermenting bacterial strains, avoiding the need to adjust relative amounts of different bacterial strains to achieve a desired fermentate composition.

In some embodiments, 1, 2, 3, 4, 5, 6, 7, 8, 9, 10, 11, 12, 13, 14, 15, 16, 17, 18, 19, or 20 additional fermentations are carried out, with the fermentate of each additional fermentation being combined with the first and second fermentates comprising ILA and IAld. In some embodiments, one or more additional fermentations with a bacterial strain of *Pediococcus acidilactici* are performed. In some embodiments, one or more additional fermentations with a bacterial strain of *Bacillus licheniformis* are performed. In some embodiments, one or more additional fermentations with a bacterial strain of *Bacillus pumilus* are performed. In some embodiments, one or more additional fermentations with a bacterial strain of *Bacillus subtilis* are performed. In some embodiments, one or more additional fermentations with a bacterial strain of *Bacillus velezensis* are performed. In some embodiments, one or more additional fermentations with a bacterial strain of *Weizmannia coagulans* are performed. In some embodiments, one or more additional fermentations with a bacterial strain of *Lactiplantibacillus plantarum* are performed.

In additional fermentations, a fermentation medium may comprise any combination of bacterial strains selected from *Pediococcus acidilactici, Bacillus licheniformis, Bacillus pumilus, Bacillus subtilis, Bacillus velezensis, Weizmannia coagulans,* and *Lactiplantibacillus plantarum*.

In some embodiments, one or more additional fermentations are conducted under conditions for producing IPyA. In some embodiments, one or more additional fermentations are conducted under conditions for producing IPA.

In some embodiments, one or more additional fermentations are conducted under conditions for producing IA. In some embodiments, one or more additional fermentations are conducted under conditions for producing IAA.

Fermentation under conditions for production of ILA, fermentation under conditions for production of IAld, and/or additional fermentations may be conducted under conditions such that a fermentate comprises a compound in amount at or greater than a threshold. In some embodiments, fermentation under conditions for production of ILA is carried out such that the fermentate comprises at least 50 mg/L ILA. In some embodiments, fermentation under conditions for production of IAld is carried out such that the fermentate comprises at least 10 mg/L IAld.

In some embodiments, a fermentation is carried out such that the fermentate comprises at least 50 mg/L IPyA. In some embodiments, a fermentation is carried out such that the fermentate comprises at least 1.5 mg/L IPA. In some embodiments, a fermentation is carried out such that the fermentate comprises at least 50 mg/L IAA.

Fermentation under conditions for production of ILA, fermentation under conditions for production of IAld, and/or additional fermentations may be conducted under conditions such that a fermentate comprises an undesired compound at an amount below a threshold.

In some embodiments, a fermentation is carried out such that the concentration of tryptophan in the fermentate is 1 mg/L or less. In some embodiments, a fermentation is carried out such that the concentration of IAA in the fermentate is 50 mg/L or less. In some embodiments, a fermentation is carried out such that the concentration of tryptamine in the fermentate is 1 mg/L or less. In some embodiments, a fermentation is carried out such that the concentration of indole-3-acetamide in the fermentate is 1 mg/L or less.

In some embodiments, a fermentation is carried out such that the fermentate comprises at least 0.1% (w/w) ILA. In some embodiments, a fermentate mixture comprises at least 0.1% (w/w) ILA. In some embodiments, a postbiotic composition comprises at least 0.1% (w/w) ILA. In some embodiments, the % (w/w) ILA is 0.1-10, 0.1-5, 0.1-2, 0.1-1, or 0.1-0.5.

In some embodiments, a fermentation is carried out such that the fermentate comprises at least 0.015% (w/w) IAld. In some embodiments, a fermentate mixture comprises at least 0.015% (w/w) IAld. In some embodiments, a postbiotic composition comprises at least 0.015% (w/w) IAld. In some embodiments, the % (w/w) IAld is 0.015-1.5, 0.015-0.75, 0.015-0.30, or 0.015-0.15.

In some embodiments, a fermentation is carried out such that the fermentate comprises at least 10% w/w IPyA relative to ILA. In some embodiments, a fermentate mixture comprises at least 10% w/w IPyA relative to ILA. In some embodiments, a postbiotic composition comprises at least 10% w/w IPyA relative to ILA. In some embodiments, the % (w/w) of IPyA relative to ILA is 10-100, 10-50, or 10-20.

In some embodiments, a fermentation is carried out such that the fermentate comprises at least 1% w/w IPA relative to IAld. In some embodiments, a fermentate mixture comprises at least 1% w/w IPA relative to IAld. In some embodiments, a postbiotic composition comprises at least 1% w/w IPA relative to IAld. In some embodiments, the % (w/w) of IPA relative to IAld is 1-100, 1-50, 1-20, or 1-10.

In some embodiments, a fermentation is carried out such that the fermentate comprises at least 10% w/w IAA relative to ILA. In some embodiments, a fermentate mixture comprises at least 10% w/w IAA relative to ILA. In some embodiments, a postbiotic composition comprises at least 10% w/w IAA relative to ILA. In some embodiments, the % (w/w) of IAA relative to ILA is 10-100, 10-50, or 10-20.

In some embodiments, a fermentation is carried out such that the fermentate comprises less than 200% w/w tryptophan relative to ILA. In some embodiments, a fermentate mixture comprises less than 200% w/w tryptophan relative to ILA. In some embodiments, a postbiotic composition comprises less than 200% w/w tryptophan relative to ILA. In some embodiments, the % (w/w) of tryptophan relative to ILA is 175% or less, 150% or less, 125% or less, 100% or less, 75% or less, 50% or less, 25% or less, or 10% or less.

In some embodiments, a fermentation is carried out such that the fermentate comprises less than 10% w/w IAA relative to ILA. In some embodiments, a fermentate mixture comprises less than 10% w/w IAA relative to ILA. In some embodiments, a postbiotic composition comprises less than 10% w/w IAA relative to ILA. In some embodiments, the % (w/w) of IAA relative to ILA is 8% or less, 6% or less, 4% or less, 2% or less, or 1% or less.

In some embodiments, a fermentation is carried out such that the fermentate comprises less than 0.5% w/w tryptamine relative to ILA. In some embodiments, a fermentate mixture comprises less than 0.5% w/w tryptamine relative to ILA. In some embodiments, a postbiotic composition comprises less than 0.5% w/w tryptamine relative to ILA. In some embodiments, the % (w/w) of tryptamine relative to ILA is 0.4% or less, 0.3% or less, 0.2% or less, or 0.1% or less.

In some embodiments, a fermentation is carried out such that the fermentate comprises less than 0.5% w/w indole-3-acetamide relative to ILA. In some embodiments, a fermentate mixture comprises less than 0.5% w/w indole-3-acetamide relative to ILA. In some embodiments, a postbiotic composition comprises less than 0.5% w/w indole-3-acetamide relative to ILA. In some embodiments, the % (w/w) of indole-3-acetamide relative to ILA is 0.4% or less, 0.3% or less, 0.2% or less, or 0.1% or less.

In some embodiments, a fermentation is carried out in a fermentation medium comprising tryptophan at a concentration of 1 g/L to 12 g/L. In some embodiments, the tryptophan concentration is 1.0 g/L to 10 g/L, 1.0 to 8.0 g/L, or 1.0 g/L to 6.0 g/L. In some embodiments, the tryptophan concentration is 2.0 g/L to 12 g/L, 4.0 to 12 g/L, or 6.0 g/L to 12 g/L.

In some embodiments, a fermentation is carried out in a fermentation medium comprising tryptophan at a concentration of 1.0 g/L to 50 g/L. In some embodiments, the tryptophan concentration is 1.0 g/L to 40 g/L, 1.0 g/L to 30 g/L, 1.0 g/L to 20 g/L, or 1.0 g/L to 15 g/L. In some embodiments, the tryptophan concentration is 10 g/L to 50 g/L, 20 g/L to 50 g/L, 30 g/L to 50 g/L, or 40 g/L to 50 g/L. In some embodiments, the tryptophan concentration is about 10 g/L, about 20 g/L, about 30 g/L, about 40 g/L, or about 50 g/L.

In some embodiments, a bacterial strain is fermented under conditions for IAld production, where the concentration of glucose in the fermentation medium is less than 4 g/L. In some embodiments, the glucose concentration is 3.5 g/L or less, 3.0 g/L or less, 2.5 g/L or less, 2.0 g/L or less, 1.5 g/L or less, 1.0 g/L or less, or 0.5 g/L or less. In some embodiments, the glucose concentration is 0.1 g/L to 4.0 g/L, 0.5 g/L to 4.0 g/L, 1.0 g/L to 4.0 g/L, 2.0 g/L to 4.0 g/L, or 3.0 g/L to 4.0 g/L.

Bacterial strains may be fermented in fermentation media comprising one or more carbon sources. Non-limiting examples of carbon sources include monosaccharides (e.g., glucose), disaccharides (e.g., sucrose, trehalose), oligosaccharides, polysaccharides, starches, and cellulose.

In some embodiments, a bacterial strain is fermented under conditions for IAld production, where the concentration of one or more carbon sources in the fermentation medium is 4 g/L to 200 g/L. In some embodiments, the carbon source concentration is 4 g/L to 180 g/L, 4 g/L to 160 g/L, or 4 g/L to 140 g/L. In some embodiments, the carbon source concentration is 100 g/L to 200 g/L. In some embodiments, the carbon source concentration is 1 g/L to 100 g/L. In some embodiments, the carbon source concentration is 1 g/L to 90 g/L, 1 g/L to 80 g/L, 1 g/L to 70 g/L, or 1 g/L to 60 g/L. In some embodiments, the carbon source concentration is 20 g/L to 100 g/L, 30 g/L to 100 g/L, 40 g/L to 100 g/L, or 50 g/L to 100 g/L. In some embodiments, the carbon source concentration is 1 g/L to 25 g/L, 25 g/L to 50 g/L, 50 g/L to 75 g/L, or 75 g/L to 100 g/L. In some embodiments, the carbon source is a monosaccharide. In some embodiments, the carbon source is a disaccharide. In some embodiments, the carbon source is a starch. In some embodiments, the carbon source is cellulose.

In some embodiments, a bacterial strain is fermented under conditions for IAld production, where the concentration of glucose in the fermentation medium is 4 g/L to 200 g/L. In some embodiments, the glucose concentration is 4 g/L to 180 g/L, 4 g/L to 160 g/L, or 4 g/L to 140 g/L. In some embodiments, the glucose concentration is 100 g/L to 200 g/L. In some embodiments, the glucose concentration is 1 g/L to 100 g/L. In some embodiments, the glucose concentration is 1 g/L to 90 g/L, 1 g/L to 80 g/L, 1 g/L to 70 g/L, or 1 g/L to 60 g/L. In some embodiments, the glucose concentration is 20 g/L to 100 g/L, 30 g/L to 100 g/L, 40 g/L to 100 g/L, or 50 g/L to 100 g/L. In some embodiments, the glucose concentration is 1 g/L to 25 g/L, 25 g/L to 50 g/L, 50 g/L to 75 g/L, or 75 g/L to 100 g/L.

In some embodiments, a bacterial strain is fermented under conditions for ILA production, where the concentration of glucose in the fermentation medium is at least 4.0 g/L. In some embodiments, the glucose concentration is at least 5.0 g/L, at least 6.0 g/L, at least 8.0 g/L, at least 10 g/L, at least 12 g/L, or at least 14 g/L. In some embodiments, the glucose concentration is 4.0 to 15 g/L, 4.0 g/L to 12 g/L, 4.0 g/L to 10 g/L, 4.0 g/L to 8 g/L, or 4.0 to 6.0 g/L. In some embodiments, the glucose concentration is 6.0 to 15 g/L, 8.0 g/L to 15 g/L, 10 g/L to 15 g/L, 12 g/L to 15 g/L, or 14 to 15 g/L.

In some embodiments, a bacterial strain is fermented under conditions for ILA production, where the concentration of glucose in the fermentation medium is 4 g/L to 200 g/L. In some embodiments, the glucose concentration is 4 g/L to 180 g/L, 4 g/L to 160 g/L, or 4 g/L to 140 g/L. In some embodiments, the glucose concentration is 100 g/L to 200 g/L. In some embodiments, the glucose concentration is 100 g/L to 180 g/L, 100 g/L to 160 g/L, 100 g/L to 140 g/L, or 100 g/L to 120 g/L. In some embodiments, the glucose concentration is 120 g/L to 200 g/L, 140 g/L to 200 g/L, 160 g/L to 200 g/L, or 180 g/L to 200 g/L. In some embodiments, the glucose concentration is 100 g/L to 120 g/L, 120 g/L to 140 g/L, 140 g/L to 160 g/L, 160 g/L to 180 g/L, or 180 g/L to 200 g/L.

In some embodiments, a bacterial strain is fermented under conditions for ILA production, where the concentration of one or more carbon sources in the fermentation medium is 4 g/L to 200 g/L. In some embodiments, the carbon source concentration is 4 g/L to 180 g/L, 4 g/L to 160 g/L, or 4 g/L to 140 g/L. In some embodiments, the carbon source concentration is 100 g/L to 200 g/L. In some embodiments, the carbon source concentration is 100 g/L to 180 g/L, 100 g/L to 160 g/L, 100 g/L to 140 g/L, or 100 g/L to 120 g/L. In some embodiments, the carbon source concentration is 120 g/L to 200 g/L, 140 g/L to 200 g/L, 160 g/L to 200 g/L, or 180 g/L to 200 g/L. In some embodiments, the carbon source concentration is 100 g/L to 120 g/L, 120 g/L to 140 g/L, 140 g/L to 160 g/L, 160 g/L to 180 g/L, or 180 g/L to 200 g/L. In some embodiments, the carbon source is a monosaccharide. In some embodiments, the carbon source is a disaccharide. In some embodiments, the carbon source is a starch. In some embodiments, the carbon source is cellulose.

In some embodiments, a bacterial strain is fermented under conditions for ILA production, where the fermentation medium comprises polysorbate 80. In some embodiments, the polysorbate 80 concentration in the fermentation medium is at least 0.1 g/L, at least 0.2 g/L, at least 0.4 g/L, at least 0.6 g/L, at least 0.8 g/L, or at least 1 g/L.

In some embodiments, a bacterial strain is fermented under conditions for ILA production, where the fermentation medium comprises manganese. In some embodiments, the manganese concentration in the fermentation medium is at least 0.01 mg/L, at least 0.02 mg/L, at least 0.04 mg/L, at least 0.06 mg/L, at least 0.08 mg/L, or at least 0.1 mg/L. In some embodiments, the manganese concentration in the fermentation medium is at least 0.01 g/L, at least 0.1 g/L, at least 1 g/L, or at least 10 g/L. In some embodiments, the manganese concentration in the fermentation medium is 0.001 g/L to 0.01 g/L, 0.01 g/L to 0.1 g/L, 0.1 g/L to 1 g/L, or 1 g/L to 10 g/L.

In some embodiments, a bacterial strain is fermented under conditions for ILA production, where the fermentation medium comprises vitamin B12. In some embodiments, the vitamin B12 concentration in the fermentation medium is at least 0.0001 mg/L, at least 0.0002 mg/L, at least 0.0004 mg/L, at least 0.0006 mg/L, at least 0.0008 mg/L, or at least 0.001 mg/L.

In some embodiments, a bacterial strain is fermented under conditions for IAld production, where the fermentation medium does not comprise polysorbate 80. In some embodiments, a bacterial strain is fermented under conditions for IAld production, where the fermentation medium does not comprise manganese. In some embodiments, a bacterial strain is fermented under conditions for IAld production, where the fermentation medium does not comprise vitamin B12.

In some embodiments, a bacterial strain is fermented under conditions for IAld production, where the fermentation medium comprises polysorbate 80. In some embodiments, the polysorbate 80 concentration in the fermentation medium is at least 0.1 g/L, at least 0.2 g/L, at least 0.4 g/L, at least 0.6 g/L, at least 0.8 g/L, or at least 1 g/L.

In some embodiments, a bacterial strain is fermented under conditions for IAld production, where the fermentation medium comprises manganese. In some embodiments, the manganese concentration in the fermentation medium is at least 0.01 mg/L, at least 0.02 mg/L, at least 0.04 mg/L, at least 0.06 mg/L, at least 0.08 mg/L, or at least 0.1 mg/L. In some embodiments, the manganese concentration in the fermentation medium is at least 0.01 g/L, at least 0.1 g/L, at least 1 g/L, or at least 10 g/L. In some embodiments, the manganese concentration in the fermentation medium is 0.001 g/L to 0.01 g/L, 0.01 g/L to 0.1 g/L, 0.1 g/L to 1 g/L, or 1 g/L to 10 g/L.

In some embodiments, a bacterial strain is fermented under conditions for IAld production, where the fermentation medium comprises vitamin B12. In some embodiments, the vitamin B12 concentration in the fermentation medium is at least 0.0001 mg/L, at least 0.0002 mg/L, at least 0.0004 mg/L, at least 0.0006 mg/L, at least 0.0008 mg/L, or at least 0.001 mg/L.

Bacterial strains may be fermented in fermentation media comprising one or more nitrogen sources. Examples of nitrogen sources include, without limitation, yeast extract, peptones, ammonium salts, nitrates, and amino acids.

In some embodiments, a bacterial strain is fermented under conditions for ILA production, where the fermentation medium comprises 10 g/L to 125 g/L of one or more nitrogen sources. In some embodiments, the fermentation medium comprises 10 g/L to 120 g/L, 10 g/L to 100 g/L, 10 g/L to 80 g/L, 10 g/L to 60 g/L, or 10 g/L to 40 g/L of one or more nitrogen sources. In some embodiments, the fermentation medium comprises 25 g/L to 125 g/L, 50 g/L to 125 g/L, 75 g/L to 125 g/L, or 100 g/L to 125 g/L of one or more nitrogen sources. In some embodiments, the fermentation medium comprises 10 g/L to 25 g/L, 25 g/L to 50 g/L, 50 g/L to 75 g/L, 75 g/L to 100 g/L, or 100 g/L to 125 g/L of one or more nitrogen sources. In some embodiments, nitrogen sources in the fermentation medium comprise yeast extract and peptones. In some embodiments, the fermentation medium does not comprise nitrogen sources other than yeast extract, peptones, or the combination of yeast extract and peptones.

In some embodiments, a bacterial strain is fermented under conditions for IAld production, where the fermentation medium comprises 125 g/L to 200 g/L of one or more nitrogen sources. In some embodiments, the fermentation medium comprises 125 g/L to 190 g/L, 125 g/L to 180 g/L, 125 g/L to 170 g/L, 125 g/L to 160 g/L, or 125 g/L to 150 g/L of one or more nitrogen sources. In some embodiments, the fermentation medium comprises 130 g/L to 200 g/L, 140 g/L to 200 g/L, 150 g/L to 200 g/L, 160 g/L to 200 g/L, or 170 g/L to 200 g/L of one or more nitrogen sources. In some embodiments, the fermentation medium comprises 125 g/L to 140 g/L, 140 g/L to 160 g/L, 160 g/L to 180 g/L, or 180 g/L to 200 g/L of one or more nitrogen sources. In some embodiments, nitrogen sources in the fermentation medium comprise yeast extract and peptones. In some embodiments, the fermentation medium does not comprise nitrogen sources other than yeast extract, peptones, or the combination of yeast extract and peptones.

In some embodiments, a bacterial fermentate mixture comprises a first fermentate and second fermentate, wherein:
(i) the first fermentate is produced by incubating a bacterial strain under microaerobic conditions in a first fermentation medium comprising 1 g/L to 50 g/L tryptophan, 4 g/L to 200 g/L glucose, and one or more of polysorbate 80, manganese, and vitamin B12, and the second fermentate is produced by incubating a bacterial strain under aerobic conditions in a second fermentation medium comprising 1 g/L to 50 g/L tryptophan, 4 g/L to 200 g/L glucose, and one or more of polysorbate 80, manganese, and vitamin B12; or
(ii) the first fermentate is produced by incubating a bacterial strain under aerobic conditions in a first fermentation medium comprising 1 g/L to 50 g/L tryptophan, 4 g/L to 200 g/L glucose, and one or more of polysorbate 80, manganese, and vitamin B12, and the second fermentate is produced by incubating a bacterial strain in a second fermentation medium comprising a second fermentation medium comprising 1 g/L to 50 g/L tryptophan, less than 4 g/L glucose, no detectable polysorbate 80, no detectable manganese, and no detectable vitamin B12.

In some embodiments, a bacterial strain is fermented under the following conditions (Condition A1):
a microaerobic environment;
1 g/L to 50 g/L tryptophan;
4 g/L to 200 g/L glucose; and
one or more of polysorbate 80, manganese, and vitamin B12.

In some embodiments, a bacterial strain is fermented under the following conditions (Condition B):
an aerobic environment;
1 g/L to 50 g/L tryptophan;
4 g/L to 200 g/L glucose; and one or more of polysorbate 80, manganese, and vitamin B12.

In some embodiments, a bacterial fermentate mixture comprises a first fermentate produced by fermentation under Condition A1 and a second fermentate produced by fermentation under Condition B.

In some embodiments, a bacterial strain is fermented under the following conditions (Condition A2):
an aerobic environment;
1 g/L to 50 g/L tryptophan;
4 g/L to 200 g/L glucose; and
one or more of polysorbate 80, manganese, and vitamin B12.

In some embodiments, a bacterial strain is fermented under the following conditions (Condition C):
an aerobic environment;
1 g/L to 50 g/L tryptophan;
less than 4 g/L glucose; and
no detectable polysorbate 80, no detectable manganese, and no detectable vitamin B12.

In some embodiments, a bacterial fermentate mixture comprises a first fermentate produced by fermentation under Condition A2 and a second fermentate produced by fermentation under Condition C.

In some embodiments, a bacterial fermentate mixture comprises a first fermentate and second fermentate, wherein (i) the first fermentate is produced by incubating a bacterial strain under microaerobic conditions in a first fermentation medium comprising 1 g/L to 50 g/L tryptophan, 100 g/L to 200 g/L glucose, the presence of manganese, and 10 g/L to 125 g/L of one or more nitrogen sources; and (ii) the second fermentate is produced by incubating a bacterial strain under aerobic conditions in a second fermentation medium comprising 1 g/L to 50 g/L tryptophan, 1 g/L to 100 g/L glucose, the presence of manganese, and 125 g/L to 200 g/L of one or more nitrogen sources.

In some embodiments, a bacterial strain is fermented under the following conditions (Condition D):
a microaerobic environment;
1 g/L to 50 g/L tryptophan;
100 g/L to 200 g/L glucose;
the presence of manganese; and
10 g/L to 125 g/L of one or more nitrogen sources.

In some embodiments, a bacterial strain is fermented under the following conditions (Condition E):
an aerobic environment;
1 g/L to 50 g/L tryptophan;
1 g/L to 100 g/L glucose;
the presence of manganese; and
125 g/L to 200 g/L of one or more nitrogen sources.

In some embodiments, a bacterial fermentate mixture comprises a first fermentate produced by fermentation under Condition D and a second fermentate produced by fermentation under Condition E.

In some embodiments, a bacterial strain is fermented for at least 1, at least 2, at least 3, at least 4, at least 5, at least 6, at least 7, at least 8, at least 9, at least 10, at least 11, at least 12, at least 13, at least 14, at least 15, at least 16, at least 17, at least 18, at least 19, at least 20, or at least 21 days. In some embodiments, a bacterial strain is fermented for up to 1, up to 2, up to 3, up to 4, up to 5, up to 6, up to 7, up to 8, up to 9, up to 10, up to 11, up to 12, up to 13, up to 14, up to 15, up to 16, up to 17, up to 18, up to 19, up to 20, or up to 21 days. In some embodiments, a bacterial strain is fermented for 1-21, 1-20, 10-17, 1-14, 1-11, 1-10, 1-7, 1-6, 1-5, 1-4, 1-3, or 1-2 days. In some embodiments, a bacterial strain is fermented for 2-21, 2-20, 10-17, 2-14, 2-11, 2-10, 2-7, 2-6, 2-5, 2-4, or 2-3 days. In some embodiments, a bacterial strain is fermented for 1-7, 2-7, 3-7, 4-7, 5-7, or 6-7 days.

In some embodiments, a bacterial strain is fermented under aerobic conditions. An environment having "aerobic conditions" contains oxygen at a concentration similar to that of Earth's atmosphere (i.e., air is 21% 02). In some embodiments, the bacterial strain is fermented in an environment having an oxygen concentration of 17% to 25%, 18% to 24%, 19% to 23%, or 20% to 22%. In some embodiments, the oxygen concentration is at least 20%.

In some embodiments, a bacterial strain is fermented under microaerobic conditions. An environment having "microaerobic conditions" contains limited amounts of oxygen, at a concentration lower than that of Earth's atmosphere (e.g., air is 1-2% 02). In some embodiments, the bacterial strain is fermented in an environment having an oxygen concentration of 0.5% to 5%, 1.0% to 4%, or 1.5% to 3%. In some embodiments, the oxygen concentration is about 0.5%, about 1.0%, about 1.5%, or about 2.0%. In some embodiments, the oxygen concentration is 1.0% to 2.0%.

The amount of dissolved oxygen in a fermentation medium may be modulated by introducing air directly into the fermentation medium, such as by air sparging. In some embodiments, aerobic conditions are achieved by air sparging during fermentation. In some embodiments, microaerobic conditions are achieved by fermentation without air sparging. Air sparging in a fermentation bioreactor involves introducing pressurized air or oxygen through diffusers or spargers directly into the liquid medium to enhance oxygen distribution throughout the culture.

In some embodiments, the first and/or second fermentates are concentrated before being combined to form a fermentate mixture. Concentrating a fermentate refers to the removal of water from the fermentate, thereby increasing the concentration of fermentation products, such as ILA and IAld, that are present in the fermentate. A fermentate may be concentrated to reduce water content without reducing water content to the same extent as a drying process. As one example, a fermentation medium may be subjected to circulating air or reduced atmospheric pressure to facilitate evaporation.

In some embodiments, the first and/or second fermentates are dried before being combined to form a fermentate mixture. Any suitable drying method may be used to dry fermentates, including lyophilization, spray-drying, and vacuum drying. In some embodiments, one or more fermentates is dried by a process that does not raise the fermentate temperature above 100° C., above 90° C., above 80° C. above 70° C., above 60° C., or above 50° C.

Methods of Use

Some aspects relate to administration of a composition (and/or nutritional supplement and/or food product comprising the same) to a subject in need thereof. Administration may be accomplished through any suitable method, such as one described herein or known in the art, and may include, for example, consumption of the composition (and/or nutritional supplement and/or food product) by the subject or topical application of the composition onto the subject. Administration may be for the treatment or prevention of a condition or one or more symptoms of the condition. "Treating" a condition refers to reducing the frequency, duration, and/or severity of one or more symptoms of the condition. "Preventing" a condition encompasses prophylactic administration and refers to reducing the likelihood of developing the condition or one or more of its symptoms.

Some aspects relate to methods of treating or preventing skin inflammation, skin irritation, and/or skin damage in a subject in need thereof. Non-limiting examples of skin inflammation symptoms include redness, swelling, itchiness, warmth, heat, discomfort, and pain. In some embodiments, the duration of one or more symptoms is reduced. In some embodiments, the frequency of one or more symptoms is reduced. In some embodiments, the severity of one or more symptoms is reduced. In some embodiments, the symptom is a symptom of skin inflammation. In some embodiments, the symptom is a symptom of skin irritation. In some embodiments, the symptom is a symptom of photodamage. In some embodiments, the symptom is a symptom of UV damage.

Some aspects relate to treating or preventing gut inflammation or gastrointestinal distress in a subject in need thereof. Non-limiting examples of symptoms of gastrointestinal distress include bloating, constipation, diarrhea, heartburn, nausea, reflux, stomach pain and cramping, and vomiting. In some embodiments, the duration of one or more symptoms is reduced. In some embodiments, the frequency of one or more symptoms is reduced. In some embodiments, the severity of one or more symptoms is reduced.

Some aspects relate to treating or preventing neuroinflammation in a subject in need thereof. In some embodiments, the duration of one or more symptoms is reduced. In some embodiments, the frequency of one or more symptoms is reduced. In some embodiments, the severity of one or more symptoms is reduced. In some embodiments, mobility of the subject is improved. In some embodiments, cognition of the subject is improved.

Some aspects relate to methods of treating or preventing weight-related inflammation in a subject in need thereof. In some embodiments, the duration of one or more symptoms is reduced. In some embodiments, the frequency of one or more symptoms is reduced. In some embodiments, the severity of one or more symptoms is reduced.

Some aspects relate to methods of limiting weight gain in a subject in need thereof. In some embodiments, the rate of weight gain is reduced.

Some aspects relate to methods of promoting weight loss in a subject in need thereof. In some embodiments, the composition, nutritional supplement, and/or food product the rate of weight loss is increased.

Some aspects relate to methods of treating or preventing overweight status or obesity in a subject in need thereof. In some embodiments, the duration of one or more symptoms is reduced. In some embodiments, the frequency of one or more symptoms is reduced. In some embodiments, the severity of one or more symptoms is reduced.

Some aspects relate to methods of treating or preventing anxiety in a subject. Non-limiting examples of anxiety symptoms include excessive barking, pacing, trembling, aggressive behavior, destructive behavior, or withdrawal. In some embodiments, the duration of one or more symptoms is reduced. In some embodiments, the frequency of one or more symptoms is reduced. In some embodiments, the severity of one or more symptoms is reduced.

Some aspects relate to methods of treating or preventing a seasonal allergy in a subject in need thereof. In some embodiments, the duration of one or more symptoms is reduced. In some embodiments, the frequency of one or more symptoms is reduced. In some embodiments, the severity of one or more symptoms is reduced.

Some aspects relate to methods of treating or preventing a food allergy in a subject in need thereof. In some embodiments, the duration of one or more symptoms is reduced. In some embodiments, the frequency of one or more symptoms is reduced. In some embodiments, the severity of one or more symptoms is reduced.

Some aspects relate to methods of treating or preventing gum inflammation in a subject in need thereof. Non-limiting examples of symptoms of gum inflammation include gum redness, swelling, pain, and bleeding. In some embodiments, the duration of one or more symptoms is reduced. In some embodiments, the frequency of one or more symptoms is reduced. In some embodiments, the severity of one or more symptoms is reduced.

In some embodiments, administration is oral. Oral administration may refer to manual administration, such as oral gavage or spraying (e.g., via aerosol). Oral administration may also refer to feeding, such as providing the composition or nutritional supplement to a subject (e.g., a companion animal), which ingests it by eating or drinking. Methods may include a single administration or administration may be repeated. Repeat administrations may be conducted at regular intervals (e.g., daily or weekly). For example, a subject may be administered a composition or supplement one or more times daily, over a specified time period, such as a week, several weeks, a month, or several months. Alternatively, multiple instances of administration may be conducted on an as-needed basis.

In some embodiments, administration is rectal. In some embodiments, a composition is in the form of a suppository when administered rectally. In some embodiments, a composition, supplement, or food product is delivered to the intestine. In some embodiments, a composition, supplement, or food product is delivered to the colon. Such delivery to the intestine or colon may be accomplished by oral or rectal administration.

In some embodiments, administration is topical. Topical administration refers to application of a composition to a particular body surface, such as the skin or mucus membranes. Forms of compositions suitable for topical administration include, without limitation, ointments, gels, creams, foams, emulsions, lotions, pastes, powders, tinctures, drops, rinses, sprays, and transdermal patches. These and other delivery vehicles for topical administration of compositions are known in the art. See, e.g., Mayba and Gooderham, *J Cutan Med Surg*. 2018. 22(2):207-212. In some embodiments, a composition is applied to the skin by topical administration.

In some embodiments, a composition comprising fermentate(s) is present in a topical administration formulation (i.e., a composition in a form for topical application) at an incorporation rate of 0.001% to 10% w/w. As used in this paragraph, an "incorporation rate" refers to the mass of the fermentate-containing composition as a percentage of the total weight of the topical administration formulation. For example, 10 mg of a fermentate-containing composition in a 50 g topical administration formulation is present at an incorporation rate of 0.2% w/w. In some embodiments, the incorporation rate is 0.001% to 10% w/w. In some embodiments, the incorporation rate is 0.001% to 5% w/w. In some embodiments, the incorporation rate is 0.001% to 1% w/w. In some embodiments, the incorporation rate is 0.001% to 0.1% w/w. In some embodiments, the incorporation rate is 0.001% to 0.01% w/w. In some embodiments, the incorporation rate is 0.002% to 10%, 0.003% to 10%, 0.004% to 10%, 0.005% to 10%, 0.006% to 10%, 0.007% to 10%, 0.008% to 10%, 0.009% to 10%, 0.01% to 10%, 0.1% to 10%, or 1% to 10% w/w. In some embodiments, the incorporation rate is 0.001% to 0.003%, 0.003% to 0.01%, 0.01% to 0.03%, 0.03% to 0.1%, 0.1% to 0.3%, 0.3% to 1%, 1% to 3%, or 3% to 10% w/w.

In some embodiments, a composition, nutritional supplement, or food product is administered in an effective amount for treating, preventing, or alleviating one or more symptoms in a subject. An "effective amount" or "effective dosage" refers to an amount or dosage, respectively, sufficient to treat, alleviate, or prevent a sign or symptom in a subject. The actual effective amount or dosage will depend on the individual subject and their health. Such effective amounts or dosages may be determined by routine assays known to those of skill in the art.

Subjects to which a composition, nutritional supplement, or food product may be administered include any animal known in the art. In some embodiments, the subject is a human. In some embodiments, the animal is a domesticated animal. In some embodiments, the animal is a carnivore. In some embodiments, the animal is a rodent. In some embodiments, the rodent is a mouse, rat, guinea pig, chinchilla, or hamster. In some embodiments, the animal is a dog, cat, rabbit, guinea pig, hamster, or ferret. In some embodiments, the animal is a dog. In some embodiments, the animal is a cat. In some embodiments, the animal is a bovine, swine, llama, alpaca, sheep, or goat. In some embodiments, the animal is a bird.

Some aspects relate to methods of treating, preventing, or reducing the extent of inflammation in a subject in need thereof. In some embodiments, the composition, nutritional supplement and/or food product is effective in reducing one or more symptoms, such as inflammation, diarrhea, vomiting, itching, and allergy. In some embodiments, the composition, nutritional supplement and/or food product reduces inflammation in the subject. In some embodiments, the composition, nutritional supplement and/or food product treats or prevents diarrhea in the subject. In some embodiments, the composition, nutritional supplement and/or food product treats or prevents vomiting in the subject. In some embodiments, the composition, nutritional supplement, and/or food product treats or prevents itching in the subject. In some embodiments, the composition, nutritional supplement, and/or food product treats or prevents allergy in the subject.

In some embodiments, the composition, nutritional supplement, and/or food product reduces inflammation in the subject. In some embodiments, the composition, nutritional supplement, and/or food product treats or prevents one or more symptoms associated with inflammation. Methods of measuring inflammation are known in the art, and include, without limitation, measuring the concentration of one or more cytokines (e.g., TNF-α, IL-1β, IL-6, IL-10, and IL-12) in the subject, such as in a sample obtained from the subject (e.g., a blood sample, serum sample, plasma sample). In some embodiments, the composition, nutritional supplement, and/or food product reduces infiltration of leukocytes (e.g., neutrophils and/or monocytes) into oral mucosa, gut mucosa, or dermis.

In some embodiments, administration results in a decrease in the serum concentration of one or more inflammatory cytokines by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the serum concentration of the same subject prior to administering the composition. In some embodiments, administration results in a decrease in the serum concentration of one or more inflammatory cytokines by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the serum concentration in a subject (e.g., a reference subject) who did not receive the composition.

In some embodiments, administration results in a decrease in the duration of inflammation by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration of inflammation in the same subject prior to administering the composition. In some embodiments, administration results in a decrease in duration of inflammation by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to duration of inflammation in a subject (e.g., a reference subject) who did not receive the composition.

In some embodiments, administration results in a decrease in the frequency of diarrhea by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of diarrhea in the same subject prior to administering the composition. In some embodiments, administration results in a decrease in the frequency of diarrhea by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of diarrhea in a subject (e.g., a reference subject) who did not receive the composition.

In some embodiments, administration results in a decrease in the duration over which diarrhea occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which diarrhea occurs in the same subject prior to administering the composition. In some embodiments, administration results in a decrease in the duration over which diarrhea occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which diarrhea occurs in a subject (e.g., a reference subject) who did not receive the composition.

In some embodiments, administration results in a decrease in the frequency of vomiting by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of vomiting in the same subject prior to administering the composition. In some embodiments, administration results in a decrease in the frequency of vomiting by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of vomiting in a subject (e.g., a reference subject) who did not receive the composition.

In some embodiments, administration results in a decrease in the duration over which vomiting occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which vomiting occurs in the same subject prior to administering the composition. In some embodiments, administration results in a decrease in the duration over which vomiting occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which vomiting occurs in a subject (e.g., a reference subject) who did not receive the composition.

In some embodiments, administration results in a decrease in the frequency of itching by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of itching in the same subject prior to administering the composition. In some embodiments, administration results in a decrease in the frequency of itching by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of itching in a subject (e.g., a reference subject) who did not receive the composition.

In some embodiments, administration results in a decrease in the duration over which itching occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which itching occurs in the same subject prior to administering the composition. In some embodiments, administration results in a decrease in the duration over which itching occurs by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration over which itching occurs in a subject (e.g., a reference subject) who did not receive the composition.

In some embodiments, administration results in a decrease in the frequency of allergy symptoms by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of allergy symptoms in the same subject prior to administering the composition. In some embodiments, administration results in a decrease in the frequency of allergy symptoms by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the frequency of allergy symptoms in a subject (e.g., a reference subject) who did not receive the composition.

In some embodiments, administration results in a decrease in the duration of allergy symptoms by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration of allergy symptoms in the same subject prior to administering the composition. In some embodiments, administration results in a decrease in the duration of allergy symptoms by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100%, as compared to the duration of allergy symptoms in a subject (e.g., a reference subject) who did not receive the composition.

Reduction of Inflammation and/or Symptoms Thereof

Fermentates of bacterial strains for use in the compositions described herein were identified based on the ability to produce indole-containing compounds that interact with aryl hydrocarbon receptors (AhRs), such as the canine AhR. Without wishing to be bound by theory, the presence of such fermentates is believed to be useful for improving homeostasis (e.g., by modulating inflammation and/or improving tissue barrier integrity).

In some embodiments, a composition, nutritional supplement, and/or food product reduces inflammation in the subject. In some embodiments, a composition, nutritional supplement, and/or food product treats or prevents a symptom of inflammation in the subject. In some embodiments, a composition, nutritional supplement, and/or food product treats or prevents diarrhea in the subject. In some embodiments, a composition, nutritional supplement, and/or food product treats or prevents vomiting in the subject. In some embodiments, a composition, nutritional supplement, and/or food product treats or prevents itching in the subject. In some embodiments, a composition, nutritional supplement, and/or food product treats or prevents a symptom of allergy in the subject.

In some embodiments, a composition, nutritional supplement, and/or food product treats or prevents a symptom of skin inflammation in the subject. In some embodiments, a composition, nutritional supplement, and/or food product treats or prevents a symptom of skin irritation in the subject. In some embodiments, a composition, nutritional supplement, and/or food product treats or prevents a symptom of skin photodamage in the subject.

In some embodiments, a composition, nutritional supplement, and/or food product treats or prevents a symptom of gut inflammation in the subject. In some embodiments, a composition, nutritional supplement, and/or food product treats or prevents a symptom of gastrointestinal distress in the subject.

In some embodiments, a composition, nutritional supplement, and/or food product treats or prevents a symptom of neuroinflammation in the subject. In some embodiments, a composition, nutritional supplement, and/or food product improves mobility in the subject. In some embodiments, a composition, nutritional supplement, and/or food product improves cognition in the subject.

In some embodiments, a composition, nutritional supplement, and/or food product treats or prevents a symptom of weight-related inflammation in the subject. In some embodiments, a composition, nutritional supplement, and/or food product reduces the rate of weight gain in the subject. In some embodiments, a composition, nutritional supplement, and/or food product increases the rate of weight loss in the subject. In some embodiments, a composition, nutritional supplement, and/or food product treats or prevents a symptom of overweight or obese status in the subject.

In some embodiments, a composition, nutritional supplement, and/or food product treats or prevents a symptom of anxiety in the subject.

In some embodiments, a composition, nutritional supplement, and/or food product treats or prevents a symptom of seasonal allergy in the subject.

In some embodiments, a composition, nutritional supplement, and/or food product treats or prevents a symptom of food allergy in the subject.

In some embodiments, a composition, nutritional supplement, and/or food product treats or prevents a symptom of gum inflammation in the subject.

In some embodiments, a composition, nutritional supplement, and/or food product reduces the serum concentration of one or more inflammatory cytokines in the subject. In some embodiments, the serum cytokine concentration is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the serum cytokine concentration in the same subject prior to prior to exposure to the composition or fermentate(s). In some embodiments, the serum cytokine concentration is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the serum cytokine concentration in the same subject prior to exposure to the composition or fermentate(s).

In some embodiments, a composition, nutritional supplement, and/or food product reduces the duration of inflammation in the subject. In some embodiments, the duration of inflammation is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the duration of inflammation in the same subject prior to exposure to the composition or fermentate(s). In some embodiments, the duration of inflammation is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the duration of inflammation in the same subject prior to exposure to the composition or fermentate(s).

In some embodiments, a composition, nutritional supplement, and/or food product reduces the frequency of one or more symptoms of inflammation in the subject. In some embodiments, the inflammation symptom frequency is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the inflammation symptom frequency in the same subject prior to exposure to the composition or fermentate(s). In some embodiments, the inflammation symptom frequency is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the inflammation symptom frequency in the same subject prior to exposure to the composition or fermentate(s).

In some embodiments, a composition, nutritional supplement, and/or food product reduces the duration of one or more symptoms of inflammation in the subject. In some embodiments, the inflammation symptom duration is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the inflammation symptom duration in the same subject prior to exposure to the composition or fermentate(s). In some embodiments, the inflammation symptom duration is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the inflammation symptom duration in the same subject prior to exposure to the composition or fermentate(s).

In some embodiments, a composition, nutritional supplement, and/or food product reduces the frequency of diarrhea in the subject. In some embodiments, the frequency of diarrhea is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the frequency of diarrhea in the subject prior to exposure to the composition or fermentate(s). In some embodiments, the frequency of diarrhea is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the frequency of diarrhea in the same subject prior to exposure to the composition or fermentate(s).

In some embodiments, a composition, nutritional supplement, and/or food product reduces the duration over which diarrhea occurs in the subject. In some embodiments, the duration over which diarrhea occurs is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the duration over which diarrhea occurs in the same subject prior to exposure to the composition or fermentate(s).

In some embodiments, the duration over which diarrhea occurs is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the duration over which diarrhea occurs in the same subject prior to exposure to the composition or fermentate(s).

In some embodiments, a composition, nutritional supplement, and/or food product reduces the frequency of vomiting in the subject. In some embodiments, the frequency of vomiting is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the frequency of vomiting in the same subject prior to exposure to the composition or fermentate(s). In some embodiments, the frequency of vomiting is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the frequency of vomiting in the same subject prior to exposure to the composition or fermentate(s).

In some embodiments, a composition, nutritional supplement, and/or food product reduces the duration over which vomiting occurs in the subject. In some embodiments, the duration over which vomiting occurs is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the duration over which vomiting occurs in the same subject prior to exposure to the composition or fermentate(s). In some embodiments, the duration over which vomiting occurs is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the duration over which vomiting occurs in the same subject prior to exposure to the composition or fermentate(s).

In some embodiments, a composition, nutritional supplement, and/or food product reduces the frequency of itching in the subject. In some embodiments, the frequency of itching is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the frequency of itching in the same subject prior to exposure to the composition or fermentate(s). In some embodiments, the frequency of itching is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the frequency of itching in the same subject prior to exposure to the composition or fermentate(s).

In some embodiments, a composition, nutritional supplement, and/or food product reduces the duration over which itching occurs in the subject. In some embodiments, the duration over which itching occurs is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to the duration over which itching occurs in the same subject prior to exposure to the composition or fermentate(s). In some embodiments, the duration over which itching occurs is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to the duration over which itching occurs prior to prior to exposure to the composition or fermentate(s).

In some embodiments, a composition, nutritional supplement, and/or food product reduces the frequency of one or more symptoms of allergy in the subject. In some embodiments, the allergy symptom frequency is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to allergy symptom frequency in the same subject prior to exposure to the composition or fermentate(s). In some embodiments, allergy symptom frequency is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to allergy symptom frequency in the same subject prior to exposure to the composition or fermentate(s).

In some embodiments, a composition, nutritional supplement, and/or food product reduces the duration of one or more symptoms of allergy in the subject. In some embodiments, the allergy symptom duration is reduced by at least 1.1-fold, 1.2-fold, 1.3-fold, 1.4-fold, 1.5-fold, 2-fold, 3-fold, 4-fold, 5-fold, 6-fold, 7-fold, 8-fold, 9-fold, 10-fold, 20-fold, 30-fold, 40-fold, 50-fold, 100-fold, 1000-fold, $10^4$-fold, $10^5$-fold or more as compared to allergy symptom duration in the same subject prior to exposure to the composition or fermentate(s). In some embodiments, allergy symptom duration is reduced by at least 5%, 6%, 7%, 8%, 9%, 10%, 11%, 12%, 13%, 14%, 15%, 16%, 17%, 18%, 19%, 20%, 21%, 22%, 23%, 24%, 25%, 26%, 27%, 28%, 29%, 30%, 35%, 40%, 45%, 50%, 55%, 60%, 65%, 70%, 75%, 80%, 85%, 90%, 95%, or 100% or more as compared to allergy symptom duration in the same subject prior to exposure to the composition or fermentate(s).

ENUMERATED EMBODIMENTS

1. A postbiotic composition comprising a first fermentate and a second fermentate of a bacterial strain,
    the bacterial strain comprising a 16S rDNA sequence with at least 97% sequence identity to the nucleotide sequence of SEQ ID NO: 1 (*Pediococcus acidilactici*) or SEQ ID NO: 7 (*Lactiplantibacillus plantarum*), and
    wherein the first fermentate comprises indole-3-lactic acid (ILA) and the second fermentate comprises indole-3-carboxaldehyde (IAld).

2. The postbiotic composition of Embodiment 1, wherein the bacterial strain comprises a 16S rDNA sequence with at least 99% sequence identity to SEQ ID NO: 1.

3. The postbiotic composition of Embodiment 1 or 2, wherein the bacterial strain belongs to the species *Pediococcus acidilactici*.

4. The postbiotic composition of any one of Embodiments 1-3, wherein the bacterial strain comprises a genome with at least 95.0% average nucleotide identity (ANI) and an alignment fraction (AF) of at least 20.0% to the reference genome of SEQ ID NO: 8.

5. The postbiotic composition of any one of Embodiments 1-4, wherein the bacterial strain comprises a genome with at least 95.0% average nucleotide identity (ANI) and an alignment fraction (AF) of at least 50.0% to the reference genome of SEQ ID NO: 8.

6. The postbiotic composition of any one of Embodiments 1-5, wherein the first fermentate is produced by incubating the bacterial strain under microaerobic conditions in a fermentation medium comprising:
    1 g/L to 50 g/L tryptophan;
    100 g/L to 200 g/L glucose;
    manganese; and
    10 g/L to 125 g/L of one or more nitrogen sources.

7. The postbiotic composition of any one of Embodiments 1-6, wherein the second fermentate is produced by incubating the bacterial strain under aerobic conditions in a fermentation medium comprising:

1 g/L to 50 g/L tryptophan;
1 g/L to 100 g/L glucose;
manganese; and
125 g/L to 200 g/L of one or more nitrogen sources.

8. The postbiotic composition of Embodiment 6 or 7, wherein the one or more nitrogen sources comprise yeast extract or peptones.

9. The postbiotic composition of any one of Embodiments 1-5, wherein:
the first fermentate is produced by incubating the bacterial strain under microaerobic conditions in a fermentation medium comprising 1 g/L to 50 g/L tryptophan, 4 g/L to 200 g/L glucose, and one or more of polysorbate 80, manganese, and vitamin B12; and
the second fermentate is produced by incubating the bacterial strain under aerobic conditions in a fermentation medium comprising 1 g/L to 50 g/L tryptophan, 4 g/L to 200 g/L glucose; and one or more of polysorbate 80, manganese, and vitamin B12.

10. The postbiotic composition of any one of Embodiments 1-5, wherein:
the first fermentate is produced by incubating the bacterial strain under aerobic conditions in a fermentation medium comprising 1 g/L to 50 g/L tryptophan, 4 g/L to 200 g/L glucose, and one or more of polysorbate 80, manganese, and vitamin B12; and
the second fermentate is produced by incubating the bacterial strain under aerobic conditions in a fermentation medium comprising 1 g/L to 50 g/L tryptophan, less than 4 g/L glucose, no detectable polysorbate 80, no detectable manganese, and no detectable vitamin B12.

11. The postbiotic composition of any one of Embodiments 1-10, wherein the second fermentate comprises more IAld than the first fermentate.

12. The postbiotic composition of any one of Embodiments 1-11, wherein the first fermentate comprises more ILA than the second fermentate.

13. The postbiotic composition of any one of Embodiments 1-5, wherein the first fermentate is produced by incubating the bacterial strain under aerobic or microaerobic conditions in a fermentation medium comprising:
1 g/L to 12 g/L tryptophan;
4 g/L to 15 g/L glucose; and
one or more of polysorbate 80, manganese, and vitamin B12.

14. The postbiotic composition of any one of Embodiments 1-5 or 13, wherein the second fermentate is produced by incubating the bacterial strain under the following conditions:
1 g/L to 12 g/L tryptophan;
less than 4 g/L glucose; and
no detectable polysorbate 80, no detectable manganese, and no detectable vitamin B12.

15. The postbiotic composition of any one of Embodiments 1-14, wherein a bacterial strain belonging to the species *Clostridium sporogenes* produces indole-3-propionic acid (IPA) in the presence of the postbiotic composition.

16. The postbiotic composition of any one of Embodiments 1-15, wherein the first fermentate comprises ILA at a higher amount than IAld.

17. The postbiotic composition of any one of Embodiments 1-16, wherein the second fermentate comprises IAld at a higher amount than ILA.

18. A postbiotic composition comprising two or more fermentates of one or more bacterial strains, wherein a first fermentate comprises indole-3-lactic acid (ILA), and a second fermentate comprises indole-3-carboxaldehyde (IAld).

19. The postbiotic composition of any one of Embodiments 1-18, further comprising indole-3-pyruvic acid (IPyA), indole-3-propionic acid (IPA), 3-indoleacrylic acid (IA), and/or indole-3-acetic acid (IAA).

20. The postbiotic composition of any one of Embodiments 1-19, wherein the first fermentate and/or the second fermentate further comprises indole-3-pyruvic acid (IPyA) and/or indole-3-propionic acid (IPA).

21. The postbiotic composition of any one of Embodiments 1-20, wherein the postbiotic composition does not comprise indole-3-acetic acid (IAA)

22. The postbiotic composition of any one of Embodiments 1-21, wherein the postbiotic composition further comprises one or more additional fermentates of one or more additional bacterial strains selected from the group consisting of *Bacillus licheniformis, Bacillus pumilus, Bacillus subtilis, Bacillus velezensis, Weizmannia coagulans*, and *Lactiplantibacillus plantarum*.

23. The postbiotic composition of Embodiment 22, wherein the one or more additional fermentates comprise ILA.

24. The postbiotic composition of Embodiment 22 or 23, wherein the one or more additional fermentates comprise IAld.

25. The postbiotic composition of any one of Embodiments 22-24, wherein the one or more additional fermentates comprise IPyA and/or IPA.

26. The postbiotic composition of any one of Embodiments 1-25, wherein the postbiotic composition comprises at least 0.1% (w/w) ILA.

27. The postbiotic composition of any one of Embodiments 1-26, wherein the postbiotic composition comprises at least 0.015% (w/w) IAld.

28. The postbiotic composition of any one of Embodiments 1-27, wherein the postbiotic composition further comprises IPyA and/or IPA.

29. The postbiotic composition of any one of Embodiments 1-28, wherein the postbiotic composition comprises at least 10% w/w IPyA relative to ILA.

30. The postbiotic composition of any one of Embodiments 1-29, wherein the postbiotic composition comprises at least 1% w/w IPA relative to IAld.

31. The postbiotic composition of any one of Embodiments 1-30, wherein the postbiotic composition comprises at least 10% w/w IAA relative to ILA.

32. The postbiotic composition of any one of Embodiments 1-31, wherein the postbiotic composition comprises less than 200% w/w tryptophan relative to ILA.

33. The postbiotic composition of any one of Embodiments 1-32, wherein the postbiotic composition does not comprise indoxyl sulfate.

34. The postbiotic composition of any one of Embodiments 1-33, wherein the postbiotic composition comprises less than 10% w/w IAA relative to ILA.

35. The postbiotic composition of any one of Embodiments 1-34, wherein the postbiotic composition comprises less than 0.5% w/w tryptamine relative to ILA.

36. The postbiotic composition of any one of Embodiments 1-35, wherein the postbiotic composition comprises less than 0.5% w/w indole-3-acetamide relative to ILA.

37. The postbiotic composition of any one of Embodiments 1-36, wherein each of the fermentates are in powdered form.

38. The postbiotic composition of any one of Embodiments 1-37, wherein each of the fermentates are lyophilized or spray-dried.

39. The postbiotic composition of any one of Embodiments 1-38, wherein each of the fermentates are present in an amount of 0.1 to 1000 mg.

40. The postbiotic composition of any one of Embodiments 1-39, wherein the postbiotic composition comprises a total amount of fermentates of 0.2 to 2000 mg.

41. The postbiotic composition of any one of Embodiments 1-40, wherein the postbiotic composition further comprises an excipient.

42. The postbiotic composition of Embodiment 41, wherein the excipient is a tapioca-based maltodextrin.

43. The postbiotic composition of any one of Embodiments 1-42, wherein the postbiotic composition is in a form for topical administration.

44. The postbiotic composition of any one of Embodiments 1-42, wherein the postbiotic composition is in a form for oral administration.

45. The postbiotic composition of any one of Embodiments 1-42, wherein the postbiotic composition is in the form of a dry flowable powder.

46. The postbiotic composition of any one of Embodiments 1-45, wherein the postbiotic composition reduces inflammation in a subject.

47. The postbiotic composition of any one of Embodiments 1-46, wherein the postbiotic composition treats or prevents a symptom of inflammation in a subject.

48. The postbiotic composition of any one of Embodiments 1-47, wherein the postbiotic composition treats or prevents diarrhea in a subject.

49. The postbiotic composition of any one of Embodiments 1-48, wherein the postbiotic composition treats or prevents vomiting in a subject.

50. The postbiotic composition of any one of Embodiments 1-49, wherein the postbiotic composition treats or prevents itching in a subject.

51. The postbiotic composition of any one of Embodiments 1-50, wherein the postbiotic composition treats or prevents a symptom of allergy in a subject.

52. The postbiotic composition of any one of Embodiments 46-51, wherein the subject is a carnivore.

53. The postbiotic composition of any one of Embodiments 46-52, wherein the subject is a mammal.

54. The postbiotic composition of any one of Embodiments 46-53, wherein the subject is a domesticated animal.

55. The postbiotic composition of any one of Embodiments 46-54, wherein the subject is a dog, cat, rabbit, guinea pig, hamster, or ferret.

56. The postbiotic composition of any one of Embodiments 46-55, wherein the subject is a dog.

57. A topical preparation comprising the postbiotic composition of any one of Embodiments 1-56.

58. The topical preparation of Embodiment 57, wherein the topical preparations is a shampoo (liquid cleansing preparations), a cream (semi-solid, water-based emulsions), an ointment (thicker, greasier preparations usually with an oil base), a spray (liquid preparations in aerosol or pump form), a spot-on solution (liquid preparations specifically designed for application to a single area), a lotion (thinner liquid preparations compared to creams), a gel (semi-solid, typically clear preparations), a foam (aerated preparations that come out as mousse), a balm (waxy, protective preparations), or a powder (dry preparations for dusting).

59. The topical preparation of Embodiment 57 or 58, wherein the bacterial fermentate mixture is present in the topical preparation at an incorporation rate of 0.01% to 10%.

60. A nutritional supplement or food product comprising the postbiotic composition of any one of Embodiments 1-56.

61. The nutritional supplement or food product of Embodiment 60, wherein the nutritional supplement or food product comprises a meat or animal-derived material.

62. The nutritional supplement of Embodiment 60 or 61, wherein the meat or animal-derived material is beef, chicken, eggs, turkey, lamb, fish, blood marrow, and/or bone marrow.

63. The nutritional supplement or food product of any one of Embodiments 60-62, wherein the nutritional supplement or food product comprises a grain.

64. The nutritional supplement or food product of Embodiment 63, wherein the grain is wheat, corn, rice, oats, and/or barley.

65. The nutritional supplement or food product of any one of Embodiments 60-64, wherein the nutritional supplement or food product comprises a fiber.

66. The nutritional supplement or food product of Embodiment 65, wherein the fiber is sugar beet pulp, chicory pulp, chicory, coconut endosperm fiber, wheat fiber, fructooligosaccharides, galactooligosaccharides, and/or inulin.

67. The nutritional supplement or food product of any one of Embodiments 60-66, wherein the nutritional supplement or food product comprises an algae.

68. The nutritional supplement or food product of Embodiment 67, wherein the algae is *Ascophyllum nodosum, Spirulina,* and/or *Fucus vesiculosus.*

69. The nutritional supplement or food product of any one of Embodiments 60-68, wherein the nutritional supplement or food product comprises a gelatinized starch matrix.

70. A method comprising administering the postbiotic composition of any one of Embodiments 1-56, or the nutritional supplement or food product of any one of Embodiments 60-69, to a subject in need thereof.

71. The method of Embodiment 70, wherein the administration is oral administration.

72. The method of Embodiment 70, wherein the administration is topical administration.

73. The method of any one of Embodiments 70-72, wherein the administering:
   (i) reduces inflammation in the subject;
   (ii) treats or prevents a symptom of inflammation in the subject;
   (iii) treats or prevents diarrhea in the subject;
   (iv) treats or prevents vomiting in the subject;
   (v) treats or prevents itching in the subject; and/or
   (vi) treats or prevents a symptom of allergy in the subject.

74. The method of any one of Embodiments 70-73, wherein the administering:
   (i) treats or prevents skin inflammation, skin irritation, and/or skin damage in the subject;
   (ii) treats or prevents gut inflammation or gastrointestinal distress in the subject;
   (iii) treats or prevents neuroinflammation in the subject;
   (iv) treats or prevents weight-related inflammation in the subject;
   (v) limits weight gain in the subject;
   (vi) promotes weight loss in the subject;
   (vii) treats or prevents overweight status or obesity in the subject;
   (viii) treats or prevents anxiety in the subject;
   (ix) treats or prevents seasonal allergy in the subject;

(x) treats or prevents food allergy in the subject; and/or
(xi) improves coat quality in the subject.

75. The method of any one of Embodiments 70-74, wherein the subject is a carnivore.

76. The method of any one of Embodiments 70-75, wherein the subject is a mammal.

77. The method of any one of Embodiments 70-76, wherein the subject is a domesticated animal.

78. The method of any one of Embodiments 70-77, wherein the subject is a dog, cat, rabbit, guinea pig, hamster, or ferret.

79. The method of any one of Embodiments 70-78, wherein the subject is a dog.

80. The method of any one of Embodiments 70-78, wherein the subject is a cat.

81. A method for producing a postbiotic composition, the method comprising:
   (i) fermenting a first bacterial strain comprising a 16S rDNA sequence with at least 97% sequence identity to the nucleotide sequence of SEQ ID NO: 1 (*Pediococcus acidlactici*) or SEQ ID NO: 7 (*Lactiplantibacillus plantarum*) in a first fermentation medium under conditions for production of indole-3-lactic acid (ILA), thereby producing a first fermentate comprising ILA;
   (ii) fermenting the first bacterial strain in a second fermentation medium under conditions for production of indole-3-carboxaldehyde (IAld), thereby producing a second fermentate comprising IAld; and
   (iii) combining the first and second fermentates to produce a postbiotic composition comprising ILA and IAld.

82. The method of Embodiment 81, wherein the bacterial strain comprises a 16S rDNA sequence with at least 99% sequence identity to SEQ ID NO: 1.

83. The method of Embodiment 81 or 82, wherein the bacterial strain belongs to the species *Pediococcus acidilactici*.

84. The method of any one of Embodiments 81-83, wherein the bacterial strain comprises a genome with at least 95.0% average nucleotide identity (ANI) and an alignment fraction (AF) of at least 20.0% to the reference genome of SEQ ID NO: 8.

85. The method of any one of Embodiments 81-84, wherein the bacterial strain comprises a genome with at least 95.0% average nucleotide identity (ANI) and an alignment fraction (AF) of at least 50.0% to the reference genome of SEQ ID NO: 8.

86. The method of any one of Embodiments 81-85, wherein the first fermentate comprises ILA at a higher amount than IAld.

87. The method of any one of Embodiments 81-86, wherein the second fermentate comprises IAld at a higher amount than ILA.

88. The method of any one of Embodiments 81-87, wherein the first and/or second fermentate further comprises indole-3-pyruvic acid (IPyA) and/or indole-3-propionic acid (IPA).

89. The method of any one of Embodiments 81-88, wherein the first and/or second fermentate further comprises 3-indoleacrylic acid (IA), and/or indole-3-acetic acid (IAA).

90. The method of any one of Embodiments 81-89, further comprising fermenting one or more additional bacterial strains to produce one or more additional fermentates, and combining the one or more additional fermentates with the first and second fermentates or the postbiotic composition, wherein the one or more additional bacterial strains are selected from the group consisting of *Bacillus licheniformis, Bacillus pumilus, Bacillus subtilis, Bacillus velezensis, Weizmannia coagulans*.

91. The method of Embodiment 90, wherein the one or more additional fermentates comprise ILA and/or IAld.

92. The method of any one of Embodiments 90-91, wherein the one or more additional fermentates comprise IPyA and/or IPA.

93. The method of any one of Embodiments 81-92, wherein the postbiotic composition comprises at least 0.1% (w/w) ILA.

94. The method of any one of Embodiments 81-93, wherein the postbiotic composition comprises at least 0.015% (w/w) IAld.

95. The method of any one of Embodiments 81-94, wherein the postbiotic composition further comprises IPyA and/or IPA.

96. The method of any one of Embodiments 81-95, wherein the postbiotic composition comprises at least 10% w/w IPyA relative to ILA.

97. The method of any one of Embodiments 81-96, wherein the postbiotic composition comprises at least 1% w/w IPA relative to IAld.

98. The method of any one of Embodiments 81-97, wherein the postbiotic composition comprises less than 200% w/w tryptophan relative to ILA.

99. The method of any one of Embodiments 81-98, wherein the postbiotic composition does not comprise indole.

100. The method of any one of Embodiments 81-99, wherein the postbiotic composition does not comprise indoxyl sulfate.

101. The method of any one of Embodiments 81-100, wherein the postbiotic composition comprises less than 10% w/w IAA relative to ILA.

102. The method of any one of Embodiments 81-101, wherein the postbiotic composition comprises less than 0.5% w/w tryptamine relative to ILA.

103. The method of any one of Embodiments 81-102, wherein the postbiotic composition comprises less than 0.5% w/w indole-3-acetamide relative to ILA.

104. The method of any one of Embodiments 81-103, wherein the first fermentate is produced by incubating the bacterial strain under microaerobic conditions in a fermentation medium comprising:
   1 g/L to 50 g/L tryptophan;
   100 g/L to 200 g/L glucose;
   manganese; and
   10 g/L to 125 g/L of one or more nitrogen sources.

105. The method of any one of Embodiments 81-104, wherein the second fermentate is produced by incubating the bacterial strain under aerobic conditions in a fermentation medium comprising:
   1 g/L to 50 g/L tryptophan;
   1 g/L to 100 g/L glucose;
   manganese; and
   125 g/L to 200 g/L of one or more nitrogen sources.

106. The method of Embodiment 104 or 105, wherein the one or more nitrogen sources comprise yeast extract or peptones.

107. The method of any one of Embodiments 81-103, wherein:
   the first fermentate is produced by incubating the bacterial strain under microaerobic conditions in a fermentation medium comprising 1 g/L to 50 g/L tryptophan, 4 g/L to 200 g/L glucose, and one or more of polysorbate 80, manganese, and vitamin B12; and the second fermentate is produced by incubating the bacterial strain under aerobic conditions in a fermentation medium comprising 1 g/L to 50 g/L tryptophan, 4 g/L to 200 g/L glucose; and one or more of polysorbate 80, manganese, and vitamin B12.

108. The method of any one of Embodiments 81-103, wherein:
the first fermentate is produced by incubating the bacterial strain under aerobic conditions in a fermentation medium comprising 1 g/L to 50 g/L tryptophan, 4 g/L to 200 g/L glucose, and one or more of polysorbate 80, manganese, and vitamin B12; and
the second fermentate is produced by incubating the bacterial strain under aerobic conditions in a fermentation medium comprising 1 g/L to 50 g/L tryptophan, less than 4 g/L glucose, no detectable polysorbate 80, no detectable manganese, and no detectable vitamin B12.

109. The method of any one of Embodiments 81-108, wherein the second fermentate comprises more IAld than the first fermentate.

110. The method of any one of Embodiments 81-109, wherein the first fermentate comprises more ILA than the second fermentate.

111. The method of any one of Embodiments 81-103, wherein the first fermentation medium and/or the second fermentation medium comprises tryptophan at a concentration of 1 to 12 g/L.

112. The method of any one of Embodiments 81-103 or 111, wherein the first fermentation medium comprises glucose at a concentration of at least 4 g/L.

113. The method of any one of Embodiments 81-103 or 111-112, wherein the first fermentation medium comprises glucose at a concentration of at least 4 to 15 g/L.

114. The method of any one of Embodiments 81-103 or 111-113, wherein the second fermentation medium comprises glucose at a concentration of less than 4 g/L.

115. The method of any one of Embodiments 81-103 or 111-114, wherein the first fermentation medium comprises polysorbate 80, manganese, and/or vitamin B12.

116. The method of any one of Embodiments 81-103 or 111-115, wherein the second fermentation medium does not comprise polysorbate 80, does not comprise manganese, and does not comprise vitamin B12.

117. The method of any one of Embodiments 81-116, wherein the fermenting of (i) and/or the fermenting of (ii) is for 2 to 7 days.

118. The method of any one of Embodiments 81-117, wherein the fermenting of (i) and/or the fermenting of (ii) is under aerobic or microaerobic conditions.

119. The method of any one of Embodiments 81-118, further comprising separating bacterial cells from the first fermentate and/or second fermentate before combining the first and second fermentates.

120. The method of any one of Embodiments 81-119, further comprising heat killing bacterial strains in the first fermentate and/or second fermentate before combining the first and second fermentates.

121. The method of any one of Embodiments 81-120, further comprising concentrating the first fermentate and/or second fermentate before combining the first and second fermentates.

122. The method of any one of Embodiments 81-121, further comprising drying the first fermentate and/or second fermentate before combining the first and second fermentates.

123. A postbiotic composition produced by the method of any one of Embodiments 81-122.

201. A composition comprising a bacterial fermentate mixture, the bacterial fermentate mixture comprising a first fermentate and a second fermentate of a bacterial strain comprising a 16S rDNA sequence with at least 97% sequence identity to the nucleotide sequence of SEQ ID NO: 1,
wherein the first fermentate comprises more indole-3-lactic acid (ILA) than indole-3-carboxaldehyde (IAld) and the second fermentate comprises more IAld than the first fermentate,
wherein each of the fermentates is in powder form,
wherein the composition is a nutritional supplement or food product.

202. The composition of Embodiment 201, wherein:
(i) the first fermentate is produced by incubating the bacterial strain under microaerobic conditions in a first fermentation medium comprising 1 g/L to 50 g/L tryptophan; and
(ii) the second fermentate is produced by incubating the bacterial strain under aerobic conditions in a second fermentation medium comprising 1 g/L to 50 g/L tryptophan.

203. The composition of Embodiment 202, wherein:
(i) the first fermentation medium comprises 100 g/L to 200 g/L glucose and 10 g/L to 125 g/L of one or more nitrogen sources; and
(ii) the second fermentation medium comprises 1 g/L to 100 g/L glucose and 125 g/L to 200 g/L of one or more nitrogen sources,
wherein the first fermentation medium comprises a higher glucose concentration than the second fermentation medium, and the second fermentation medium comprises a higher nitrogen source concentration than the first fermentation medium.

204. The composition of Embodiment 203, wherein each of the first fermentation medium and the second fermentation medium comprises manganese.

205. The composition of Embodiment 201, wherein the bacterial strain comprises a 16S rDNA sequence with at least 99% sequence identity to the nucleotide sequence of SEQ ID NO: 1.

206. The composition of Embodiment 205, wherein the bacterial strain belongs to the species *Pediococcus acidilactici*.

207. The composition of Embodiment 206, wherein the bacterial fermentate mixture consists of the first fermentate and the second fermentate.

208. The composition of Embodiment 201, wherein the nutritional supplement or food product comprises maltodextrin.

209. The composition of Embodiment 201, wherein each of the fermentates is lyophilized or spray-dried.

210. The composition of Embodiment 201, wherein the nutritional supplement or food product is in the form of gelatinized starch matrix, extruded or injection-molded treat, extruded or injection-molded chew, powder meal topper, water additive, dry kibble or food, wet food, frozen food, liquid spray, peanut butter spread, or soft jerky chew.

211. The composition of Embodiment 201, further comprising indole-3-pyruvic acid (IPyA), indole-3-propionic acid (IPA), 3-indoleacrylic acid (IA), and/or indole-3-acetic acid (IAA).

212. The composition of Embodiment 201, wherein the nutritional supplement or food product is formulated for administration to a canine subject at an ILA dose of 0.8

µg/kg per day to 8 mg/kg per day and an IAld dose of 0.08 µg/kg per day to 800 µg/kg per day.

213. The composition of Embodiment 201, wherein each of the first and second fermentates is present in the nutritional supplement or food product at an amount of 0.1 to 1000 mg, such that the bacterial fermentate mixture is present in the nutritional supplement or food product in an amount of 0.2 to 2000 mg.

214. The composition of Embodiment 201, wherein the composition treats or prevents a symptom of inflammation in a subject.

215. The composition of Embodiment 214, wherein the composition treats or prevents one or more symptoms of atopic dermatitis in the subject.

216. The composition of Embodiment 214, wherein the composition treats or prevents one or more symptoms of allergy in the subject.

217. The composition of Embodiment 214, wherein the composition treats or prevents itching in the subject.

218. The composition of Embodiment 214, wherein the composition increases diversity of the intestinal microbiome in a subject as measured by Shannon diversity index of zero-radius operational taxonomic units (OTUs) present in a fecal sample of the subject.

219. The composition of Embodiment 214, wherein the subject is a dog or cat.

220. A composition comprising a bacterial fermentate mixture, the bacterial fermentate mixture comprising a first fermentate and a second fermentate of a bacterial strain belonging to the species *Pediococcus acidilactici* and comprising a 16S rDNA sequence with at least 99% sequence identity to the nucleotide sequence of SEQ ID NO: 1,
  wherein the first fermentate is produced by incubating the bacterial strain under microaerobic conditions in a first fermentation medium comprising 1 g/L to 50 g/L tryptophan, 100 g/L to 200 g/L glucose, 10 g/L to 125 g/L of one or more nitrogen sources, and manganese, such that the first fermentate comprises more indole-3-lactic acid (ILA) than indole-3-carboxaldehyde (IAld),
  wherein the second fermentate is produced by incubating the bacterial strain under aerobic conditions in a second fermentation medium comprising 1 g/L to 50 g/L tryptophan, 1 g/L to 100 g/L glucose, 125 g/L to 200 g/L of one or more nitrogen sources, and manganese, such that the second fermentate comprises more IAld than the first fermentate,
  wherein the first fermentation medium comprises a higher glucose concentration than the second fermentation medium, and the second fermentation medium comprises a higher nitrogen source concentration than the first fermentation medium,
  wherein each of the fermentates is in powder form,
  wherein the composition is a nutritional supplement or food product.

301. A method of treating or preventing one or more symptoms of inflammation in a subject in need thereof, the method comprising orally administering to the subject a nutritional supplement or food product comprising a bacterial fermentate mixture, the bacterial fermentate mixture comprising a first fermentate and a second fermentate of a bacterial strain comprising a 16S rDNA sequence with at least 97% sequence identity to the nucleotide sequence of SEQ ID NO: 1,
  wherein the first fermentate comprises more indole-3-lactic acid (ILA) than indole-3-carboxaldehyde (IAld) and the second fermentate comprises more IAld than the first fermentate.

302. The method of Embodiment 301, wherein:
  (i) the first fermentate is produced by incubating the bacterial strain under microaerobic conditions in a first fermentation medium comprising 1 g/L to 50 g/L tryptophan; and
  (ii) the second fermentate is produced by incubating the bacterial strain under aerobic conditions in a second fermentation medium comprising 1 g/L to 50 g/L tryptophan.

303. The method of Embodiment 302, wherein:
  (i) the first fermentation medium comprises 100 g/L to 200 g/L glucose and 10 g/L to 125 g/L of one or more nitrogen sources; and
  (ii) the second fermentation medium comprises 1 g/L to 100 g/L glucose and 125 g/L to 200 g/L of one or more nitrogen sources,
  wherein the first fermentation medium comprises a higher glucose concentration than the second fermentation medium, and the second fermentation medium comprises a higher nitrogen source concentration than the first fermentation medium.

304. The method of Embodiment 303, wherein each of the first fermentation medium and the second fermentation medium comprises manganese.

305. The method of Embodiment 301, wherein the bacterial strain comprises a 16S rDNA sequence with at least 99% sequence identity to the nucleotide sequence of SEQ ID NO: 1.

306. The method of Embodiment 305, wherein the bacterial strain belongs to the species *Pediococcus acidilactici*.

307. The method of Embodiment 306, wherein the bacterial fermentate mixture consists of the first fermentate and the second fermentate.

308. The method of Embodiment 301, wherein the subject is a dog or cat.

309. The method of Embodiment 301, wherein the subject is a dog.

310. The method of Embodiment 309, wherein the bacterial fermentate mixture stimulates a canine aryl hydrocarbon receptor (AhR).

311. The method of Embodiment 309, wherein the bacterial fermentate mixture activates a nuclear factor erythroid 2-related factor 2 (Nrf2).

312. The method of Embodiment 309, wherein the bacterial fermentate mixture inhibits production of interferon-gamma (IFN-γ) and/or tumor necrosis factor alpha (TNF-α) in the dog.

313. The method of Embodiment 309, wherein the administering reduces itching severity in the dog.

314. The method of Embodiment 309, wherein the administering improves coat quality in the dog.

315. The method of Embodiment 309, wherein the administering increases, in an intestinal microenvironment of the dog, abundance of one or more microorganisms that produce indole-3-proprionic acid and/or butyrate.

316. The method of Embodiment 301, wherein each of the first and second fermentates is present in the nutritional supplement or food product at an amount of 0.1 to 1000 mg.

317. The method of Embodiment 301, wherein the bacterial fermentate mixture is present in the nutritional supplement or food product at an incorporation rate of 0.01% to 10% w/w.

318. The method of Embodiment 301, wherein the nutritional supplement or food product is in the form of a gelatinized starch matrix, extruded or injection-molded treat, extruded or injection-molded chew, powder meal topper, water additive, dry kibble or food, wet food, frozen food, liquid spray, peanut butter spread, or soft jerky chew.

319. A method of reducing itching severity in a canine subject in need thereof, the method comprising orally administering to the subject a nutritional supplement or food product comprising a bacterial fermentate mixture, the bacterial fermentate mixture comprising a first fermentate and a second fermentate of a bacterial strain belonging to the species *Pediococcus acidilactici* and comprising a 16S rDNA sequence with at least 99% sequence identity to the nucleotide sequence of SEQ ID NO: 1,
  wherein the first fermentate is produced by incubating the bacterial strain under microaerobic conditions in a first fermentation medium comprising 1 g/L to 50 g/L tryptophan, 100 g/L to 200 g/L glucose, 10 g/L to 125 g/L of one or more nitrogen sources, and manganese, such that the first fermentate comprises more indole-3-lactic acid (ILA) than indole-3-carboxaldehyde (IAld),
  wherein the second fermentate is produced by incubating the bacterial strain under aerobic conditions in a second fermentation medium comprising 1 g/L to 50 g/L tryptophan, 1 g/L to 100 g/L glucose, 125 g/L to 200 g/L of one or more nitrogen sources, and manganese, such that the second fermentate comprises more IAld than the first fermentate,
  wherein the first fermentation medium comprises a higher glucose concentration than the second fermentation medium, and the second fermentation medium comprises a higher nitrogen source concentration than the first fermentation medium.

320. The method of Embodiment 319, wherein the bacterial fermentate mixture reduces scratching frequency in the canine subject as measured by pruritus visual analog scale (PVAS).

EQUIVALENTS AND SCOPE

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in some embodiments, to A only (optionally including elements other than B); in another embodiment, to B only (optionally including elements other than A); in yet another embodiment, to both A and B (optionally including other elements); etc. As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of," or, when used in the claims, "consisting of," will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of," "only one of," or "exactly one of." "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in some embodiments, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc. Each possibility represents a separate embodiment of the present invention.

It should be understood that, unless clearly indicated to the contrary, the disclosure of numerical values and ranges of numerical values in the specification includes both i) the exact value(s) or range specified, and ii) values that are "about" the value(s) or ranges specified (e.g., values or ranges falling within a reasonable range (e.g., about 10% similar)) as would be understood by a person of ordinary skill in the art.

It should also be understood that, unless clearly indicated to the contrary, in any methods disclosed herein that include more than one step or act, the order of the steps or acts of the method is not necessarily limited to the order in which the steps or acts of the method are disclosed.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

EXAMPLES

Examples 1-7, 21, and 22 describe experiments that have actually been conducted. Examples 8-20 are prophetic examples. Where examples refer to the postbiotic composition of Example 2, containing the first and second fermentates of Strain 1, by the term "Strain 1 Postbiotic Fermentate Mixture", mixtures of fermentates of other bacteria (e.g., Strains 2-7) may be applied to the described conditions in similar manners. Where examples refer to the postbiotic composition of Example 2, containing the first and second fermentates of Strain 1, by the term "Canine Immune Health Postbiotic" or "(CIHP)", the skilled artisan will appreciate that the utility of such compositions is not limited to canines, as stimulation of the aryl hydrocarbon receptor and/or limiting inflammation by use of the fermentate mixture is beneficial in the context of other species, such as other domesticated animals (e.g., cats) and humans.

Figure 2A:
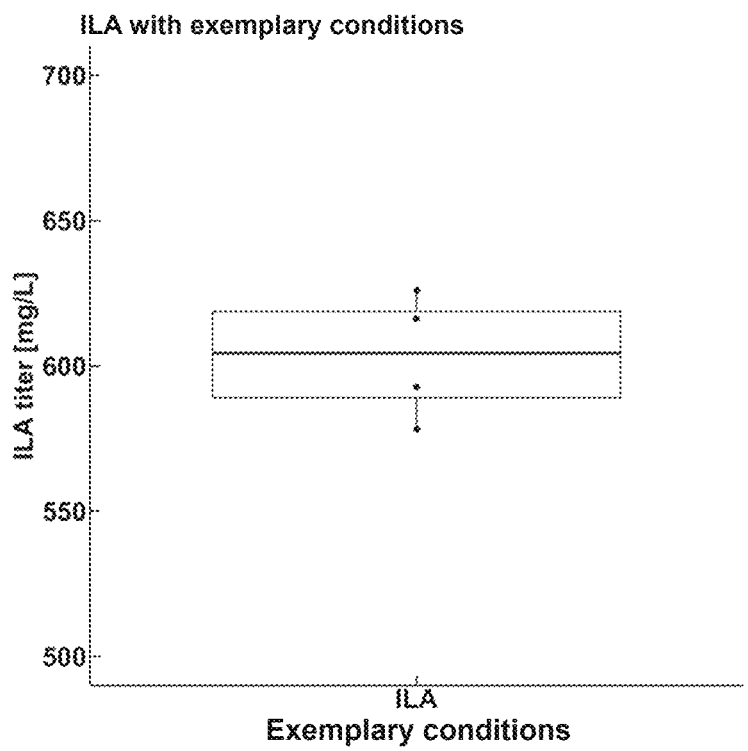
FIGS. 2A and 2B show ILA (FIG. 2A) and IAld (FIG. 2B) titers obtained during fermentation with *Pediococcus acidilactici* at exemplary glucose concentrations for each compound, respectively.
Figure 2B:
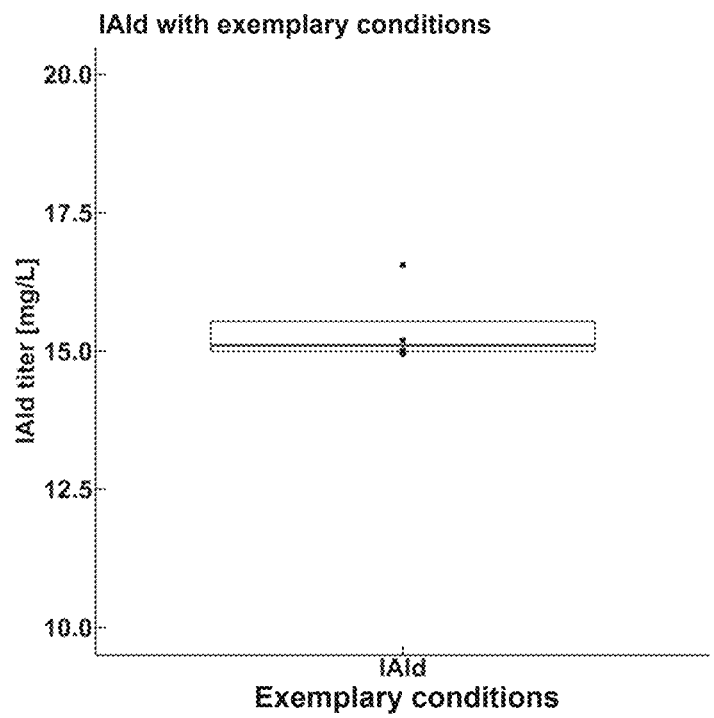

Example 1: Production of indole-3-lactic acid (ILA) and indole-3-carboxaldehyde (IAld) by Bacterial Fermentation Bacterial strain *Pediococcus acidilactici* (having a 16S rDNA sequence of SEQ ID NO: 1) was fermented in tryptophan-containing medium at varying concentrations of glucose, and titers of ILA and IAld were measured in bacterial fermentates. It was discovered that while *P. acidilactici* produced both ILA and IAld, the amounts of each compound produced varied with glucose concentration, with the greatest ILA production occurring at glucose concentrations above 4 g/L, and the most IAld production occurring at glucose concentrations below 4 g/L (FIG. 1). Fermentation of *P. acidilactici* at exemplary glucose concentrations yielded fermentates containing 600 mg/L ILA (FIG. 2A) or 15.0 mg/L (FIG. 2B).

Figure 3A:
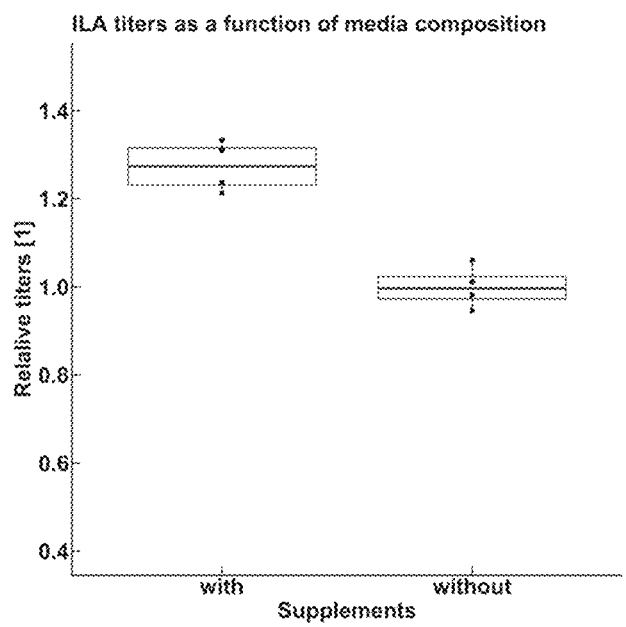
FIGS. 3A and 3B show relative ILA (FIG. 3A) and IAld (FIG. 3B) titers obtained during fermentation with *Pediococcus acidilactici* with or without supplementation of media with polysorbate 80 (1 g/L final concentration), manganese (0.1 g/L final concentration), and vitamin B12 (0.001 mg/L final concentration).
Figure 3B:
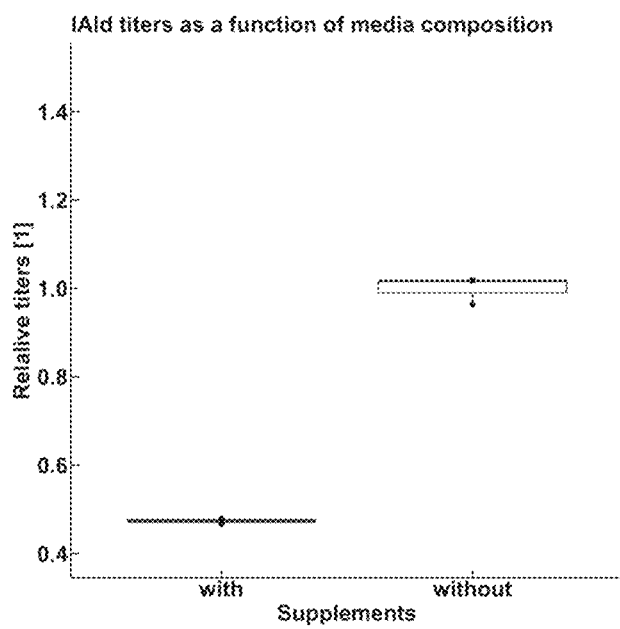
Figure 4A:
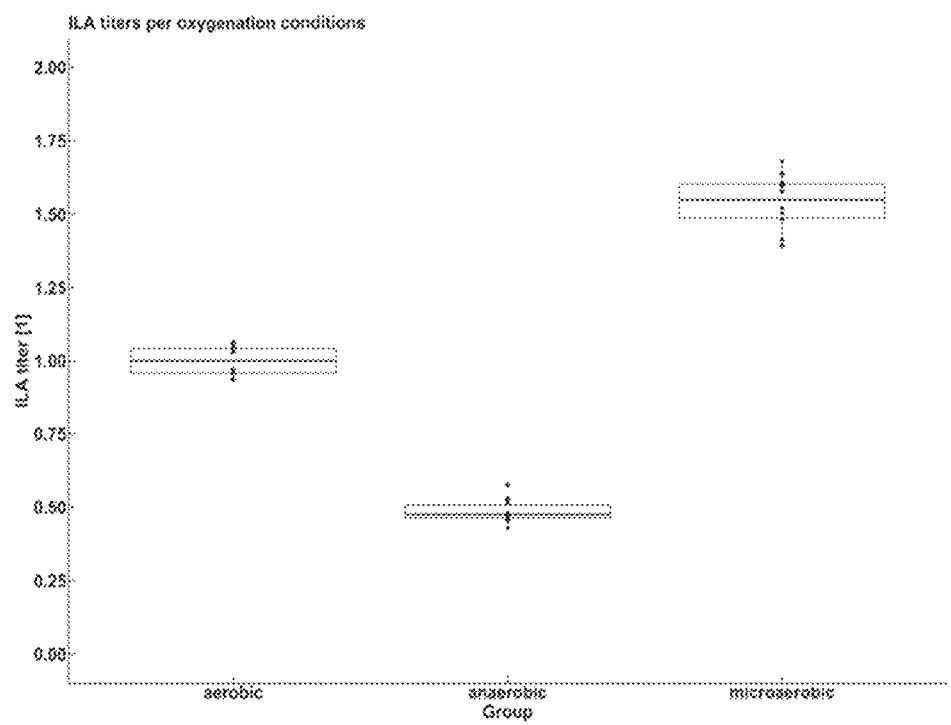
FIGS. 4A and 4B show relative ILA (FIG. 4A) and IAld (FIG. 4B) titers obtained during fermentation with *Pediococcus acidilactici* in different oxygenation conditions.
Figure 4B:
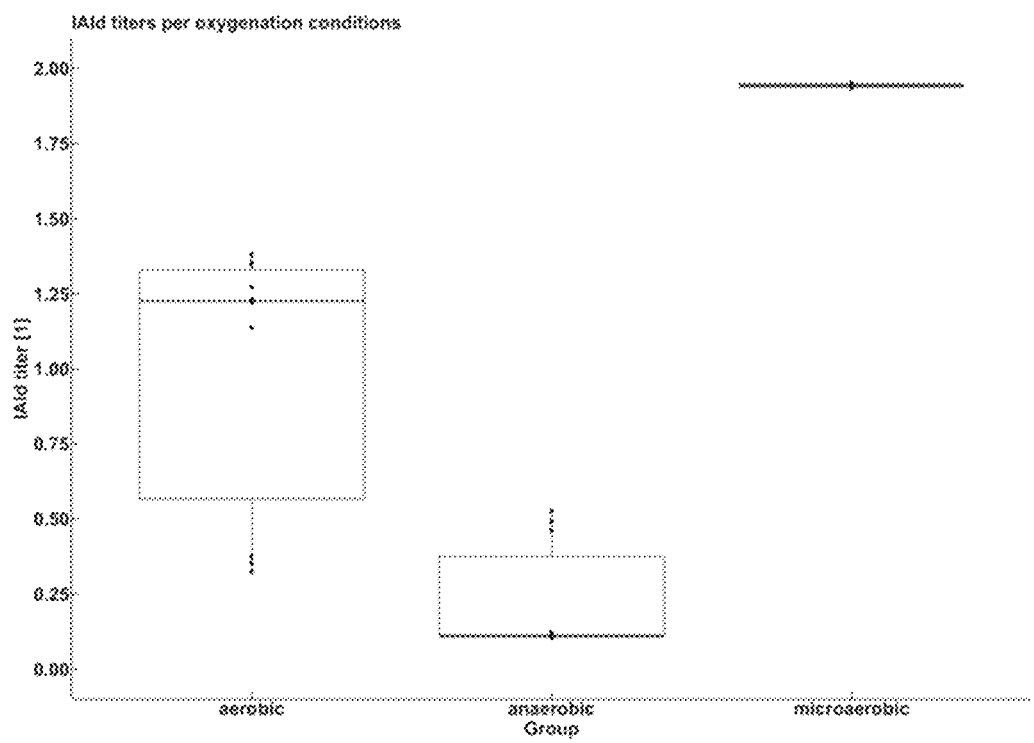

Next, *P. acidilactici* was fermented in separate reactions having the glucose concentrations determined optimal for ILA or IAld production, with or without supplementation of the media with a combination of (i) polysorbate 80, (ii) manganese, and (iii) vitamin B12. While this supplementation increased production of ILA (FIG. 3A), it decreased production of IAld (FIG. 3B). The effect of oxygen exposure was also investigated, revealing that microaerobic conditions improved yields of both ILA and IAld, while both compounds were produced less under anaerobic conditions (FIGS. 4A and 4B).

Figure 5:
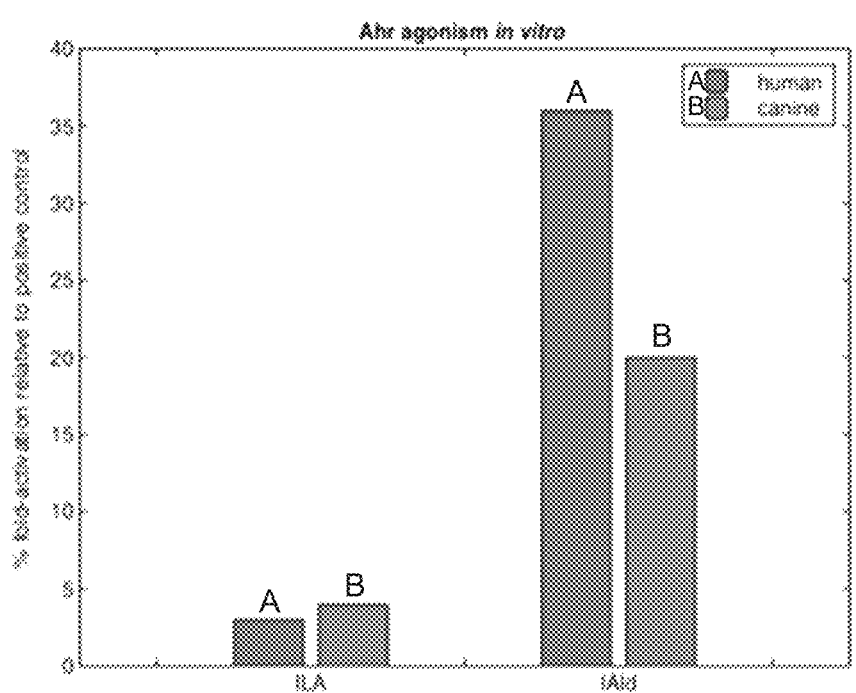
FIG. 5 shows AhR agonism of ILA and IAld in human (left column of each pair) and canine (right column of each pair) cell lines. Data are normalized to the positive control (methylcholanthrene).

The utility of ILA and IAld in multiple host was validated by an in vitro assay. Human or canine cell lines expressing AhR were exposed to ILA or IAld at 200 PM, and AhR activation was assayed using in vitro luminescence. AhR activation was observed using both compounds (FIG. 5), indicating the benefit of both ILA and IAld for AhR agonism.

Example 2: Improved Activation of Canine AhR by a Mixture of Fermentates of Strain 1

The ability of a postbiotic to activate canine AhR was validated by an in vitro assay. The postbiotic composition comprised a first fermentate and a second fermentate of Strain 1, belonging to *Pediococcus acidilactici*, whose 16S rRNA gene sequence is provided by SEQ ID NO: 1, and genome is provided by SEQ ID NO: 8. The first fermentate contained ILA, and the second fermentate contained IAld.

AhR activation was assessed using a luciferase reporter assay; a luminescent signal is generated upon activation of AhR. The negative control was water and the positive control was 2 mg/mL methylcholanthrene, an AhR agonist. The AhR reporter canine cell lines were treated for 24 hours with controls, the postbiotic, or a blend of pure ILA and IAld at the same ratio and concentrations as the postbiotic. Cell viability was measured, cells were lysed, and luciferase activity was measured using a luminometer upon addition of a luminescence detection reagent (luciferin).

Figure 6:
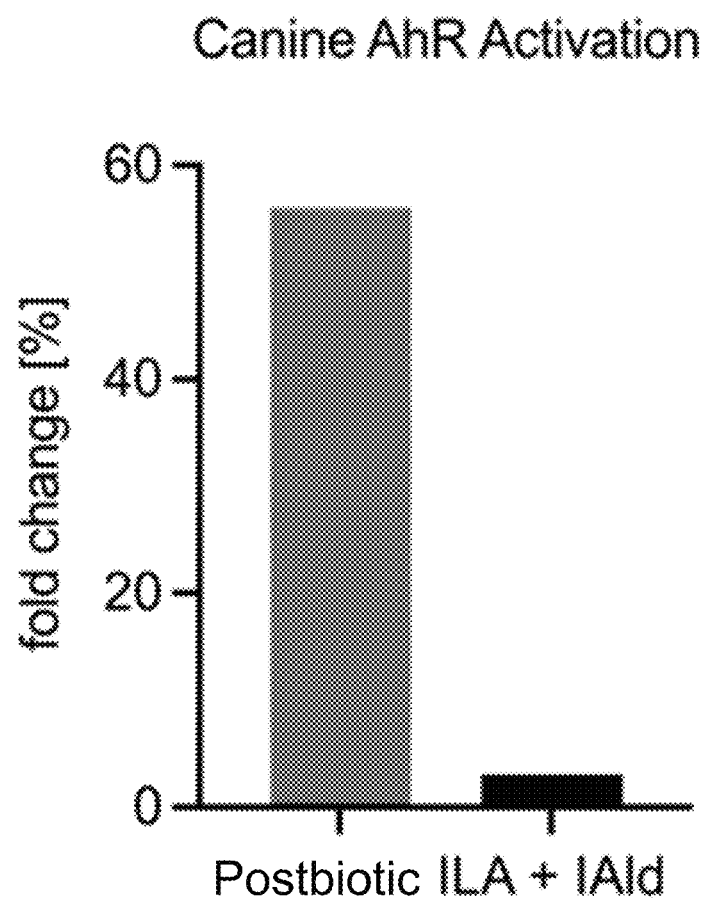
FIG. 6 shows canine AhR activation by Strain 1 Postbiotic Fermentate Mixture (an exemplary postbiotic composition) or a mixture of ILA and IAld.

The luminescence light intensity (corrected by number of viable cells) is directly proportional to the extent of AhR activation. The postbiotic unexpectedly caused a fold activation of canine AhR that was 10× higher than a blend of pure ILA and IAld (FIG. 6).

Example 3: Improved Reduction of Pro-Inflammatory Cytokines by a Mixture of Fermentates of Strain 1

The ability of the postbiotic of Example 2, containing the first and second fermentates of Strain 1, to modulate inflammation, in particular by reducing pro-inflammatory cytokines, was validated by an in vitro lymphocyte stimulation assay. Peripheral blood mononuclear cells (PBMCS) were harvested from one human donor and treated with controls, the postbiotic, or a blend of pure ILA and IAld at the same ratio and concentrations as the postbiotic. The positive control was the reference inhibitor dexamethasone at 100 nM. The postbiotic and pure ILA/IAld blend were tested at a range of concentrations. PBMCs were seeded at a density of $2\times10^5$ cells/well in culture medium and incubated for 1 hour prior to the addition of test agents. Test agents and controls were added in triplicate and incubated for 1 hour. Next, the inducing agent phytohemagglutinin-L was added at 10 g/mL, followed by incubation for 48 hours. Supernatants were then collected for analysis, and cytokine levels were determined using Luminex® methodology.

Figure 7A:
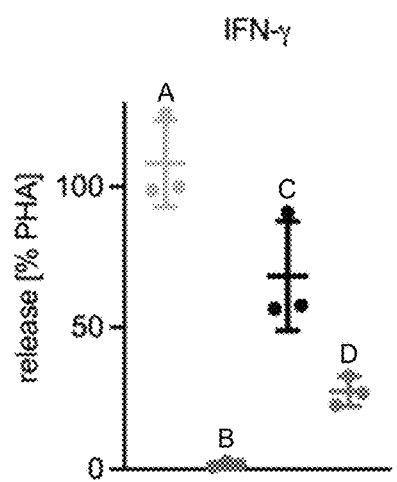
FIGS. 7A and 7B show reduction in IFN-γ (FIG. 7A) and TNF-α (FIG. 7B) from PBMCs exposed to phytohemagglutinin (PHA, −control), Strain 1 Postbiotic Fermentate Mixture, a mixture of purified ILA and IAld, or inhibitor dexamethasone (+control).
Figure 7B:
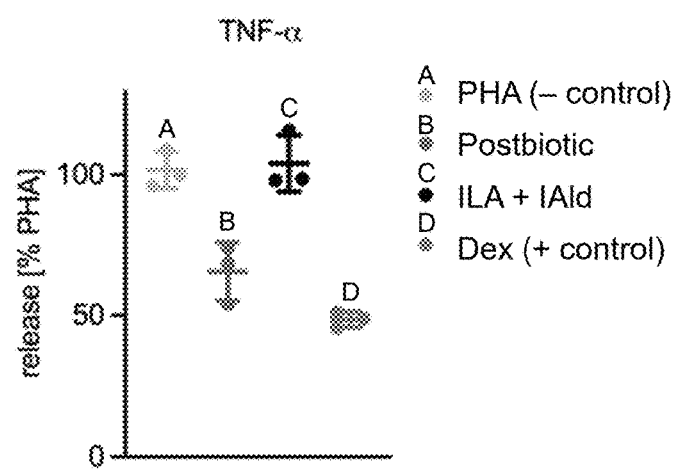

Levels of each cytokine were interpolated from standard curves using non-linear regression analysis and normalized to the vehicle control. The postbiotic significantly inhibited the release of the pro-inflammatory cytokines interferon-gamma (IFN-γ) and tumor necrosis factor alpha (TNF-α) at all concentrations tested. The postbiotic unexpectedly outperformed the mixture of pure ILA/IAld blend with respect to both cytokines (FIGS. 7A and 7B), with only minimal detection of IFN-γ (FIG. 7A), and inhibition of TNF-α production where the mixture of pure ILA+IAld failed to inhibit TNF-α production.

Example 4: Reduction of Scratching Behavior in Dogs Following Administration of a Mixture of Fermentates of Strain 1

A double-blind, multi-group controlled study was conducted to evaluate the efficacy of the postbiotic of Example 2, containing the first and second fermentates of Strain 1 in reducing canine itching. Thirty dogs, evenly divided into postbiotic and placebo groups, participated over 50 days, including a 14-day baseline observation and a 28-day treatment phase. The postbiotic or placebo was administered twice daily as a meal topper, with stratified randomization ensuring balanced groups by sex and baseline scratching levels. The primary biomarker was scratching time, measured in seconds per day using a wearable activity monitor, with the rolling weekly average used to assess efficacy. Secondary biomarkers included licking time (also tracked by the wearable activity monitor), skin metagenomic analysis from samples taken on Days 0 and 28 to track microbiome shifts, and fecal metagenomic analysis from the same days to track microbiome shifts. Skin samples were taken from three locations (armpit, groin, and paw), while fecal samples were collected from first-evacuated feces of the day, refrigerated, and shipped on ice packs. Human-reported metrics, collected biweekly, included perceptions of coat quality (using a standard 4-point scale, with lowest score indicating poor quality coat), and itching severity (using the Pruritis Visual Analog Scale (PVAS)). This structured methodology assessed the efficacy of the postbiotic in alleviating occasional canine itching.

Figure 8A:
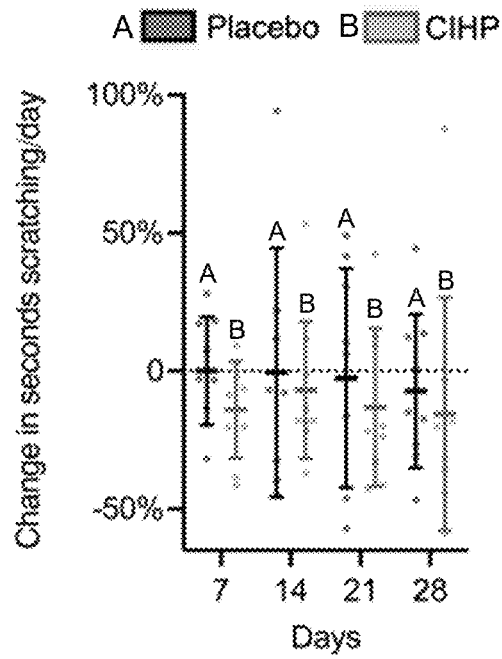

Among participants with occasional-elevated scratching, the postbiotic reduced scratching on Day 28. Scratching was significantly reduced from baseline on Day 28 (median change=–26%, p-value=0.031, two-tailed Wilcoxon Test, FIG. 8A) in the postbiotic group, but not in the placebo group (p=0.87).

Figure 8B:
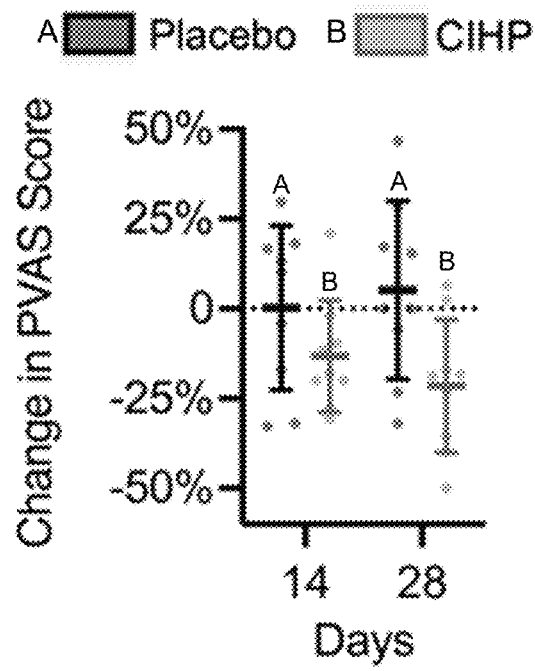
FIG. 8B shows change in PVAS score, by group. Lines and error bars indicate the mean and standard deviation. Points represent individual participant data.

Among all participants, the postbiotic reduced PVAS score by 14% at Day 14 and 17% at Day 28, relative to baseline (FIG. 8B, p-value=0.03 and p-value=0.0095, two-tailed paired t-test). There was no change in PVAS score in the placebo group (p-value=0.73 and p-value=0.45). At Day 28, PVAS score change from baseline was significantly lower in the postbiotic (CIHP) group compared to placebo (mean difference=27%, p=0.02, two-tailed unpaired t-test).

Figure 8C:
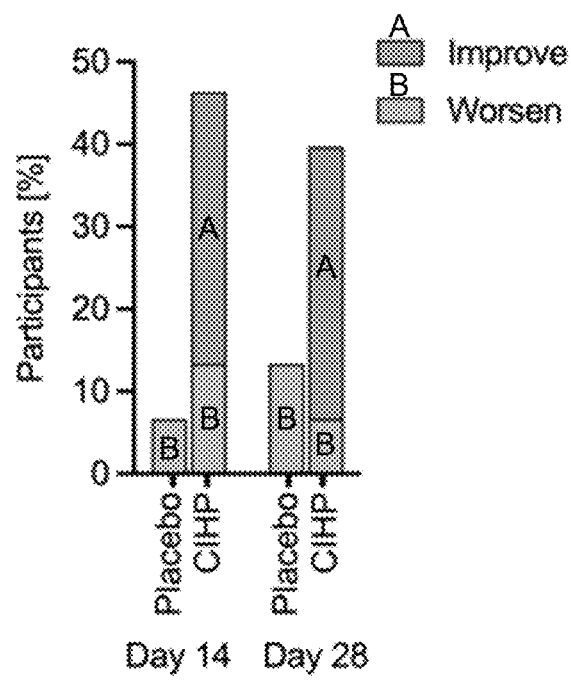
FIG. 8C shows a summary of changes to coat quality. Both groups started with a median score of 1 (mean=1.33), indicating a typical quality coat.

Among all participants, the postbiotic improved perception of coat quality compared to placebo at Day 14 (p-value=0.01, Fisher's exact test, mean difference=3%, FIG. 8C) and Day 28 (p-value=0.02, Fisher's exact test, mean difference=11%).

Fecal metagenomic analysis of fecal samples was used to identify shifts in the gut microbiome composition as a measure of gut health. Fecal samples were collected from first-evacuated feces representing the first defecation of the day and stored in a DNA/RNA Shield Fecal Collection Tube (Zymo Research R1137). Samples were processed altogether in a randomized order, with DNA extraction and PCR being performed on all samples at the same time. Samples were processed in duplicate from the raw fecal sample. The 16S rRNA gene sequence V4 region was amplified with sequencing primers and the resulting libraries were pooled and sequenced on the Illumina platform. Counts of zero-radius operational taxonomic units (ZOTUs) were determined for each library using USEARCH, with RDP Classifier reference database. doi: 10.1128/mra.01063-23. Taxa that were seen less than 10 times in at least 20% of samples were removed, and read counts were standardized to the median sequencing depth. The DESeq2 package was utilized to detect taxa with significant differences across groups.

Figure 9A:
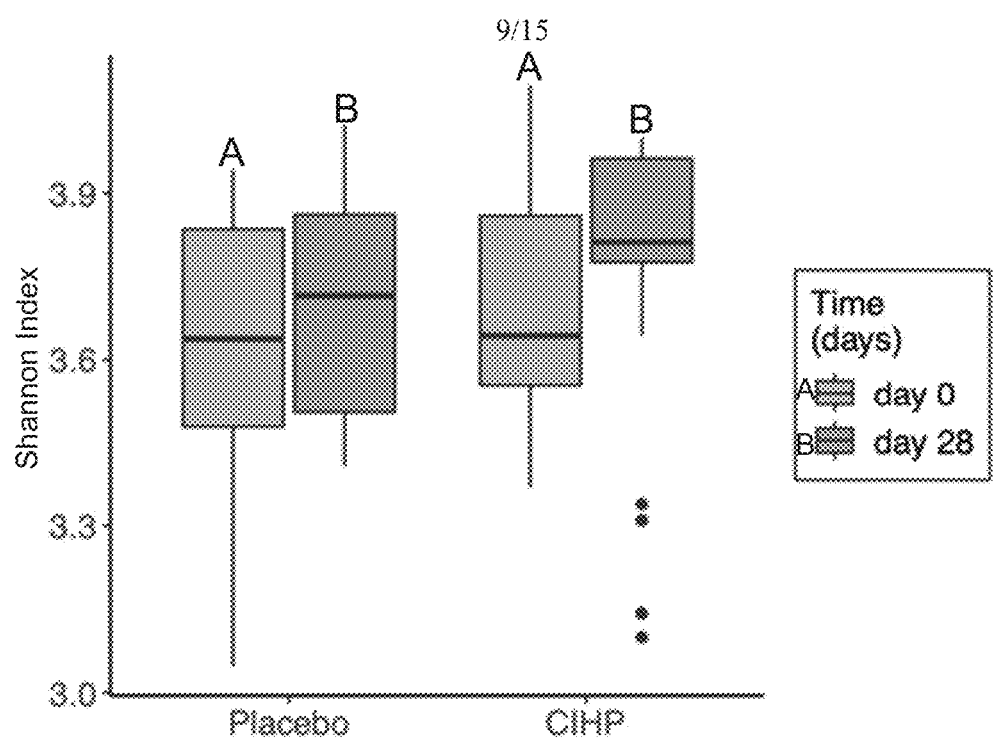
FIG. 9A shows diversity of gut microbiomes as measured by Shannon index.
Figure 9B:
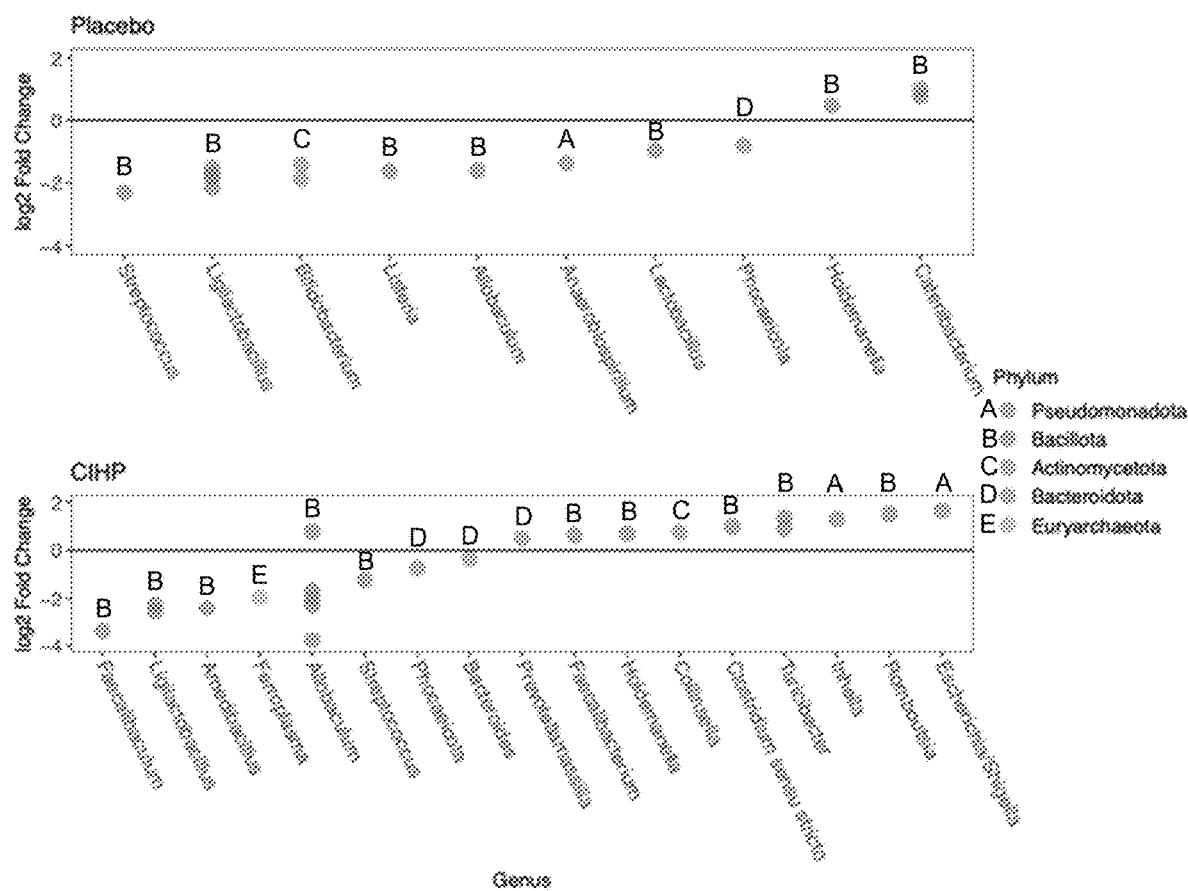

Alpha diversity describes the variety of individuals that make up a community on a local scale, and the Shannon index accounts for both the relative abundance of species (evenness) and the number of different species (richness). Shannon, Bell Syst Tech J. 1948. 27:379-423. CIHP increased the Shannon index of gut microbiomes by 4.6% at Day 28 (p-value=0.043, two-tailed Wilcoxon test, FIG. 9A). The placebo showed no change (p-value=0.092). In general, diversity is thought to be associated with microbiome robustness, resilience and health.

Additionally, the postbiotic increased the abundance of ~4× more taxa in the gut microbiome compared to placebo (alpha=0.01) at Day 28, which indicates a response to the treatment in the gut microbiome. The abundance of two strains of the genus *Clostridium sensu stricto* increased in response to the postbiotic treatment, as well as other taxa associated with indole production, which are known to support skin, gut, and immune health. Bacteria of the genus *Clostridium sensu stricto* support gut health in both animals and humans by producing IPA, a beneficial compound that is anti-inflammatory and increases intestinal barrier integrity.

Example 5: Production of indole-3-propionic acid (IPA) Levels by Incubation of an Anaerobic Intestinal Bacterium with a Fermentate Mixture of Fermentates of Strain 1

Figure 10:
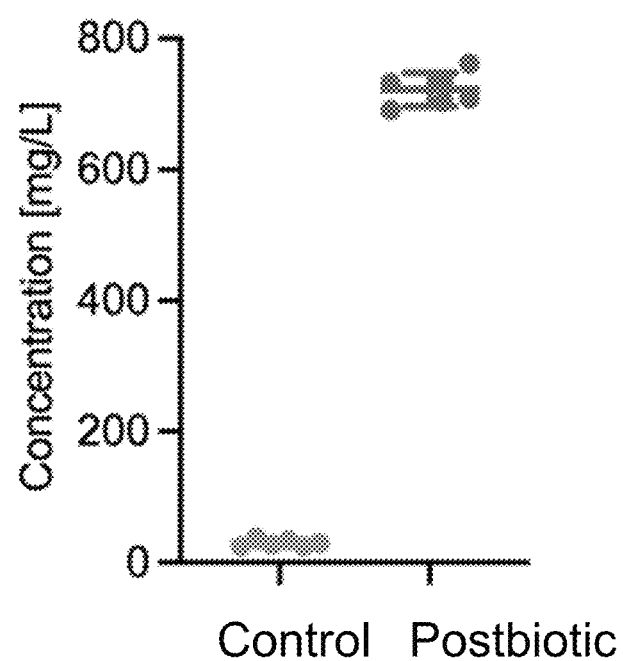
FIG. 10 shows production of IPA by *Clostridium sporogenes* in the presence of Strain 1 Postbiotic Fermentate Mixture or media only (−control).

The ability of the postbiotic of Example 2, containing the first and second fermentates of Strain 1, to serve as a substrate for production of indole-3-propionic acid (IPA) by bacteria of the intestinal microbiome, thereby increasing serum levels in vivo, was evaluated in an in vitro assay. To demonstrate that the postbiotic has the potential for conversion into IPA, *Clostridium sporogenes*, an anaerobic gut commensal that produces IPA, was fermented for 48 hours in a base media supplemented with the postbiotic or a negative control. The negative control was tryptophan (at a concentration of 277.48 mg/mL), and the postbiotic concentration was 722.03 mg/mL. The concentration of IPA in the supernatant of each fermentation was then measured using a liquid chromatography/mass spectrometry system (Agilent 6470). The amount of IPA produced by *C. sporogenes* in the postbiotic-supplemented media was 25 times greater than that of negative control media (FIG. 10) (p=0.0022, Mann-Whitney test), confirming the ability of the postbiotic to drive IPA production. This result demonstrates that components of the postbiotic, such as indole-3-lactic acid (ILA), may also be converted into other indole-containing compounds (e.g., IPA) by the gut microbiome following administration.

IPA is a well characterized indole compound produced through microbial metabolism of tryptophan and known to mediate a wide range of health benefits.[1-6] IPA is produced primarily by anaerobic gut commensal microbiota. IPA has been shown to promote a healthy immune system and inflammatory response in the skin, gut, and nervous system,[7-12] and to regulate intestinal permeability.[13] IPA has also been found to have antioxidant properties across tissues including in the skin and brain.[14-17] Higher levels of IPA in the gut promote and are associated with a healthy gut microbiome,[8,18,19] and IPA is also known to promote a healthy weight and metabolism.[20] Without wishing to be bound by theory, the production of IPA from fermentates is believed to be useful for improving homeostasis in subjects, such as by mitigating inflammation, improving epithelial barrier integrity, and acting as an antioxidant.

Example 6: Activation of Canine Pregnane X Receptor (PXR) by a Fermentate Mixture of Fermentates of Strain 1

The ability of the postbiotic of Example 2, containing the first and second fermentates of Strain 1, to activate canine PXR was evaluated in an in vitro assay. PXR activation was assessed using a luciferase reporter assay, in which a luminescent signal is generated upon activation of PXR. The negative control was water and the positive control was 10 µM rifampicin, a PXR agonist. The PXR reporter canine cell lines were treated for 24 hours with controls and the postbiotic. Cell viability was measured, cells were lysed, and luciferase activity was measured using a luminometer upon addition of a luminescence detection reagent (luciferin). The luminescence light intensity (corrected by number of viable cells) is directly proportional to the extent of PXR activation.

Figure 11:
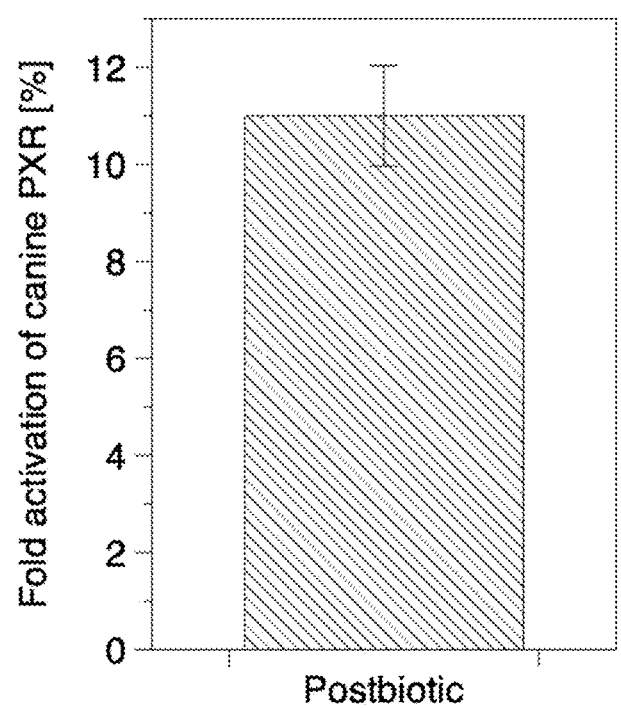
FIG. 11 shows activation of canine PXR by Strain 1 Postbiotic Fermentate Mixture, normalized to positive and negative controls.

The postbiotic unexpectedly caused an 11% fold activation of canine PXR, normalized to positive and negative controls (FIG. 11). No activation was expected because ILA and IAld were not known to activate PXR.

The pregnane X receptor (PXR) plays a role in maintaining epithelial tissue health by regulating genes involved in detoxification, inflammation, and cellular homeostasis.[21-23] As a nuclear receptor, PXR modulates the expression of enzymes and transporters responsible for metabolizing xenobiotics and endogenous compounds,[24] thereby protecting epithelial barriers from chemical and oxidative stress.[25,26] In the gut, PXR activation supports intestinal health by enhancing the integrity of the epithelial barrier, reducing inflammation, and promoting microbial balance, which contribute to mitigating disorders like inflammatory bowel disease.[27-28] Similarly, in the skin, PXR contributes to maintaining the epidermal barrier by regulating the response to environmental insults and modulating inflammatory pathways.[26,28,29] Dysregulation of PXR activity in either tissue can compromise barrier function, leading to increased susceptibility to infections, inflammation, and chronic conditions.[26,30-32] Thus, PXR thus serves as a molecular link between environmental sensing and epithelial health in both the gut and the skin. Without wishing to be bound by theory, activation of PXR by fermentates is believed to be useful for improving homeostasis in subjects, such as by mitigating inflammation and improving tissue barrier integrity.

Example 7: Activation of Nuclear Factor Erythroid 2-Related Factor 2 (Nrf2) by a Fermentate Mixture of Fermentates of Strain 1

Figure 12A:
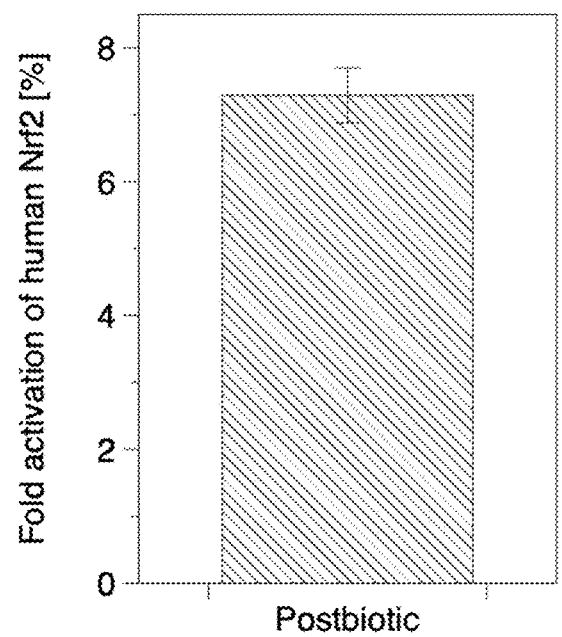
FIG. 12A shows activation of human Nrf2 by Strain 1 Postbiotic Fermentate Mixture, normalized to positive and negative controls.
Figure 12B:
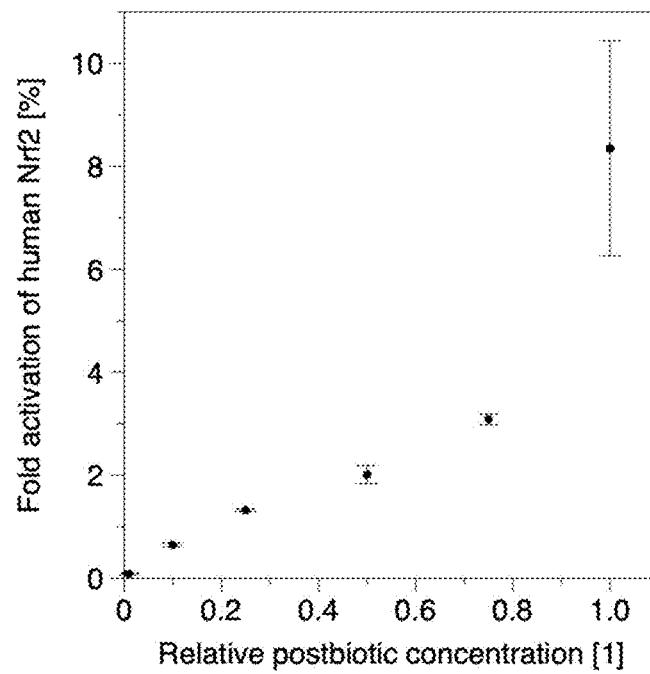
FIG. 12B shows a dose-response curve of Nrf2 activation by Strain 1 Postbiotic Fermentate Mixture at a range of concentrations.

The ability of the postbiotic of Example 2, containing the first and second fermentates of Strain 1, was evaluated in an in vitro assay. Nrf2 activation was assessed using a luciferase reporter assay; a luminescent signal is generated upon activation of Nrf2. The negative control was water and the positive control was 40 µM NK-252, a Nrf2 agonist. The Nrf2 reporter human cell lines were treated for 24 hours with controls and the postbiotic. Cell viability was measured, cells were lysed, and luciferase activity was measured using a luminometer upon addition of a luminescence detection reagent (luciferin). The luminescence light intensity (corrected by number of viable cells) is directly proportional to the extent of Nrf2 activation. The postbiotic unexpectedly caused a 7% fold activation of Nrf2, normalized to positive and negative controls (FIGS. 12A-12B).

The nuclear factor erythroid 2-related factor 2 (Nrf2) is a key transcription factor that regulates cellular defense through its interaction with the antioxidant response element (ARE).[33-35] ARE is a specific DNA sequence found in the promoter region of genes involved in antioxidant production, detoxification, and cellular protection.[36-37] Activation of Nrf2 leads to its translocation into the nucleus, where it binds to ARE, driving the expression of genes such as glutathione S-transferases, NAD(P)H quinone oxidoreductase 1, and heme oxygenase-1.[38-40] In epithelial tissues like the gut and skin, Nrf2-ARE signaling strengthens barrier function, reduces inflammation, and mitigates oxidative damage.[41,42] In the gut, this pathway enhances epithelial resilience to insults, supports microbiome balance, and protects against inflammatory conditions such as colitis.[43-45] In the skin, Nrf2-ARE activation promotes antioxidant defense and healing, safeguarding against UV-induced damage and aging.[46-48] Beyond epithelial health, ARE-regulated genes contribute to maintaining metabolic homeostasis by mitigating oxidative stress linked to insulin resistance and lipid dysregulation.[49-50] In the brain, Nrf2-ARE signaling counters neurodegenerative processes by reducing oxidative and inflammatory stress, promoting neuronal survival, and maintaining mitochondrial function.[43,51,52] Thus, Nrf2-ARE interaction is a mechanism underlying the protection and resilience of epithelial tissues, metabolic systems, and the nervous system.

Example 8: Use of Postbiotic Fermentate Mixtures in Metabolic Health and Weight Management Weight gain and obesity are linked to various metabolic health issues, and managing these is an increasingly important health consideration for dogs. The Strain 1 Postbiotic Fermentate Mixture contains bioactive metabolites that are shown, e.g., in Example 4, to be readily converted into IPA by microbes of the canine gut microbiome (e.g., *Clostridium sporogenes*) and activate the aryl hydrocarbon receptor (AhR). IPA has been shown to help reduce weight gain, improve glucose metabolism, and protect against obesity-related metabolic issues, while AhR activation may further mitigate obesity-related inflammation. Therefore, the Strain 1 Postbiotic Fermentate Mixture is expected to promote a healthy weight and metabolism in dogs.

Weight management in dogs is essential not only for their overall well-being but also for supporting their metabolic health, as obesity is becoming an increasing concern.[53-54] Obesity in dogs primarily occurs when they consume more calories than they burn, leading to excessive fat accumulation and disrupting their metabolic balance,[53-54] which can impair glucose metabolism and increase risk of heart disease, joint problems, and other metabolic disorders.[55-62] Proper weight management involves feeding dogs a balanced diet tailored to their size, breed, and activity level, together with regular exercise to burn calories and maintain muscle mass.[53-57] Interestingly, the gut microbiome and metabolites produced by the gut microbiome have been increasingly implicated in metabolic diseases such as obesity in dogs.[63]

IPA promotes a healthy weight and metabolism.[20] A low serum level of IPA has been associated with obesity and obesity-associated metabolic disorders in both human and animal studies.[64-66] A low serum level of IPA has also been associated with liver fibrosis, which can develop from metabolic dysfunction related to glucose and fatty acid metabolism.[67,68] Conversely, IPA levels 1.5 to 2 times higher than those low serum levels are associated with good metabolic health and healthy weight maintenance.[67,68] IPA supplementation has been shown to reduce weight gain in rats and mice, by ~50% over 1 week and ~60% in 2 weeks, respectively, and to ameliorate obesity-induced metabolic dysfunction in mice.[65,69] IPA enhances glucose metabolism by promoting glucose uptake and preventing insulin resistance.[70] Interestingly, indole was shown to stimulate GLP-1 secretion over short time periods.[71] GLP-1 enhances glucose metabolism by stimulating insulin release in response to high blood sugar and reducing glucagon secretion, thereby helping to lower and stabilize blood glucose levels. Improvements to gut epithelium health and barrier integrity are also observed after IPA administration, preventing systemic inflammation which aggravates metabolic disorders linked to obesity and inflammation.[65,72] IPA can mediate benefits in several ways. IPA demonstrates potent anti-inflammatory effects by inhibiting NF-κB signaling and reducing production of pro-inflammatory cytokines.[3,72,73] IPA also exhibits antioxidant properties by decreasing reactive oxygen species and lipid peroxidation[13,14,74] and improves the gut epithelium by modulating the PXR pathway.[75-77]

The primary benefit of AhR in the context of metabolic health and obesity is its ability to regulate inflammation. Specifically, AhR activation is known to protect gut barrier integrity against damage from obesity-related inflammation.[78] Indeed, AhR activation in the gut protects against inflammatory damage by regulating intestinal stem cell proliferation and differentiation, by upregulating production of tight junction proteins, and by inhibiting inflammatory signaling.[45,78-80] Maintaining gut barrier integrity is broadly applicable metabolic and immune health, as it facilitates the selective transport of essential nutrients and molecules, restricts translocation of harmful pathogens and toxins, and helps block inflammatory signals that could exacerbate systemic inflammation.

In summary, the Strain 1 Postbiotic Fermentate Mixture contains bioactive metabolites that are shown to be converted into IPA by gut microbes, and can thereby increase IPA serum levels and activate the AhR. IPA is known to reduce weight gain and improve glucose metabolism in mammals, and its anti-oxidative and anti-inflammatory properties can provide protection against metabolic comorbidities associated with obesity. AhR activation can also modulate inflammation to protect against obesity-related inflammatory conditions, particularly in the gut. Taken together, the evidence indicates that the Strain 1 Postbiotic Fermentate Mixture, allowing indole-dependent AhR activation and IPA level modulation, is expected to promote a healthy weight and metabolism in dogs. Examples 14 (weight loss) and 15 (weight maintenance) provide a double-blind, placebo-controlled study design to measure these benefits.

Example 9: Use of Postbiotic Fermentate Mixtures in Gut Health

Gut health in dogs refers to the balance and functioning of the gastrointestinal system, also referred to as the digestive system. When this system is out of balance, it can result in issues like diarrhea, constipation, and lethargy. The Strain 1 Postbiotic Fermentate Mixture has been shown to activate the aryl hydrocarbon receptor (AhR). The Strain 1 Postbiotic Fermentate Mixture also contains bioactive metabolites that are shown to be converted to indole-3-propionic acid (IPA) by microbes of the canine microbiome, which thereby increases IPA serum levels. Finally, the Strain 1 Postbiotic Fermentate Mixture was shown to reduce production of inflammatory cytokines in vitro and is known to promote antioxidant activity. Together, these mechanisms can substantially support epithelial barrier integrity and help to maintain a healthy immune and inflammatory response in the gut. Therefore, the Strain 1 Postbiotic Fermentate Mixture is expected to promote gut health in dogs.

Gut health in dogs refers to the function of their gastrointestinal system, including the stomach, intestines, and associated microbiome.[81-83] A healthy gut is essential for digestion, nutrient absorption, immune function, and overall well-being.[84,85] A healthy gut contains a diverse and balanced population of beneficial bacteria, which help break down food, prevent the growth of harmful pathogens, and support the immune system.[81,86,87] Signs of good gut health include regular bowel movements, a healthy appetite, and vibrant energy levels, while issues like diarrhea, constipation, or lethargy can indicate imbalances or underlying problems.[82,84,88,89] Maintaining gut health often involves a balanced diet, nutritional supplements, and proper veterinary care.[85,90]

AhR is important in maintaining gut health, primarily through its ability to enhance barrier function and modulate immune responses.[80,91-93] AhR activation increases expression of tight junction proteins, which are crucial for maintaining a robust intestinal epithelial barrier.[79,80] This barrier fortification prevents the leakage of harmful substances and microorganisms into the bloodstream, reducing inflammation, and maintaining gut homeostasis.[79,80] Notably, AhR activation inhibits the activity of NF-κB and calpain, both of which negatively impact tight junction protein expression, thus contributing to a strengthened epithelial barrier.[45] In addition to its role in barrier function, AhR also significantly impacts immune regulation in the gut.[93-96] AhR activation promotes the production of IL-22, a cytokine crucial for gut barrier integrity and defense against pathogens.[97,98] Studies show that AhR activation protects against colitis and reduces pro-inflammatory cytokines such as TNF-α and IFN-γ.[80,91,98-101] The absence of AhR signaling, on the other hand, results in increased susceptibility to colitis.[97,102] AhR activation appears to influence the differentiation and proliferation of intestinal stem cells, which are essential for epithelial renewal.[77,100] In vitro studies suggest that AhR activation promotes differentiation of intestinal stem cells into goblet cells, which are responsible for mucus production, a crucial component of the intestinal barrier.[100] These findings point towards AhR's involvement in epithelial regeneration and mucosal barrier maintenance through the regulation of intestinal stem cells function. The Strain 1 Postbiotic Fermentate Mixture activates canine AhR in vitro, and can therefore improve gut health through AhR-dependent mechanisms.

IPA demonstrates potent anti-inflammatory effects by inhibiting NF-κB signaling and reducing pro-inflammatory cytokines.[3,72,73] IPA also exhibits antioxidant properties by decreasing reactive oxygen species and lipid peroxidation,[3,14,73,74] and improves the gut epithelium by modulating the PXR pathway.[13,20,75,103] PXR is considered a drug target for inflammatory bowel disease.[104,105]

Improvement in gut epithelial barrier integrity, reduction of inflammation, and antioxidant action are all linked to improved gut health in dogs.[90,106-109] The Strain 1 Postbiotic Fermentate Mixture contains components that can be readily converted into IPA in vitro by microbes present in the canine gut microbiome. As such, production of IPA in the gut can promote gut health through IPA-dependent mechanisms.

Upregulation of TNF-α and IFN-γ plays a significant role in gut inflammation.[110,111] IFN-γ and TNF-α decrease serotonin transporter function in intestinal cells, potentially contributing to altered motility in inflammatory bowel disorders.[112] TNF-α may act as a cofactor for mucosal Th1 responses, and its neutralization can down-regulate mucosal Th1 cytokines in Crohn's disease.[113] IFN-γ is also involved in the development of intestinal inflammation in animal models.[114] Some studies have found increased expression of pro-inflammatory cytokines, including IFN-γ and TNF-α, in dogs with IBD compared to healthy controls.[115,116] We have demonstrated that our ingredient reduces the release of TNF-α and IFN-γ in vitro; therefore the Strain 1 Postbiotic Fermentate Mixture can promote gut health by modulating inflammation.

Gut health in dogs is linked to their overall immune function, and antioxidants are involved in maintaining a balanced immune system.[117] Antioxidants help protect the gut lining from oxidative stress caused by free radicals, which can result from poor diet, inflammation, or environmental stressors.[118-123] By neutralizing these harmful molecules, antioxidants support the integrity of the gut epithelial barrier, preventing harmful substances from entering the bloodstream.[118-123] Additionally, antioxidants can positively influence the gut microbiome by promoting the growth of beneficial bacteria, which further enhances digestive health and reduces inflammation.[90,119,124,125] The Strain 1 Postbiotic Fermentate Mixture possesses antioxidant potential, at least by serving as a substrate for IPA production in the gut. Additionally, AhR can influence the Nrf2 pathway, which regulates the expression of antioxidant response genes, thereby enhancing antioxidant activity.[40,126,127]

As one example, it is likely that AhR activation drives the downregulation of pro-inflammatory cytokines.[128-131] As another example, the ingredient itself has antioxidant activity, the potential of which can be further enhanced by conversion of metabolites into IPA, a known antioxidant, and activation of the Nrf2 pathway. The Strain 1 Postbiotic Fermentate Mixture can promote gut health in dogs through several distinct mechanisms, which collectively have the potential to maintain gut epithelial barrier integrity, promote a healthy gut microbiome, and ensure healthy immune and inflammatory responses in the gut. Example 16 provides a double-blind, placebo-controlled study design to measure these benefits.

Example 10: Use of Postbiotic Fermentate Mixtures in Food Allergy and Intolerance Food allergies in dogs occur when their immune system reacts abnormally to certain dietary proteins, leading to symptoms such as itchy skin and gastrointestinal distress. The Strain 1 Postbiotic Fermentate Mixture contains bioactive metabolites that activate the aryl hydrocarbon receptor (AhR). AhR plays an important role in modulating immune responses, reducing inflammation, and promoting epithelial barrier integrity across various tissues, including those affected by food allergies. Therefore, the Strain 1 Postbiotic Fermentate Mixture is expected to promote a healthy immune system and inflammatory response in the context of food allergies in dogs.

Food allergies in dogs occur when their immune system misidentifies certain dietary proteins as harmful, triggering an abnormal immune response.[132] Common allergens in dogs include beef, dairy, chicken, and wheat products.[133-135] Food allergies are often linked to overproduction of antibodies like IgE, leading to inflammation and discomfort. Clinical symptoms typically involve pruritic skin conditions and gastrointestinal symptoms such as vomiting or diarrhea.[132,134] There is no clear breed, sex, or age predisposition to food allergies.[132] Food allergies should be distinguished from food intolerances, which do not involve an immune response but may present similar symptoms in dogs.[132]

AhR plays a significant role in immune system function and allergic responses, including food allergies. AhR activation has been shown to suppress allergic sensitization in animal models by modulating regulatory T cell populations and dendritic cell functions.[136,137] AhR activation can also suppress the development of Th2-mediated food allergic responses in mice, suggesting therapeutic applications of AhR activation.[136,137] The role of AhR in immune regulation extends to other cell types, including mast cells, which are involved in allergic responses.[138,139] Moreover, AhR responds to various environmental toxins, dietary ligands, and allergens to regulate immune responses in allergic diseases,[140] and certain food factors can act as AhR antagonists, suppressing AhR activation.[141]

AhR is involved in the maintenance of healthy skin and gut function through regulation of epithelial barrier integrity and homeostasis. In the skin, AhR regulates keratinocyte differentiation, downregulates proinflammatory cytokines, promotes barrier repair, and maintains intercellular connectivity.[127,142-144] In the gut, AhR activation protects against inflammatory damage by regulating intestinal stem cell proliferation and differentiation, by upregulating tight junction proteins, and by inhibiting inflammatory signaling.[45,77,79,80] AhR signaling is also essential for intraepithelial lymphocyte maintenance in both the skin and intestine, which protect against epithelial damage.[145] In brief, AhR regulates inflammation thus promoting overall skin and gut health, and therefore can mitigate common skin and digestive symptoms associated with food allergies.

The AhR pathway is involved in suppressing allergic sensitization to food, modulating the immune response to allergens, and regulating the inflammatory responses related to the most common symptoms of food allergies in dogs: itching and gastrointestinal distress. Taken together, the evidence indicates that the Strain 1 Postbiotic Fermentate Mixture, containing AhR agonists, is expected to promote healthy immune and inflammatory responses in the context of food allergies in dogs. Example 17 provides a double-blind, placebo-controlled study design to measure these benefits.

Example 11: Use of Postbiotic Fermentate Mixtures in Gum Health

Gum inflammation is associated with suboptimal oral hygiene and can result in gum redness, swelling, pain, and bleeding in both dogs and humans. However, gum health can be impacted by modulating inflammation, ensuring tissue integrity, and reducing oxidative stress. The Strain 1 Postbiotic Fermentate Mixture has been shown to reduce key biomarkers of gum inflammation, to activate the aryl hydrocarbon receptor (AhR), which is known to support epithelial barrier integrity, and to possess antioxidant activity. Therefore, the Strain 1 Postbiotic Fermentate Mixture is expected to promote gum health in dogs and humans.

Gingivitis is a common gum disease in dogs and humans characterized by irritation, redness, and swelling around the base of the teeth.[146-149] Poor oral hygiene typically causes this condition by allowing plaque, a sticky film of bacteria, to accumulate on the teeth.[146-148] If not removed, plaque hardens into tartar, intensifying gum irritation. Bacteria in plaque and tartar release toxins and enzymes that trigger an immune response, leading to inflammation.[146,147] As immune cells work to defend against infection, they release molecules that increase blood flow to the gums causing them to become red, swollen, sensitive, and prone to bleeding during brushing or flossing.[146,147] Without treatment, this persistent inflammation can result in gum tissue breakdown, heightening the risk of more advanced periodontal disease.[146,147]

Several pro-inflammatory cytokines have been shown to be elevated in gum inflammation: TNF-$\alpha$, IFN-$\gamma$, and IL-2.[150-156] These cytokines are produced as part of the immune response to bacterial challenges in the oral cavity.[146] Disruption of AhR signaling by pathogens like *Porphyromonas gingivalis* also triggers high levels of inflammatory biomarkers, further exacerbating inflammation and expediting bone loss.[157] When AhR signaling is compromised, TNF-$\alpha$ levels increase, amplifying immune cell recruitment and further intensifying inflammation; however, AhR activation can downregulate TNF-$\alpha$ production, thereby reducing immune cell infiltration and moderating the intensity of the inflammatory response.[158-160] IFN-$\gamma$ activates macrophages and enhances immune defenses, but excessive IFN-$\gamma$ can worsen tissue damage; AhR activation helps to maintain this balance.[129,154,160-162] IL-2 regulates the development and homeostasis of various T cells.[163] In the context of gingivitis, an increased abundance of T cells and their infiltration in gum tissue has been linked to loss of tissue integrity, which can lead to bone resorption.[164,165] The Strain 1 Postbiotic Fermentate Mixture activates canine AhR and downregulates production of pro-inflammatory cytokines (TNF-$\alpha$, IFN-$\gamma$, and IL-2) in vitro. In brief, when activated by ligands such as the ones in the Strain 1 Postbiotic Fermentate Mixture, AhR can mitigate harmful effects of the inflammatory response, thus promoting gum health.

Chronic inflammation in gingivitis leads to tissue breakdown, as immune responses, initially protective, become damaging over time.[146] For instance, neutrophils, key effector cells in inflammation, infiltrate the gum epithelium and release reactive oxygen species (ROS) and matrix metalloproteinases (MMPs), like MMP-8.[166-168] While these molecules combat bacterial infection, they also degrade collagen and extracellular matrix, weakening the gum tissue and increasing susceptibility to further damage.[146,169] AhR promotes maintenance of epithelial barrier integrity across various tissues.[77,142,170-172] AhR activation preserves epithelial barrier integrity by regulating epithelial cell differentiation, strengthening intercellular connections, modulating paracellular permeability, and limiting immune cell infiltration.[77,80,142,173,174] This barrier function contributes to protecting against bacterial invasion and regulating inflammatory responses.[175] In sum, AhR activation is well-known to maintain epithelial barrier integrity, which supports gum health. Combined with the evidence that the Strain 1 Postbiotic Fermentate Mixture can activate canine AhR in vitro, this suggests potential benefits for promoting gum health.

Antioxidants, such as those present in fermentate mixtures or produced by metabolism of fermentate mixtures, also contribute to improving gum health. Individuals with gum diseases such as gingivitis often have lower salivary antioxidant levels and increased oxidative stress in the gum.[161-176] Antioxidant supplementation has been shown to enhance gum health by increasing salivary antioxidant capacity, including boosting levels of uric acid, a key antioxidant in saliva.[177,178] Glutathione, a potent antioxidant, plays an important role in managing inflammation in the gums.[179] Various methods, such as oral supplements and topical applications, have been explored to counteract oxidative stress in the oral cavity.[180,181] Research indicates that incorporating antioxidants into daily oral care can support healthier gums by reducing oxidative damage and enhancing the body's natural defense mechanisms.[182-184] The Strain 1 Postbiotic Fermentate Mixture possesses antioxidant activity in vitro, and as such can improve gum health through its antioxidant action.

Gum health in humans and dogs is impacted by inflammation, epithelial tissue integrity, and antioxidant levels. The Strain 1 Postbiotic Fermentate Mixture was (1) shown to reduce key biomarkers of gum inflammation (e.g., in Example 3), (2) shown to activate AhR (e.g., in Example 2), which is known to support epithelial barrier integrity, and (3) shown to possess antioxidant activity (e.g., in Example 4). Taken together, this evidence indicates that the Strain 1 Postbiotic Fermentate Mixture is expected to promote gum health in both humans and dogs. Example 18 provides a double-blind, placebo-controlled study design to measure these benefits.

Example 12: Use of Postbiotic Fermentate Mixtures in Healthy Aging

Healthy aging in dogs centers on preserving mobility, physiological function, and cognition throughout their natural lifespan. The Strain 1 Postbiotic Fermentate Mixture contains bioactive metabolites that are shown to activate the aryl hydrocarbon receptor (AhR) and to be readily converted into indole-3-propionic acid (IPA) by microbes of the canine gut microbiome, and consequently can increase serum levels of IPA. These mechanisms can help reduce weight gain, improve metabolic health, and protect against chronic neuroinflammation, which in turn can impact mobility, physiological function, and cognition. Therefore, the Strain 1 Postbiotic Fermentate Mixture is expected to promote healthy aging in dogs.

Healthy aging in dogs involves maintaining their mobility, physiological health, and cognitive function as they grow older.[185,187] It focuses on improving quality of life during their natural lifespan, ensuring they remain active and engaged. Mobility can decline due to the natural wear and tear in joints, leading to conditions like osteoarthritis, which causes discomfort, and even pain, during movement.[188-191] Physiological health, including immune, metabolic, and cardiac functions, may deteriorate with age as organ tissues experience senescence and are altered due to oxidative stress.[192-195] Cognitive function can also decline, often attributed to the oxidative stress and other immunity-related mechanisms in the brain, contributing to canine cognitive dysfunction syndrome.[196-198] Supporting healthy aging in dogs typically involves regular exercise tailored to their abilities, providing a nutrient-rich diet, and mental stimulation. Preserving mobility enables aging dogs to remain active and maintain a high quality of life.[199,200] With age, the natural wear and tear on joints becomes more pronounced, often leading to conditions like osteoarthritis.[188-190] This degenerative process affects the cartilage that cushions joints, resulting in stiffness, discomfort, and even pain during movement.[188-190] The process not only impacts a dog's ability to move freely, but can also contribute to a decline in overall health as activity levels decrease.[191,200,201] One of the most effective ways to minimize the risk of joint problems is through weight management.[190,199] Excess weight increases strain on the joints, accelerating the natural degeneration of cartilage and contributing to mobility issues. Reducing weight can limit stress on the joints, thus lowering the risk of painful conditions. Example 8 outlines how the Strain 1 Postbiotic Fermentate Mixture can promote a healthy weight in dogs, which ultimately supports healthier aging.

As dogs age, several physiological functions begin to decline, including immune, metabolic, and cardiovascular functions.[192,194,195,202] The weakening of the immune system results in reduced ability to fight infections, slower wound healing, and increased susceptibility to diseases.[203] Metabolically, aging results in less efficient energy production, slower fat metabolism, and impaired blood sugar regulation, contributing to weight gain and increasing the risk of metabolic disorders.[202,204] Chronic inflammation has been implicated in the aging process and is believed to exacerbate the decline of various physiological functions.[193,205] Notably, evidence suggests that modulating the immune response via AhR activation with indoles, a property of the Strain 1 Postbiotic Fermentate Mixture, reduces systemic inflammation and can increase healthspan in diverse experimental models.[206] Example 8 discusses in more detail how the Strain 1 Postbiotic Fermentate Mixture can promote metabolic health in dogs through modulating inflammation. Collectively, these considerations suggest that the Strain 1 Postbiotic Fermentate Mixture can help support normal physiological functions during aging in dogs.

Chronic Neuroinflammation and Cognition

Aged-related decline of cognitive functions in dogs is associated with chronic neuroinflammation.[207-209] Chronic neuroinflammation is characterized by a low-grade, yet persistent activation of immune cells in the central nervous system.[209-211] This persistent activation leads to a sustained release of pro-inflammatory cytokines (TNF-α, IFN-γ, IL-1β, and IL-6) by microglia, causing neuronal stress and damage, and of glutamate and reactive oxygen species (ROS) by astrocytes, exacerbating excitotoxicity and oxidative stress.[212-218] Inflammation and oxidative stress are thus directly linked to neurodegeneration, and have been shown to exacerbate the accumulation of beta-amyloid plaques in the brain, which is thought to increase the risk of canine cognitive dysfunction syndrome (CCDS).[209,214,217,219-221] CCDS is akin to Alzheimer's in humans and characterized by behavioral changes, memory loss, disorientation, and altered interactions with their environment or owners.[214,217,222,223] In addition, chronic systemic inflammation and reactive oxygen species weaken the blood-brain barrier, allowing peripheral immune cells and inflammatory mediators to infiltrate the central nervous system.[88,224,225] This exacerbates chronic neuroinflammation, creating a positive feedback loop of neuronal damage and inflammation. Curbing chronic neuroinflammation throughout life could therefore limit neurodegeneration and preserve cognitive functions in older dogs,[207,219,226] and the Strain 1 Postbiotic Fermentate Mixture is expected to promote cognitive health through multiple mechanisms.

Chronic Neuroinflammation and AhR

Increased levels of pro-inflammatory cytokines, such as TNF-α and IFN-γ, is an indicator of chronic neuroinflammation and has been linked to neurodegenerative disorders in humans.[212,213,215,216,227] In this context, AhR activation inhibits the activation of the NF-κB signaling pathway, reducing expression of these pro-inflammatory cytokines and thus reducing neuroinflammation.[228-231] In addition to their direct role in neurodegeneration, TNF-α and IFN-γ contribute to blood-brain barrier disruption by downregulating tight junction proteins, inducing apoptosis in endothelial cells and upregulating matrix metalloproteinases, further enhancing neuroinflammation.[232-235] AhR signaling can therefore mitigate blood-brain barrier disruption by reducing levels of pro-inflammatory cytokines. The Strain 1 Postbiotic Fermentate Mixture activates canine AhR and reduces the release of TNF-α and IFN-γ in vitro, and as is expected to promote cognitive health through AhR-dependent mechanisms.

Chronic Neuroinflammation and IPA

The neuroprotective benefits of IPA have been shown directly in the context of neurodegeneration.[3] IPA can cross the blood-brain barrier and counteract oxidative stress directly inside the brain.[11] The expression of IPA was observed to be significantly reduced in Alzheimer's patients.[236] IPA protects neurons against Alzheimer's-related toxicity[8,237,238] and against oxidative stress in the ischemic hippocampus.[14] Notably, in an elderly human population, IPA was shown to protect microglia from inflammation, thus promoting neuronal function.[8] IPA demonstrates potent anti-inflammatory effects by inhibiting NF-κB signaling and reducing pro-inflammatory cytokines.[3,72,73] IPA also exhibits potent antioxidant properties by decreasing reactive oxygen species and lipid peroxidation.[3,14,73-74] Altogether, the evidence suggests that IPA helps maintain blood-brain barrier integrity and mitigates damage to neurons by reducing inflammation and oxidative stress. the Strain 1 Postbiotic Fermentate Mixture can be readily converted into IPA by microbes present in the canine gut microbiome in vitro, and as such is expected to promote cognitive health through IPA-dependent mechanisms.

The Strain 1 Postbiotic Fermentate Mixture can influence three aspects of healthy aging: mobility, physiological health, and cognitive function. The Strain 1 Postbiotic Fermentate Mixture can impact mobility by aiding in weight management, while its influence on metabolic health helps maintain normal physiological processes over a dog's natural lifespan. Additionally, the Strain 1 Postbiotic Fermentate Mixture can support cognitive function by mitigating chronic neuroinflammation. By simultaneously addressing these interconnected facets of aging, the Strain 1 Postbiotic Fermentate Mixture demonstrates potential to support overall healthy aging.

Example 13: Use of Postbiotic Fermentate Mixtures in Calming

Anxiety in dogs is a common behavioral issue that can manifest as excessive barking, pacing, trembling, aggressive behavior, destructive behavior, or withdrawal. It may stem from various causes, including separation from their owners, fear of loud noises, or changes in their environment. Chronic anxiety not only affects a dog's mental state but can also lead to physical health issues such as digestive problems, weakened immunity, and long-term behavioral challenges.

Chronic neuroinflammation has been strongly associated with chronic anxiety; reducing chronic neuroinflammation has been shown to reduce symptoms associated with anxiety on a timescale of weeks to months.[239-244] Additionally, fermentates of bacterial strains described herein were also found to contain compounds such as tryptophan, GABA, melatonin, and 5-HT, which are known to have short-term calming effects, providing relief in acute situations while supporting overall well-being. The presence of these compounds in fermentates of bacterial strains described herein, such as Strains 1-7, suggests that compositions containing such fermentates, including the Strain 1 Postbiotic Fermentate Mixture, are useful in alleviating anxiety. Examples 19 (short-term calming) and 20 (long-term calming) provide a double-blind, placebo-controlled study design to measure these benefits.

Example 14: Weight Loss in Dogs Following Administration of a Mixture of Fermentates of Strain 1

A double-blind, placebo-controlled study is conducted to evaluate the efficacy of the postbiotic of Example 2, containing the first and second fermentates of Strain 1, in helping dogs with weight loss. Forty dogs, evenly divided into postbiotic and placebo groups, participate over 104 days, including a 14-day baseline observation phase (Day −14 to 0) and a 90-day treatment phase (Day 1 to 90). All dogs recruited for this study are at least overweight, defined as being at least 10% above ideal body weight. The postbiotic or placebo is administered twice daily as a meal topper, with stratified randomization ensuring balanced groups by sex and baseline body score condition.

Dogs are weighted every week for the duration of the study, and the absolute and relative weight loss, as well as the rate of weight loss, are calculated. The body score condition is evaluated on Day −14, 0, 30, 60 and 90. On Day 0 and 90, blood samples are collected and the following biomarkers are quantified in the blood: IL-1β, IL-6, TNF-α, C-reactive protein, total cholesterol, total triglyceride, creatinine, alanine aminotransferase, aspartate aminotransferase, alkaline phosphatase, lactate dehydrogenase, blood urea nitrogen, glucose, total protein, nonesterified fatty acids, malondialdehyde, insulin, leptin, GLP-1, glucagon, and thyroid-related compounds. On Day 0 and 90, dual-energy X-ray absorptiometry (DEXA) is performed to assess fat tissue and lean mass changes.

Example 15: Weight Maintenance in Dogs Following Administration of a Mixture of Fermentates of Strain 1

A double-blind, placebo-controlled study is conducted to evaluate the efficacy of the postbiotic of Example 2, containing the first and second fermentates of Strain 1, in helping dogs with weight maintenance. Forty dogs, evenly divided into postbiotic and placebo groups, participate over 104 days, including a 14-day baseline observation phase (Day −14 to 0) and a 90-day treatment phase (Day 1 to 90). All dogs recruited for this study are of normal weight. The postbiotic or placebo is administered twice daily as a meal topper, with stratified randomization ensuring balanced groups by sex and baseline body score condition. For the duration of the treatment phase, all dogs receive a daily amount of food in a caloric excess of approximately 5-15% over their individual target daily caloric intake. National Research Council. 2006. Nutrient Requirements of Dogs and Cats. Washington, DC: The National Academies Press. doi: 10.17226/10668.

Dogs are weighted every week for the duration of the study, and the absolute and relative weight loss as well as the rate of weight loss are calculated. The body score condition is evaluated on Day −14, 0, 30, 60, and 90. On Day 0 and 90, blood samples are collected and the following biomarkers are quantified in the serum: IL-1β, IL-6, TNF-α, C-reactive protein, total cholesterol, total triglyceride, creatinine, alanine aminotransferase, aspartate aminotransferase, alkaline phosphatase, lactate dehydrogenase, blood urea nitrogen, glucose, total protein, nonesterified fatty acids, malondialdehyde, insulin, leptin, GLP-1, glucagon, and thyroid-related compounds.

Example 16: Improvement of Gut Health in Dogs Following Administration of a Mixture of Fermentates of Strain 1

A double-blind, placebo-controlled study is conducted to evaluate the efficacy of the postbiotic of Example 2, containing the first and second fermentates of Strain 1, in improving gut health in dogs. Forty dogs, evenly divided into postbiotic and placebo groups, participate over 35 days, including a 7-day baseline observation phase (Day −7 to 0) and a 28-day treatment phase (Day 1 to 28). All dogs recruited for this study have loose stool (Waltham fecal score above 3), are of normal weight and otherwise healthy. The postbiotic or placebo is administered twice daily as a meal topper, with stratified randomization ensuring balanced groups by sex and baseline Waltham fecal score.

The stool quality is assessed weekly using the Waltham fecal score. On Day 0 and 28, fecal samples are collected and the following biomarkers are quantified: calprotectin, indole compounds, including indole-3-propionic acid, short-chain fatty acids, including propionate, acetate and butyrate, fecal pH, primary bile acids, and secondary bile acids. The same fecal samples are also used to perform fecal metagenomic analysis to characterize the gut microbiome.

Examples of outcomes indicating improved gut health relative to baseline include, without limitation:
Stools with Waltham fecal score of 2.5;
Absence of diarrhea;
Regular defecation;
Reduced fecal calprotectin;
Increased indole-3-propionic acid;
Increased propionate;
Increased butyrate;
Increased microbial ZOTU richness;
Increased microbial ZOTU evenness; and
Increased microbial ZOTU diversity as measured by Shannon index.

Example 17: Reduction in Food Allergy and Food Intolerance in Dogs Following Administration of a Mixture of Fermentates of Strain 1

A double-blind, placebo-controlled study is conducted to evaluate the efficacy of the postbiotic of Example 2, containing the first and second fermentates of Strain 1, in preventing adverse reaction to changes in the diet of dogs. Forty dogs, evenly divided into postbiotic and placebo groups, participate over 35 days, including a 7-day baseline observation phase (Day −7 to 0), a 14-day pre-diet-change phase (Day 1 to 14), and a 14-day post-diet-change phase (Day 15 to 28). During the pre-diet-change and post-dietchange phases, the postbiotic or placebo is administered twice daily as a meal topper, with stratified randomization ensuring balanced groups by sex. All dogs receive their standard diet during the baseline observation phase and pre-diet-change phase. All dogs are changed to a new diet for the post-diet-change phase.

The stool quality is assessed daily using the Waltham fecal score. On Day 0, 14 and 28, fecal samples are collected and the following biomarkers are quantified: calprotectin, indole compounds, including indole-3-propionic acid, short-chain fatty acids, including propionate, acetate and butyrate, fecal pH, primary bile acids, and secondary bile acids. The same samples are also used to perform fecal metagenomic analysis to characterize the gut microbiome.

Examples of outcomes indicating alleviation or inhibition of food allergy relative to baseline include, without limitation:
Stools with Waltham fecal score of 2.5;
Absence of diarrhea;
Regular defecation;
Reduced fecal calprotectin;
Increased indole-3-propionic acid;
Increased propionate;
Increased butyrate;
Increased microbial ZOTU richness;
Increased microbial ZOTU evenness;
Increased microbial ZOTU diversity as measured by Shannon index;
Absence of vomiting;
Reduced severity or frequency of itching;
Disappearance of bald spots;
Reduction in serum concentration of IgE;
Reduction in serum concentration of IgG;
Reduction in serum concentration(s) of pro-inflammatory cytokines, including IL-1β, IL-6, TNF-α;
Reduction in serum concentration(s) of cytokines including IL-8, IL-17, IL-2, and IFN-γ.

Examples of outcomes indicating alleviation or inhibition of food intolerance relative to baseline include, without limitation:
Stools with Waltham fecal score of 2.5;
Absence of diarrhea;
Regular defecation;
Reduced fecal calprotectin;
Increased indole-3-propionic acid;
Increased propionate;
Increased butyrate;
Increased microbial ZOTU richness;
Increased microbial ZOTU evenness;
Increased microbial ZOTU diversity as measured by Shannon index;
Reduction in serum concentration(s) of pro-inflammatory cytokines, including IL-1β, IL-6, TNF-α;
Reduction in serum concentration(s) of cytokines including IL-8, IL-17, IL-2, and IFN-γ.

Example 18: Reduction in Gum Inflammation in Humans Following Administration of a Mixture of Fermentates of Strain 1

A double-blind, placebo-controlled study is conducted to evaluate the efficacy of the postbiotic of Example 2, containing the first and second fermentates of Strain 1, in reducing gum inflammation in humans. Thirty participants, evenly divided into postbiotic and placebo groups, participate over 42 days, including a 14-day baseline observation phase (Day −14 to 0) and a 28-day treatment phase (Day 1 to 28). All participants recruited for this study exhibit signs of gum inflammation as assessed by a dental professional. The postbiotic or placebo is administered twice daily for 60 seconds as a mouthwash, with stratified randomization ensuring balanced groups by sex and baseline Modified Gingival Index. See, e.g., He et al., *J Clin Dent.* 2018. 29(2):45-51; Zini et al., *J Clin Dent.* 2018. 29(2):64-68. On Day −14, 0, and 28, participants undergo an oral examination, including measurements of gingival index.

Example 19: Short-Term Calming in Dogs Following Administration of a Mixture of Fermentates of Strain 1

A double-blind, placebo-controlled study is conducted to evaluate the efficacy of the postbiotic of Example 2, containing the first and second fermentates of Strain 1, in calming dogs. Sixty dogs, evenly divided into two groups, participate over a period of 6 months. All dogs recruited for this study show anxious behavior during car travel as reported by their owner. A cross-over design is used in this study such that each dog receives both the postbiotic and the placebo treatments 3 times following a sequence determined by their group; a total of 6 treatments over the duration of the study. The postbiotic or placebo is administered 2 hours before a car ride as a meal topper, with stratified randomization ensuring balanced groups by sex and baseline behavioural score. After each car travel, the pet owners complete a canine behavioral questionnaire (e.g., C-BARQ) to assess the anxious behaviour of their dog during car travel.

Example 20: Long-Term Calming in Dogs Following Administration of a Mixture of Fermentates of Strain 1

A double-blind, placebo-controlled study is conducted to evaluate the efficacy of the postbiotic of Example 2, containing the first and second fermentates of Strain 1, in calming dogs. Sixty dogs, evenly divided into postbiotic and placebo groups, participate over 42 days, including a 14-day baseline observation phase (Day −14 to 0) and a 28-day treatment phase (Day 1 to 28). All dogs recruited for this study show anxious, fearful, or aggressive behaviors as reported by their owner. The postbiotic or placebo is administered twice daily as a meal topper, with stratified randomization ensuring balanced groups by sex and baseline behavioral score. On Day −7, 0 and 28, the pet owners complete the Canine Behavioral Assessment and Research Questionnaire (C-BARQ) that characterizes behaviours related to fear, anxiety, aggression, and excitability. For the duration of the study, all dogs are outfitted with a wearable activity tracker to quantitatively measure anxious behaviors, physical activity behaviors, and sleep-related patterns.

Example 21: Fermentation of Strain 1 in Separate Fermentations for Production of Fermentate Mixtures Including Desired Ratios of ILA and IAld A bacterial strain as described in Example 1, belonging to *Pediococcus acidilactici*, having a 16S rRNA gene sequence of SEQ ID NO: 1 and genome of SEQ ID NO: 8, were fermented under varying conditions to produce fermentates having differing amounts of ILA and IAld.

| Fermentate | Oxygenation | [Tryptophan] (g/L) | [Glucose] (g/L) | Other Component(s) |
|---|---|---|---|---|
| A1 | Microaerobic | 1-50 | 4-200 | Manganese, and optionally polysorbate 80 and/or vitamin B12 |
| B | Aerobic | 1-50 | 4-200 | Manganese, and optionally polysorbate 80 and/or vitamin B12 |
| A2 | Aerobic | 1-50 | 4-200 | Manganese, and optionally polysorbate 80 and/or vitamin B12 |
| C | Aerobic | 1-50 | <4 | No detectable polysorbate 80; No detectable manganese; No detectable vitamin B12 |

Fermentates produced by fermentation under different conditions were combined to prepare fermentate mixtures having desired amounts of ILA and IAld. As one example, a first fermentate mixture was made by combining Fermentate A1 and Fermentate B. As another example a second fermentate mixture was made by combining Fermentate A2 and Fermentate C.

Example 22: Fermentation of Strain 1 in Varying Conditions for Production of Fermentates Having Differing Relative Amounts of ILA and IAld A bacterial strain as described in Example 1, belonging to *Pediococcus acidilactici*, having a 16S rRNA gene sequence of SEQ ID NO: 1 and genome of SEQ ID NO: 8, was fermented under varying conditions to produce fermentates having differing amounts of ILA and IAld.

Both processes used similar amounts of tryptophan, the substrate from which the bacterium produces indole-containing compounds including ILA and IAld.

Despite *Pediococcus acidilactici* being a facultative anaerobe, the presence of oxygen was found to be necessary for production of IAld, and so fermentation in aerobic conditions allows for increased IAld production in the second fermentate.

In one experiment, the effects of glucose and nitrogen concentrations were evaluated by fermentations in media containing 15-200 g/L carbon source and 15-60 g/L nitrogen source(s), under aerobic conditions, for seven days. Carbon sources such as glucose serve as energy supplies in microbial fermentation, driving metabolic processes including cell growth and division. Carbon sources include simple sugars (e.g., glucose, sucrose) and complex carbohydrates (e.g., starch, cellulose), which may be metabolized to produce adenosine triphosphate (ATP) and reducing power required for biosynthetic pathways. Additionally, carbon sources contribute to the synthesis of macromolecules, such as lipids and carbohydrates, which support cellular structure and function. Nitrogen sources provide nitrogen required for synthesis of amino acids, proteins, nucleic acids, and other nitrogen-containing compounds that contribute to microbial growth and metabolism. Nitrogen sources may be inorganic (e.g., ammonium salts, nitrates) or organic (e.g., yeast extract, peptones). In this Example, the carbon source evaluated was glucose, while a combination of peptones and yeast extract served as the nitrogen source.

Figure 13A:
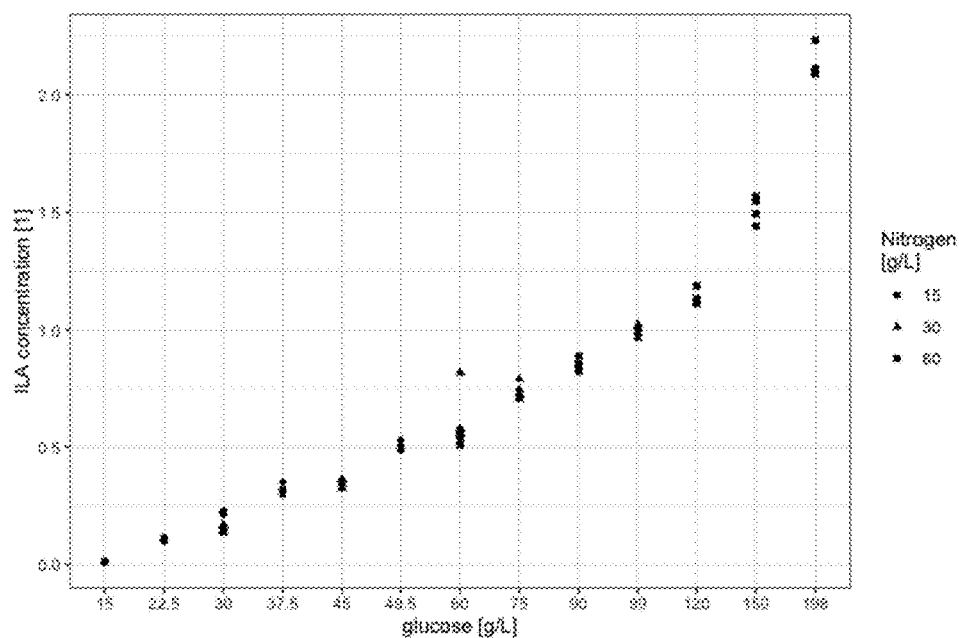
FIG. 13A shows relative concentrations of ILA produced in conditions with varying concentrations of glucose and nitrogen sources (e.g., yeast extract and peptones).

ILA concentration was found to correlate with the glucose concentration in fermentation media (FIG. 13A). Consequently, it was determined that the amount of ILA in a fermentate may be modulated by varying glucose concentrations during fermentation. Accordingly, the higher concentrations of glucose (100 to 200 g/L) in a first fermentation medium allow for increased ILA production, whereas lower concentrations in the second fermentation medium allow for lower ILA production.

Figure 13B:
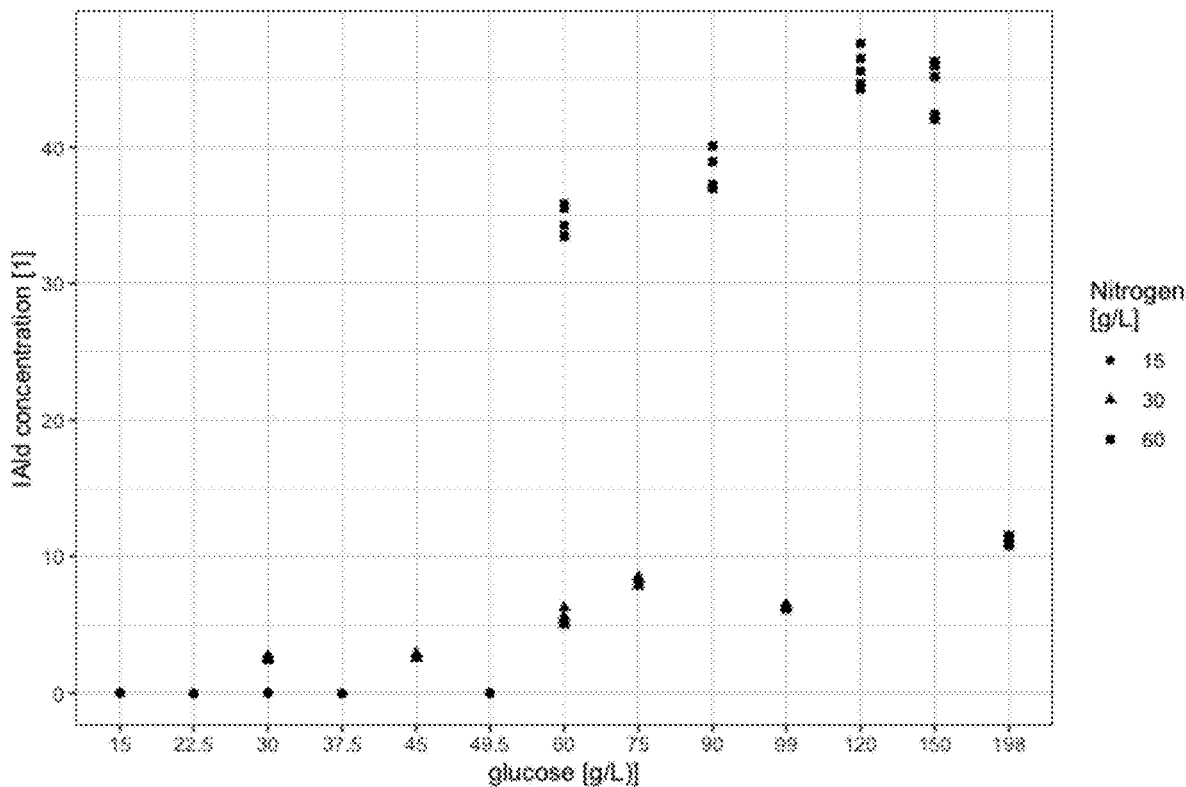
FIG. 13B shows relative concentrations of IAld produced in conditions with varying concentrations of glucose and nitrogen sources (e.g., yeast extract and peptones).

Production of IAld, but not ILA, was found to correlate with the nitrogen source concentration in fermentation media (FIGS. 13A-13B). Consequently, it was determined that the amount of IAld in a fermentate may be increased by increasing the concentration of nitrogen sources, such as yeast extract and peptones. Additionally, while limiting glucose concentration below 4 g/L as described in Example 1 increased IAld concentration compared to 4-7 g/L, this also limited the amount of carbon available for bacterial metabolism. It was further determined that substantial IAld production could be achieved by providing glucose in amounts larger than 4 g, in combination with nitrogen. Accordingly, a second fermentation medium, containing lower concentrations of glucose (1 to 100 g/L, v. 100 to 200 gL) but higher concentrations of the nitrogen source (125 to 200 g/L, v. 10 to 125 g/L), allows for increased IAld production and reduced ILA production, relative to the first fermentate.

From the results of the above experiment, separate fermentation media were prepared. The first fermentation medium, for production of ILA under microaerobic conditions, contained:
1 g/L to 50 g/L tryptophan;
100 g/L to 200 g/L glucose; and
10 g/L to 125 g/L of a nitrogen source (e.g., yeast extract or peptone).

The second fermentation medium, for production of IAld under aerobic conditions, contained:
1 g/L to 50 g/L tryptophan;
1 g/L to 100 g/L glucose; and
125 g/L to 200 g/L of a nitrogen source (e.g., yeast extract or peptone).

Figure 14A:
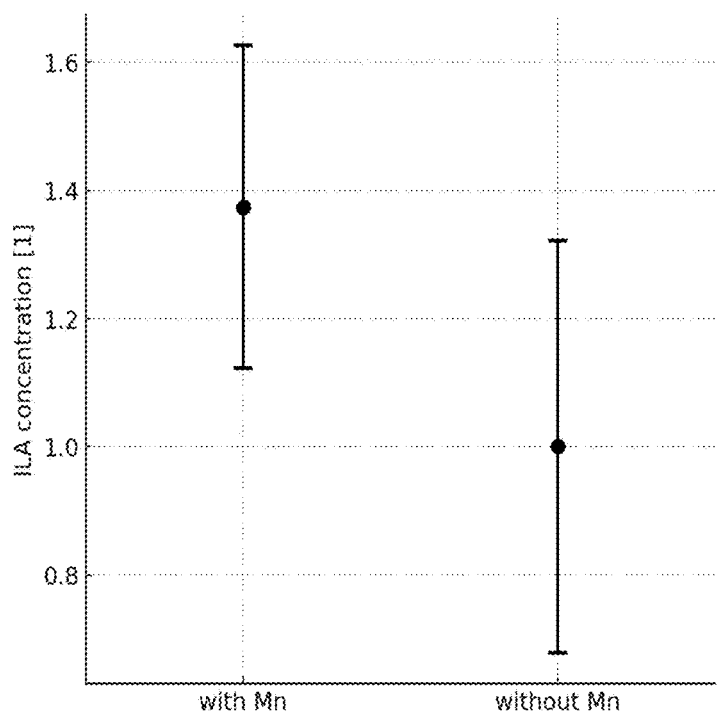
FIG. 14A shows relative concentrations of ILA produced in the presence or absence of manganese.
Figure 14B:
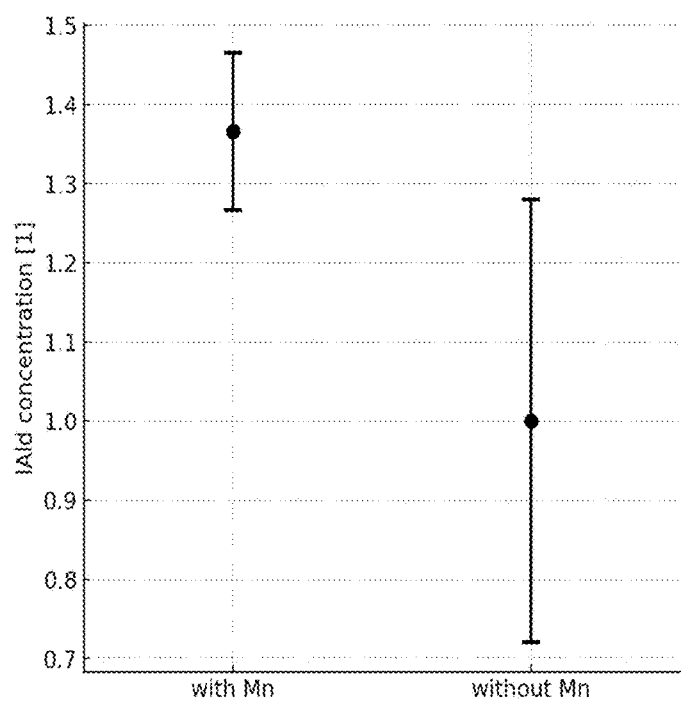
FIG. 14B shows relative concentrations of IAld produced in the presence or absence of manganese.

In another experiment, the effect of manganese was evaluated by fermentations under the conditions listed above for ILA production or IAld production, varying only the presence or absence of manganese. In the first fermentation conditions (microaerobic, 1 g/L to 50 g/L tryptophan, 100 g/L to 200 g/L glucose, 10 g/L to 125 g/L nitrogen source(s)), the presence of manganese (0.1 g/L to 1 g/L) increased ILA production by 37% (FIG. 14A). Similarly, in the second fermentation conditions (aerobic, 1 g/L to 50 g/L tryptophan, 1 g/L to 100 g/L glucose, 125 g/L to 200 g/L nitrogen source(s)), the presence of manganese (0.1 g/L to 1 g/L) increased IAld production by 37% (FIG. 14B). Accordingly, each of the first and second fermentation media were supplemented with 0.1 g/L to 1 g/L manganese.

Taken together, these results demonstrate the usefulness of fermenting bacteria (e.g., *Pediococcus acidilactici*) in multiple separate fermentations that favor different pathways of tryptophan metabolism, allowing enhanced control over the relative amounts of such metabolites in a final mixture of separate fermentates.

REFERENCES

1. Dodd, D. et al. A gut bacterial pathway metabolizes aromatic amino acids into nine circulating metabolites. *Nature* 551, 648-652 (2017).

2. Jiang, H., Chen, C. & Gao, J. Extensive Summary of the Important Roles of Indole Propionic Acid, a Gut Microbial Metabolite in Host Health and Disease. *Nutrients* 15, 151 (2022).
3. Konopelski, P. & Mogilnicka, I. Biological Effects of Indole-3-Propionic Acid, a Gut Microbiota-Derived Metabolite, and Its Precursor Tryptophan in Mammals' Health and Disease. *Int. J. Mol. Sci.* 23, 1222 (2022).
4. Floc'h, N. L., Otten, W. & Merlot, E. Tryptophan metabolism, from nutrition to potential therapeutic applications. *Amino Acids* 41, 1195-1205 (2011).
5. Liu, Y. et al. *Clostridium sporogenes* uses reductive Stickland metabolism in the gut to generate ATP and produce circulating metabolites. *Nat. Microbiol.* 7, 695-706 (2022).
6. Sinha, A. K. et al. Dietary fibre directs microbial tryptophan metabolism via metabolic interactions in the gut microbiota. Nat. Microbiol. 9, 1964-1978 (2024).
7. Alexeev, E. E. et al. Microbiota-Derived Indole Metabolites Promote Human and Murine Intestinal Homeostasis through Regulation of Interleukin-10 Receptor. *Am. J. Pathol.* 188, 1183-1194 (2018).
8. Kim, C.-S., Jung, S., Hwang, G.-S. & Shin, D.-M. Gut microbiota indole-3-propionic acid mediates neuroprotective effect of probiotic consumption in healthy elderly: A randomized, double-blind, placebo-controlled, multicenter trial and in vitro study. *Clin. Nutr* 42, 1025-1033 (2023).
9. Fang, Z. et al. Limosilactobacillus reuteri Attenuates Atopic Dermatitis via Changes in Gut Bacteria and Indole Derivatives from Tryptophan Metabolism. *Int. J. Mol. Sci.* 23, 7735 (2022).
10. Fu, Y., Gao, H., Hou, X., Chen, Y. & Xu, K. Pretreatment with IPA ameliorates colitis in mice: Colon transcriptome and fecal 16S amplicon profiling. *Front. Immunol.* 13, 1014881 (2022).
11. Rothhammer, V. et al. *Type I interferons and microbial metabolites of tryptophan modulate astrocyte activity and central nervous system inflammation via the aryl hydrocarbon receptor. Nat. Med.* 22, 586-597 (2016).
12. Xu, D. et al. Brain-derived neurotrophic factor reduces inflammation and hippocampal apoptosis in experimental *Streptococcus pneumoniae* meningitis. *J. Neuroinflammation* 14, 156 (2017).
13. Venkatesh, M. et al. Symbiotic Bacterial Metabolites Regulate Gastrointestinal Barrier Function via the Xenobiotic Sensor PXR and Toll-like Receptor 4. *Immunity* 41, 296-310 (2014).
14. Hwang, I. K. et al. Indole-3-propionic acid attenuates neuronal damage and oxidative stress in the ischemic hippocampus. *J. Neurosci. Res.* 87, 2126-2137 (2009).
15. Karbownik, M., Stasiak, M., Zygmunt, A., Zasada, K. & Lewiński, A. Protective effects of melatonin and indole-3-propionic acid against lipid peroxidation, caused by potassium bromate in the rat kidney. *Cell Biochem. Funct.* 24, 483-489 (2006).
16. Owumi, S. E., Adedara, I. A. & Oyelere, A. K. Indole-3-propionic acid mitigates chlorpyrifos-mediated neurotoxicity by modulating cholinergic and redox-regulatory systems, inflammatory stress, apoptotic responses and DNA damage in rats. Environ. Toxicol. Pharmacol. 89, 103786 (2022).
17. Rynkowska, A., Stępniak, J. & Karbownik-Lewińska, M. Melatonin and Indole-3-Propionic Acid Reduce Oxidative Damage to Membrane Lipids Induced by High Iron Concentrations in Porcine Skin. *Membranes* 11, 571 (2021).
18. Menni, C. et al. Circulating levels of the anti-oxidant indoleproprionic acid are associated with higher gut microbiome diversity. *Gut Microbes* 10, 688-695 (2019).
19. Zhao, Z.-H. et al. Indole-3-propionic acid inhibits gut dysbiosis and endotoxin leakage to attenuate steatohepatitis in rats. *Exp. Mol. Med.* 51, 1-14 (2019).
20. Zhang, B. et al. The Mechanism Underlying the Influence of Indole-3-Propionic Acid: A Relevance to Metabolic Disorders. *Front. Endocrinol.* 13, 841703 (2022).
21. Wang, S. et al. Xenobiotic Pregnane X Receptor (PXR) Regulates Innate Immunity via Activation of NLRP3 Inflammasome in Vascular Endothelial Cells*. *J. Biol. Chem.* 289, 30075-30081 (2014).
22. Lv, Y. et al. The role of pregnane X receptor (PXR) in substance metabolism. Front. Endocrinol. 13, 959902 (2022).
23. Tebbens, J. D., Azar, M., Friedmann, E., Lanzendörfer, M. & Pávek, P. Mathematical Models in the Description of Pregnane X Receptor (PXR)-Regulated Cytochrome P450 Enzyme Induction. Int. J. Mol. Sci. 19, 1785 (2018).
24. Hakkola, J. et al. Cytochrome P450 Induction and Xeno-Sensing Receptors Pregnane X Receptor, Constitutive Androstane Receptor, Aryl Hydrocarbon Receptor and Peroxisome Proliferator-Activated Receptor a at the Crossroads of Toxicokinetics and Toxicodynamics. *Basic Clin. Pharmacol. Toxicol.* 123, 42-50 (2018).
25. Shen, Z. et al. Activation of nuclear receptor pregnane-X-receptor protects against abdominal aortic aneurysm by inhibiting oxidative stress. *Redox Biol.* 77, 103397 (2024).
26. Lee, J. S. et al. Pregnane X receptor reduces particulate matter-induced type 17 inflammation in atopic dermatitis. Front. Immunol. 15, 1415350 (2024).
27. Vázquez-Gómez, G., Petráš, J., Dvořák, Z. & Vondráček, J. Aryl hydrocarbon receptor (AhR) and pregnane X receptor (PXR) play both distinct and common roles in the regulation of colon homeostasis and intestinal carcinogenesis. *Biochem. Pharmacol.* 216, 115797 (2023).
28. Terc, J., Hansen, A., Alston, L. & Hirota, S. A. Pregnane X receptor agonists enhance intestinal epithelial wound healing and repair of the intestinal barrier following the induction of experimental colitis. *Eur. J. Pharm. Sci.* 55, 12-19 (2014).
29. Tanaka, Y., Uchi, H., Ito, T. & Furue, M. Indirubin-pregnane X receptor-JNK axis accelerates skin wound healing. *Sci. Rep.* 9, 18174 (2019).
30. Minzaghi, D., Pavel, P. & Dubrac, S. Xenobiotic Receptors and Their Mates in Atopic Dermatitis. Int. J. Mol. Sci. 20, 4234 (2019).
31. Dubrac, S., Elentner, A., Ebner, S., Horejs-Hoeck, J. & Schmuth, M. Modulation of T Lymphocyte Function by the Pregnane X Receptor. *J. Immunol.* 184, 2949-2957 (2010).
32. Sun, L., Sun, Z., Wang, Q., Zhang, Y. & Jia, Z. Role of nuclear receptor PXR in immune cells and inflammatory diseases. Front. Immunol. 13, 969399 (2022).
33. Ohtsuji, M. et al. Nrf1 and Nrf2 Play Distinct Roles in Activation of Antioxidant Response Element-dependent Genes*. J. Biol. Chem. 283, 33554-33562 (2008).
34. He, X., Chen, M. G. & Ma, Q. Activation of Nrf2 in Defense against Cadmium-Induced Oxidative Stress. *Chem. Res. Toxicol.* 21, 1375-1383 (2008).
35. Kavian, N. et al. The Nrf2-Antioxidant Response Element Signaling Pathway Controls Fibrosis and Autoimmunity in Scleroderma. Front. Immunol. 9, 1896 (2018).
36. Venugopal, R. & Jaiswal, A. K. Nrf2 and Nrf1 in association with Jun proteins regulate antioxidant response element-mediated expression and coordinated induction of genes encoding detoxifying enzymes. *Oncogene* 17, 3145-3156 (1998).
37. Raghunath, A. et al. Antioxidant response elements: Discovery, classes, regulation and potential applications. *Redox Biol.* 17, 297-314 (2018).
38. Lee, J.-M. & Johnson, J. A. An Important Role of Nrf2-ARE Pathway in the Cellular Defense Mechanism. *BMB Rep.* 37, 139-143 (2004).
39. Chen-Roetling, J. & Regan, R. F. Targeting the Nrf2-Heme Oxygenase-1 Axis after Intracerebral Hemorrhage. *Curr Pharm. Des.* 23, 2226-2237 (2017).
40. Dhakshinamoorthy, S. & Jaiswal, A. K. Functional characterization and role of INrf2 in antioxidant response element-mediated expression and antioxidant induction of NAD(P)H:quinone oxidoreductase1 gene. Oncogene 20, 3906-3917 (2001).
41. Nguyen, T., Nioi, P. & Pickett, C. B. The Nrf2-Antioxidant Response Element Signaling Pathway and Its Activation by Oxidative Stress*. J. Biol. Chem. 284, 13291-13295 (2009).
42. Levings, D. C., Wang, X., Kohlhase, D., Bell, D. A. & Slattery, M. A distinct class of antioxidant response elements is consistently activated in tumors with NRF2 mutations. Redox Biol. 19, 235-249 (2018).
43. Sadovnikova, I. S. et al. Nrf2/ARE Activators Improve Memory in Aged Mice via Maintaining of Mitochondrial Quality Control of Brain and the Modulation of Gut Microbiome. *Pharmaceuticals* 14, 607 (2021).
44. Wen, Z. et al. A Protective Role of the NRF2-Keap1 Pathway in Maintaining Intestinal Barrier Function. *Oxidative Med. Cell. Longev.* 2019, 1759149 (2019).
45. Hu, X. (Lucas) et al. Aryl hydrocarbon receptor utilises cellular zinc signals to maintain the gut epithelial barrier. *Nat. Commun.* 14, 5431 (2023).
46. Saw, C. L. L. et al. Nrf2 null enhances UVB-induced skin inflammation and extracellular matrix damages. *Cell Biosci.* 4, 39 (2014).
47. Li, N. et al. Nrf2 Is a Key Transcription Factor That Regulates Antioxidant Defense in Macrophages and Epithelial Cells: Protecting against the Proinflammatory and Oxidizing Effects of Diesel Exhaust Chemicals. J. Immunol. 173, 3467-3481 (2004).
48. Schäfer, M. et al. Nrf2 links epidermal barrier function with antioxidant defense. *EMBO Mol. Med.* 4, 364-379 (2012).
49. Dinkova-Kostova, A. T. & Abramov, A. Y. The emerging role of Nrf2 in mitochondrial function. *Free Radic. Biol. Med.* 88, 179-188 (2015).
50. Vomhof-DeKrey, E. E. & Picklo, M. J. The Nrf2-antioxidant response element pathway: a target for regulating energy metabolism. *J. Nutr. Biochem.* 23, 1201-1206 (2012).
51. Goodfellow, M. J. et al. Transcriptional activation of antioxidant gene expression by Nrf2 protects against mitochondrial dysfunction and neuronal death associated with acute and chronic neurodegeneration. *Exp. Neurol.* 328, 113247 (2020).
52. Xiong, W., Garfinkel, A. E. M., Li, Y., Benowitz, L. I. & Cepko, C. L. NRF2 promotes neuronal survival in neurodegeneration and acute nerve damage. *J. Clin. Investig.* 125, 1433-1445 (2015).
53. Shepherd, M. Canine and Feline Obesity Management. *Vet. Clin. North Am.: Small Anim. Pr* 51, 653-667 (2021).
54. Zoran, D. L. Obesity in Dogs and Cats: A Metabolic and Endocrine Disorder. Vet. Clin. North Am.: Small Anim. Pr. 40, 221-239 (2010).
55. German, A. J. et al. Improvement in insulin resistance and reduction in plasma inflammatory adipokines after weight loss in obese dogs. *Domest. Anim. Endocrinol.* 37, 214-226 (2009).
56. Clark, M. & Hoenig, M. Metabolic Effects of Obesity and Its Interaction with Endocrine Diseases. Vet. Clin. North Am.: Small Anim. Pr. 46, 797-815 (2016).
57. Laflamme, D. P. COMPANION ANIMALS SYMPOSIUM: Obesity in dogs and cats: What is wrong with being fat? *J. Anim. Sci.* 90, 1653-1662 (2012).
58. Marshall, W. G., Bockstahler, B. A., Hulse, D. A. & Carmichael, S. A review of osteoarthritis and obesity: current understanding of the relationship and benefit of obesity treatment and prevention in the dog. *Vet. Comp. Orthop. Traumatol.* 22, 339-345 (2009).
59. Sanderson. The Epidemic of Canine Obesity and its Role in Osteoarthritis. *Israel Journal of Veterinary Medicine* 67, (2012).
60. Tropf, M., Nelson, O. L., Lee, P. M. & Weng, H. Y. Cardiac and Metabolic Variables in Obese Dogs. *J. Vet. Intern. Med.* 31, 1000-1007 (2017).
61. Piantedosi, D. et al. Serum biochemistry profile, inflammatory cytokines, adipokines and cardiovascular findings in obese dogs. *Vet. J.* 216, 72-78 (2016).
62. Hoenig, M. Comparative Aspects of Human, Canine, and Feline Obesity and Factors Predicting Progression to Diabetes. *Vet. Sci.* 1, 121-135 (2014).
63. Forster, G. M. et al. A Comparative Study of Serum Biochemistry, Metabolome and Microbiome Parameters of Clinically Healthy, Normal Weight, Overweight, and Obese Companion Dogs. *Top. Companion Anim. Med.* 33, 126-135 (2018).
64. Ballanti, M. et al. Decreased circulating IPA levels identify subjects with metabolic comorbidities: A multiomics study. *Pharmacol. Res.* 204, 107207 (2024).
65. Chen, L. et al. Indolepropionic acid reduces obesity-induced metabolic dysfunction through colonic barrier restoration mediated via tuft cell-derived IL-25. *FEBS J.* 289, 5985-6004 (2022).
66. Cussotto, S. et al. Tryptophan Metabolic Pathways Are Altered in Obesity and Are Associated With Systemic Inflammation. Front. Immunol. 11, 557 (2020).
67. Sehgal, R. et al. Indole-3-Propionic Acid, a Gut-Derived Tryptophan Metabolite, Associates with Hepatic Fibrosis. Nutrients 13, 3509 (2021).
68. Sehgal, R. et al. Indolepropionic Acid, a Gut Bacteria-Produced Tryptophan Metabolite and the Risk of Type 2 Diabetes and Non-Alcoholic Fatty Liver Disease. Nutrients 14, 4695 (2022).
69. Konopelski, P. et al. Indole-3-propionic acid, a tryptophan-derived bacterial metabolite, increases blood pressure via cardiac and vascular mechanisms in rats. *Am. J. Physiol.-Regul., Integr. Comp. Physiol.* 321, R969-R981 (2021).
70. Abildgaard, A., Elfving, B., Hokland, M., Wegener, G. & Lund, S. The microbial metabolite indole-3-propionic acid improves glucose metabolism in rats, but does not affect behaviour. *Arch. Physiol. Biochem.* 124, 306-312 (2018).
71. Chimerel, C. et al. Bacterial Metabolite Indole Modulates Incretin Secretion from Intestinal Enteroendocrine L Cells. *Cell Rep.* 9, 1202-1208 (2014).
72. Zhuang, H., Ren, X., Jiang, F. & Zhou, P. Indole-3-propionic acid alleviates chondrocytes inflammation and osteoarthritis via the AhR/NF-κB axis. Mol. Med. 29, 17 (2023).

73. Negatu, D. A., Gengenbacher, M., Dartois, V. & Dick, T. Indole Propionic Acid, an Unusual Antibiotic Produced by the Gut Microbiota, With Anti-inflammatory and Antioxidant Properties. *Front. Microbiol.* 11, 575586 (2020).
74. Zhao, Q. et al. Indole-3-propionic Acid Attenuates HI-Related Blood-Brain Barrier Injury in Neonatal Rats by Modulating the PXR Signaling Pathway. *ACS Chem. Neurosci.* 13, 2897-2912 (2022).
75. Roager, H. M. & Licht, T. R. Microbial tryptophan catabolites in health and disease. Nat. Commun. 9, 3294 (2018).
76. Zhuang, H. et al. Indole-3-aldehyde alleviates chondrocytes inflammation through the AhR-NF-κB signalling pathway. *Int. Immunopharmacol.* 113, 109314 (2022).
77. Metidji, A. et al. The Environmental Sensor AHR Protects from Inflammatory Damage by Maintaining Intestinal Stem Cell Homeostasis and Barrier Integrity. Immunity 49, 353-362.e5 (2018).
78. Postal, B. G. et al. AhR activation defends gut barrier integrity against damage occurring in obesity. *Mol. Metab.* 39, 101007 (2020).
79. Stockinger, B., Shah, K. & Wincent, E. AHR in the intestinal microenvironment: safeguarding barrier function. *Nat. Rev. Gastroenterol. Hepatol.* 18, 559-570 (2021).
80. Yu, M. et al. Aryl Hydrocarbon Receptor Activation Modulates Intestinal Epithelial Barrier Function by Maintaining Tight Junction Integrity. *Int. J. Biol. Sci.* 14, 69-77 (2018).
81. Suchodolski, J. S. Analysis of the gut microbiome in dogs and cats. *Vet. Clin. Pathol.* 50, 6-17 (2022).
82. Pilla, R. & Suchodolski, J. S. The Role of the Canine Gut Microbiome and Metabolome in Health and Gastrointestinal Disease. *Front. Vet. Sci.* 6, 498 (2020).
83. Blake, A. B. & Suchodolski, J. S. Importance of gut microbiota for the health and disease of dogs and cats. *Anim. Front.* 6, 37-42 (2016).
84. Yang, Q. & Wu, Z. Gut Probiotics and Health of Dogs and Cats: Benefits, Applications, and Underlying Mechanisms. *Microorganisms* 11, 2452 (2023).
85. Grześkowiak, Ł., Endo, A., Beasley, S. & Salminen, S. Microbiota and probiotics in canine and feline welfare. *Anaerobe* 34, 14-23 (2015).
86. Hooda, S., Minamoto, Y., Suchodolski, J. S. & Swanson, K. S. Current state of knowledge: the canine gastrointestinal microbiome. *Anim. Heal. Res. Rev.* 13, 78-88 (2012).
87. Mondo, E., Marliani, G., Accorsi, P. A., Cocchi, M. & Leone, A. D. Role of gut microbiota in dog and cat's health and diseases. *Open Vet. J.* 9, 253-258 (2019).
88. Huang, Z., Pan, Z., Yang, R., Bi, Y. & Xiong, X. The canine gastrointestinal microbiota: early studies and research frontiers. *Gut Microbes* 11, 635-654 (2020).
89. Wernimont, S. M. et al. The Effects of Nutrition on the Gastrointestinal Microbiome of Cats and Dogs: Impact on Health and Disease. *Front. Microbiol.* 11, 1266 (2020).
90. Atuahene, D., Mukarram, S. A., Balouei, F. & Antwi, A. Gut Health Optimization in Canines and Felines: Exploring the Role of Probiotics and Nutraceuticals. *Pets* 1, 135-151 (2024).
91. Pernomian, L., Duarte-Silva, M. & Cardoso, C. R. de B. The Aryl Hydrocarbon Receptor (AHR) as a Potential Target for the Control of Intestinal Inflammation: Insights from an Immune and Bacteria Sensor Receptor. *Clin. Rev. Allergy Immunol.* 59, 382-390 (2020).
92. Han, H., Safe, S., Jayaraman, A. & Chapkin, R. S. Diet-Host-Microbiota Interactions Shape Aryl Hydrocarbon Receptor Ligand Production to Modulate Intestinal Homeostasis. *Annu. Rev. Nutr.* 41, 455-478 (2021).
93. Cannon, A. S., Nagarkatti, P. S. & Nagarkatti, M. Targeting AhR as a Novel Therapeutic Modality against Inflammatory Diseases. *Int. J. Mol. Sci.* 23, 288 (2021).
94. Chen, Y., Wang, Y., Fu, Y., Yin, Y. & Xu, K. Modulating AHR function offers exciting therapeutic potential in gut immunity and inflammation. Cell Biosci. 13, 85 (2023).
95. Seo, S.-K. & Kwon, B. Immune regulation through tryptophan metabolism. *Exp. Mol. Med.* 55, 1371-1379 (2023).
96. Krishnan, S. et al. Gut Microbiota-Derived Tryptophan Metabolites Modulate Inflammatory Response in Hepatocytes and Macrophages. *Cell Rep.* 23, 1099-1111 (2018).
97. Lamas, B. et al. CARD9 impacts colitis by altering gut microbiota metabolism of tryptophan into aryl hydrocarbon receptor ligands. *Nat. Med.* 22, 598-605 (2016).
98. Mizoguchi, A. et al. Clinical importance of IL-22 cascade in IBD. *J. Gastroenterol.* 53, 465-474 (2018).
99. Busbee, P. B. et al. Indole-3-carbinol prevents colitis and associated microbial dysbiosis in an IL-22-dependent manner. *JCI Insight* 5, e127551 (2020).
100. Goettel, J. A. et al. AHR Activation Is Protective against Colitis Driven by T Cells in Humanized Mice. *Cell Rep.* 17, 1318-1329 (2016).
101. Abron, J. D. et al. An endogenous aryl hydrocarbon receptor ligand, ITE, induces regulatory T cells and ameliorates experimental colitis. *Am. J. Physiol.-Gastrointest. Liver Physiol.* 315, G220-G230 (2018).
102. Natividad, J. M. et al. Impaired Aryl Hydrocarbon Receptor Ligand Production by the Gut Microbiota Is a Key Factor in Metabolic Syndrome. *Cell Metab.* 28, 737-749.e4 (2018).
103. Li, J. et al. Indole-3-propionic Acid Improved the Intestinal Barrier by Enhancing Epithelial Barrier and Mucus Barrier. *J. Agric. Food Chem.* 69, 1487-1495 (2021).
104. Cheng, J., Shah, Y. M. & Gonzalez, F. J. Pregnane X receptor as a target for treatment of inflammatory bowel disorders. *Trends Pharmacol. Sci.* 33, 323-330 (2012).
105. Deuring, J. J. et al. Pregnane X receptor activation constrains mucosal NF-κB activity in active inflammatory bowel disease. *PLoS ONE* 14, e0221924 (2019).
106. Fritsch, D. A. et al. Adding a polyphenol-rich fiber bundle to food impacts the gastrointestinal microbiome and metabolome in dogs. Front. Vet. Sci. 9, 1039032 (2023).
107. Jackson, M. I., Waldy, C. & Jewell, D. E. Dietary resistant starch preserved through mild extrusion of grain alters fecal microbiome metabolism of dietary macronutrients while increasing immunoglobulin A in the cat. *PLoS ONE* 15, e0241037 (2020).
108. Kainulainen, V. et al. The canine isolate *Lactobacillus acidophilus* LAB20 adheres to intestinal epithelium and attenuates LPS-induced IL-8 secretion of enterocytes in vitro. *BMC Microbiol.* 15, 4 (2015).
109. Crakes, K. R. et al. Fenofibrate promotes PPARα-targeted recovery of the intestinal epithelial barrier at the host-microbe interface in dogs with diabetes mellitus. Sci. Rep. 11, 13454 (2021).
110. Sanchez-Muñoz, F., Dominguez-Lopez, A. & Yamamoto-Furusho, J. K. Role of cytokines in inflammatory bowel disease. *World J. Gastroenterol.* 14, 4280-4288 (2008).

111. Strober, W. & Fuss, I. J. Proinflammatory Cytokines in the Pathogenesis of Inflammatory Bowel Diseases. *Gastroenterology* 140, 1756-1767.e1 (2011).
112. Foley, K. F., Pantano, C., Ciolino, A. & Mawe, G. M. IFN-γ and TNF-α decrease serotonin transporter function and expression in Caco2 cells. Am. J. Physiol.-Gastrointest. Liver Physiol. 292, G779-G784 (2007).
113. Plevy, S. E. et al. A role for TNF-alpha and mucosal T helper-1 cytokines in the pathogenesis of Crohn's disease. J. Immunol. 159, 6276-6282 (1997).
114. Bregenholt, Brimnes, Nissen & Claesson. In vitro activated CD4+ T cells from interferon-gamma (IFN-γ)-deficient mice induce intestinal inflammation in immunodeficient hosts. *Clin. Exp. Immunol.* 118, 228-234 (1999).
115. Kołodziejska-Sawerska, A. et al. Cytokines in canine inflammatory bowel disease. *Pol. J. Vet. Sci.* 16, 165-171 (2013).
116. Cave, N. Chronic inflammatory disorders of the gastrointestinal tract of companion animals. *N. Zealand Vet. J.* 51, 262-274 (2003).
117. Jewell, D. E., Motsinger, L. A. & Paetau-Robinson, I. Effect of dietary antioxidants on free radical damage in dogs and cats. *J. Anim. Sci.* 102, skael53 (2024).
118. Aleman, R. S., Moncada, M. & Aryana, K. J. Leaky Gut and the Ingredients That Help Treat It: A Review. *Molecules* 28, 619 (2023).
119. Rajoka, M. S. R. et al. Role of Food Antioxidants in Modulating Gut Microbial Communities: Novel Understandings in Intestinal Oxidative Stress Damage and Their Impact on Host Health. Antioxidants 10, 1563 (2021).
120. Surai, K., Surai, P., Speake, B. & Sparks, N. Antioxidant-prooxidant balance in the intestine: Food for thought. 1. Prooxidants. *Current Topics in Nutraceutical Research* 2, 27-46 (2004).
121. Sahoo, D. K. et al. Oxidative stress, hormones, and effects of natural antioxidants on intestinal inflammation in inflammatory bowel disease. Front. Endocrinol. 14, 1217165 (2023).
122. Rubio, C. P. et al. Serum biomarkers of oxidative stress in dogs with idiopathic inflammatory bowel disease. Vet. J. 221, 56-61 (2017).
123. Candellone, A., Girolami, F., Badino, P., Jarriyawatta-nachaikul, W. & Odore, R. Changes in the Oxidative Stress Status of Dogs Affected by Acute Enteropathies. Vet. Sci. 9, 276 (2022).
124. Naliyadhara, N. et al. Interplay of dietary antioxidants and gut microbiome in human health: What has been learnt thus far? *J. Funct. Foods* 100, 105365 (2023).
125. Uchiyama, J., Akiyama, M., Hase, K., Kumagai, Y. & Kim, Y.-G. Gut microbiota reinforce host antioxidant capacity via the generation of reactive sulfur species. Cell Rep. 38, 110479 (2022).
126. Miao, W., Hu, L., Scrivens, P. J. & Batist, G. Transcriptional Regulation of NF-E2 p45-related Factor (NRF2) Expression by the Aryl Hydrocarbon Receptor-Xenobiotic Response Element Signaling Pathway DIRECT CROSS-TALK BETWEEN PHASE I AND II DRUG-METABOLIZING ENZYMES*. J. Biol. Chem. 280, 20340-20348 (2005).
127. Bissonnette, R., Gold, L. S., Rubenstein, D. S., Tallman, A. M. & Armstrong, A. Tapinarof in the treatment of psoriasis: A review of the unique mechanism of action of a novel therapeutic aryl hydrocarbon receptor-modulating agent. *J. Am. Acad. Dermatol.* 84, 1059-1067 (2021).
128. Abe, H. et al. Aryl hydrocarbon receptor plays protective roles in ConA-induced hepatic injury by both suppressing IFN-γ expression and inducing IL-22. *Int. Immunol.* 26, 129-137 (2014).
129. Rodriguez-Sosa, M. et al. Over-production of IFN-γ and IL-12 in AhR-null mice. *FEBS Lett.* 579, 6403-6410 (2005).
130. Kimura, A. et al. Aryl hydrocarbon receptor in combination with Stat1 regulates LPS-induced inflammatory responses. *J. Exp. Med.* 206, 2027-2035 (2009).
131. Gutiérrez-Vázquez, C. & Quintana, F. J. Regulation of the Immune Response by the Aryl Hydrocarbon Receptor. Immunity 48, 19-33 (2018).
132. Verlinden, A., Hesta, M., Millet, S. & Janssens, G. P. J. Food Allergy in Dogs and Cats: A Review. *Crit. Rev. Food Sci. Nutr* 46, 259-273 (2006).
133. Jeffers, J. G., Meyer, E. K. & Sosis, E. J. Responses of dogs with food allergies to single-ingredient dietary provocation. *J. Am. Vet. Méd. Assoc.* 209, 608-11 (1996).
134. Olivry, T. & Mueller, R. S. Critically appraised topic on adverse food reactions of companion animals (3): prevalence of cutaneous adverse food reactions in dogs and cats. *BMC Vet. Res.* 13, 51 (2017).
135. Jackson, H. A. Food allergy in dogs and cats; current perspectives on etiology, diagnosis, and management. J. Am. Vet. Méd. Assoc. 261, S23-S29 (2023).
136. Schulz, V. J. et al. Activation of the Aryl Hydrocarbon Receptor Suppresses Sensitization in a Mouse Peanut Allergy Model. *Toxicol. Sci.* 123, 491-500 (2011).
137. Schulz, V. J., Smit, J. J. & Pieters, R. H. H. The aryl hydrocarbon receptor and food allergy. *Vet. Q.* 33, 94-107 (2013).
138. Sibilano, R., Pucillo, C. E. & Gri, G. Allergic responses and aryl hydrocarbon receptor novel pathway of mast cell activation. *Mol. Immunol.* 63, 69-73 (2015).
139. Esser, C., Rannug, A. & Stockinger, B. The aryl hydrocarbon receptor in immunity. *Trends Immunol.* 30, 447-454 (2009).
140. Riaz, F., Pan, F. & Wei, P. Aryl hydrocarbon receptor: The master regulator of immune responses in allergic diseases. Front. Immunol. 13, 1057555 (2022).
141. Ashida, H., Nishiumi, S. & Fukuda, I. An update on the dietary ligands of the AhR. *Expert Opin. Drug Metab. Toxicol.* 4, 1429-1447 (2008).
142. Haas, K. et al. Aryl Hydrocarbon Receptor in Keratinocytes Is Essential for Murine Skin Barrier Integrity. *J. Investig. Dermatol.* 136, 2260-2269 (2016).
143. Vogeley, C., Esser, C., Tüting, T., Krutmann, J. & Haarmann-Stemmann, T. Role of the Aryl Hydrocarbon Receptor in Environmentally Induced Skin Aging and Skin Carcinogenesis. Int. J. Mol. Sci. 20, 6005 (2019).
144. Uberoi, A. et al. Commensal microbiota regulates skin barrier function and repair via signaling through the aryl hydrocarbon receptor. *Cell Host Microbe* 29, 1235-1248.e8 (2021).
145. Gargaro, M. et al. Allergy Prevention and Exacerbation, The Paradox of Microbial Impact on the Immune System. *Birkhäuser Adv. Infect. Dis.* 167-189 (2018).
146. Yucel-Lindberg, T. & Båge, T. Inflammatory mediators in the pathogenesis of periodontitis. *Expert Rev. Mol. Med.* 15, e7 (2013).
147. Wallis, C. & Holcombe, L. J. A review of the frequency and impact of periodontal disease in dogs. *J. Small Anim. Pr* 61, 529-540 (2020).
148. Albuquerque, C. et al. Canine periodontitis: The dog as an important model for periodontal studies. Vet. J. 191, 299-305 (2012).

149. Page, R. C. Gingivitis*. *J. Clin. Periodontol.* 13, 345-355 (1986).
150. Górska, R. et al. Relationship between clinical parameters and cytokine profiles in inflamed gingival tissue and serum samples from patients with chronic periodontitis. J. Clin. Periodontol. 30, 1046-1052 (2003).
151. Papathanasiou, E. et al. Gingival crevicular fluid levels of interferon-γ, but not interleukin-4 or -33 or thymic stromal lymphopoietin, are increased in inflamed sites in patients with periodontal disease. *J. Periodontal Res.* 49, 55-61 (2014).
152. Franco-Topete, R. et al. IFN-γR2 is strongly expressed on endothelial cells of gingival tissues from patients with chronic periodontitis. *J. Appl. Oral Sci.* 26, e20170291 (2018).
153. Maulani, C., Masulili, S. L. C., Priyadharsini, S., Susmiarsih, T. P. & Auerkari, E. I. Positive Correlation Between the Level of Interferon-Gamma and the Severity of Periodontitis. *Pesqui. Bras. em Odontopediatria e Clinica Integrada* 19, 1-9 (2019).
154. Zhou, L. et al. Macrophage polarization in human gingival tissue in response to periodontal disease. *Oral Dis.* 25, 265-273 (2019).
155. McFarlane, C. G. & Meikle, M. C. Interleukin-2, interleukin-2 receptor and interleukin-4 levels are elevated in the sera of patients with periodontal disease. J. Periodontal Res. 26, 402-408 (1991).
156. Manhart, S. S. et al. Gingival Cell IL-2 and IL-4 in Early-Onset Periodontitis. *J. Periodontol.* 65, 807-813 (1994).
157. Hao, T. et al. Porphyromonas gingivalis infection promotes inflammation via inhibition of the AhR signalling pathway in periodontitis. *Cell Prolif* 56, e13364 (2023).
158. Thatcher, T. H. et al. Aryl Hydrocarbon Receptor-Deficient Mice Develop Heightened Inflammatory Responses to Cigarette Smoke and Endotoxin Associated with Rapid Loss of the Nuclear Factor-κB Component RelB. Am. J. Pathol. 170, 855-864 (2007).
159. Nguyen, N. T., Hanieh, H., Nakahama, T. & Kishimoto, T. The roles of aryl hydrocarbon receptor in immune responses. Int. Immunol. 25, 335-343 (2013).
160. Schmidt, J. R. et al. Transcriptomic signatures reveal a shift towards an anti-inflammatory gene expression profile but also the induction of type I and type II interferon signaling networks through aryl hydrocarbon receptor activation in murine macrophages. Front. Immunol. 14, 1156493 (2023).
161. MURRAY, H. W. Interferon-Gamma, the Activated Macrophage, and Host Defense Against Microbial Challenge. *Ann. Intern. Med.* 108, 595 (1988).
162. Ivashkiv, L. B. IFNγ: signalling, epigenetics and roles in immunity, metabolism, disease and cancer immunotherapy. *Nat. Rev. Immunol.* 18, 545-558 (2018).
163. Shouse, A. N., LaPorte, K. M. & Malek, T. R. Interleukin-2 signaling in the regulation of T cell biology in autoimmunity and cancer. Immunity 57, 414-428 (2024).
164. Séguier, S., Godeau, G., Leborgne, M., Pivert, G. & Brousse, N. Immunohistologic and Morphometric Analysis of Cytotoxic T Lymphocytes in Gingivitis. J. Periodontol. 70, 1383-1391 (1999).
165. Taubman, M. A. & Kawai, T. Involvement of T-Lymphocytes in Periodontal Disease and in Direct and Indirect Induction of Bone Resorption. *Crit. Rev. Oral Biol. Med.* 12, 125-135 (2001).
166. Shin, J., Ji, S. & Choi, Y. Ability of oral bacteria to induce tissue-destructive molecules from human neutrophils. Oral Dis. 14, 327-334 (2008).
167. Kuula, H. et al. Local and Systemic Responses in Matrix Metalloproteinase 8-Deficient Mice during Porphyromonas gingivalis-Induced Periodontitis. *Infect. Immun.* 77, 850-859 (2008).
168. Scott, D. A. & Krauss, J. Neutrophils in Periodontal Inflammation. *Front. Oral Biol.* 15, 56-83 (2011).
169. Patil, R. T., Dhadse, P. V., Salian, S. S. & Punse, S. D. Role of Oxidative Stress in Periodontal Diseases. *Cureus* 16, e60779 (2024).
170. Lamas, B., Natividad, J. M. & Sokol, H. Aryl hydrocarbon receptor and intestinal immunity. *Mucosal Immunol.* 11, 1024-1038 (2018).
171. Murray, I. A. & Perdew, G. H. How Ah Receptor Ligand Specificity Became Important in Understanding Its Physiological Function. Int. J. Mol. Sci. 21, 9614 (2020).
172. Beamer, C. A. & Shepherd, D. M. Role of the aryl hydrocarbon receptor (AhR) in lung inflammation. *Semin. Immunopathol.* 35, 693-704 (2013).
173. Liu, Z. et al. Aryl hydrocarbon receptor activation maintained the intestinal epithelial barrier function through Notch1 dependent signaling pathway. *Int. J. Mol. Med.* 41, 1560-1572 (2018).
174. Li, Y. et al. Exogenous Stimuli Maintain Intraepithelial Lymphocytes via Aryl Hydrocarbon Receptor Activation. Cell 147, 629-640 (2011).
175. Takahashi, N. et al. Gingival epithelial barrier: regulation by beneficial and harmful microbes. *Tissue Barriers* 7, e1651158 (2019).
176. SCULLEY, D. V. & LANGLEY-EVANS, S. C. Periodontal disease is associated with lower antioxidant capacity in whole saliva and evidence of increased protein oxidation. *Clin. Sci.* 105, 167-172 (2003).
177. Tripathi, P. et al. Antioxidant therapy (lycopene and green tea extract) in periodontal disease: A promising paradigm. *J. Indian Soc. Periodontol.* 23, 25-30 (2019).
178. Wasti, J., Wasti, A. & Singh, R. Efficacy of Antioxidants Therapy on Progression of Periodontal Disease—A Randomized Control Trial. *Indian J. Dent. Res.* 32, 187-191 (2021).
179. Bains, V. K. & Bains, R. The antioxidant master glutathione and periodontal health. *Dent. Res. J.* 12, 389-405 (2015).
180. Miguel, S. M. S., Opperman, L. A., Allen, E. P. & Svoboda, K. K. H. Reactive oxygen species and antioxidant defense mechanisms in the oral cavity: a literature review. Compend. Contin. Educ. Dent. (Jamesburg, NJ: 1995) 32, E10-5 (2011).
181. Maruyama, T. et al. Supplementation of green tea catechins in dentifrices suppresses gingival oxidative stress and periodontal inflammation. *Arch. Oral Biol.* 56, 48-53 (2011).
182. EL.Baz, M. K., Gwad, A., M. Abd El, Awadallah, H. I. & Mahallawy, O. S. E. THE USE OF ANTIOXIDANTS IN TREATMENT OF PATIENTS WITH GINGIVITIS & CHRONIC PERIODONTITIS—INTERVENTION STUDY. *J. Environ. Sci.* 50, 217-237 (2021).
183. Mathur, A. et al. Antioxidant therapy as monotherapy or as an adjunct to treatment of periodontal diseases. J. Indian Soc. Periodontol. 17, 21-24 (2013).
184. Vo, T. T. T., Chu, P.-M., Tuan, V. P., Te, J. S.-L. & Lee, I.-T. The Promising Role of Antioxidant Phytochemicals in the Prevention and Treatment of Periodontal Disease via the Inhibition of Oxidative Stress Pathways: Updated Insights. Antioxidants 9, 1211 (2020).
185. Bellows, J. et al. Defining healthy aging in older dogs and differentiating healthy aging from disease. *J. Am. Vet. Méd. Assoc.* 246, 77-89 (2015).
186. McCune, S. & Promislow, D. Healthy, Active Aging for People and Dogs. Front. Vet. Sci. 8, 655191 (2021).
187. McKenzie, B. A., Chen, F. & LaCroix-Fralish, M. L. The phenotype of aging in the dog: how aging impacts the health and well-being of dogs and their caregivers. J. Am. Vet. Méd. Assoc. 260, 963-970 (2022).
188. Bland, S. D. Canine osteoarthritis and treatments: a review. *Vet. Sci. Dev.* 5, (2015).
189. Johnson, K. A., Lee, A. H. & Swanson, K. S. Nutrition and nutraceuticals in the changing management of osteoarthritis for dogs and cats. J. Am. Vet. Méd. Assoc. 256, 1335-1341 (2020).
190. Anderson, K. L., Zulch, H., O'Neill, D. G., Meeson, R. L. & Collins, L. M. Risk Factors for Canine Osteoarthritis and Its Predisposing Arthropathies: A Systematic Review. Front. Vet. Sci. 7, 220 (2020).
191. Lee, A. H. et al. Physical activity patterns of free living dogs diagnosed with osteoarthritis. J. Anim. Sci. 99, skab204 (2021).
192. Mosier, J. E. Effect of Aging on Body Systems of the Dog. Vet. Clin. North Am.: Small Anim. Pr. 19, 1-12 (1989).
193. López-Otín, C., Blasco, M. A., Partridge, L., Serrano, M. & Kroemer, G. The Hallmarks of Aging. Cell 153, 1194-1217 (2013).
194. Bellows, J. et al. Common physical and functional changes associated with aging in dogs. J. Am. Vet. Méd. Assoc. 246, 67-75 (2015).
195. McKenzie, B. A. & Chen, F. L. Assessment and Management of Declining Physical Function in Aging Dogs. Top. Companion Anim. Med. 51, 100732 (2022).
196. Chapagain, D., Range, F., Huber, L. & Virányi, Z. Cognitive Aging in Dogs. Gerontology 64, 165-171 (2018).
197. Dewey, C. W., Davies, E. S., Xie, H. & Wakshlag, J. J. Canine Cognitive Dysfunction Pathophysiology, Diagnosis, and Treatment. Vet. Clin. North Am.: Small Anim. Pr. 49, 477-499 (2019).
198. Urfer, S. R. et al. Canine Cognitive Dysfunction (CCD) scores correlate with amyloid beta 42 levels in dog brain tissue. *GeroScience* 43, 2379-2386 (2021).
199. Ramos, M. T. & Otto, C. M. Canine Mobility Maintenance and Promotion of a Healthy Lifestyle. Vet. Clin. North Am.: Small Anim. Pr. 52, 907-924 (2022).
200. Wells, G. M., Young, K., Haskell, M. J., Carter, A. J. & Clements, D. N. Mobility, functionality and functional mobility: A review and application for canine veterinary patients. Vet. J. 305, 106123 (2024).
201. Bray, E. E. et al. Associations between physical activity and cognitive dysfunction in older companion dogs: results from the Dog Aging Project. GeroScience 45, 645-661 (2023).
202. HAYEK, M. G. & DAVENPORT, G. M. Nutrition and Aging in Companion Animals. *J. Anti-Aging Med.* 1, 117-123 (1998).
203. Day, M. J. Ageing, Immunosenescence and Inflammageing in the Dog and Cat. *J. Comp. Pathol.* 142, S60-S69 (2010).
204. McKenzie, B. et al. Feeding dogs a high-fat diet induces metabolic changes similar to natural aging, including dyslipidemia, hyperinsulinemia, and peripheral insulin resistance. *Am. J. Vet. Res.* 85, (2024).
205. Ferrucci, L. & Fabbri, E. Inflammageing: chronic inflammation in ageing, cardiovascular disease, and frailty. Nat. Rev. Cardiol. 15, 505-522 (2018).
206. Sonowal, R. et al. Indoles from commensal bacteria extend healthspan. Proc. Natl. Acad. Sci. 114, E7506-E7515 (2017).
207. Head, E. A canine model of human aging and Alzheimer's disease. *Biochim. Biophys. Acta (BBA)—Mol. Basis Dis.* 1832, 1384-1389 (2013).
208. Alexander, J. E., Colyer, A., Haydock, R. M., Hayek, M. G. & Park, J. Understanding How Dogs Age: Longitudinal Analysis of Markers of Inflammation, Immune Function, and Oxidative Stress. *J. Gerontol.: Ser A* 73, 720-728 (2018).
209. Zhang, W., Xiao, D., Mao, Q. & Xia, H. Role of neuroinflammation in neurodegeneration development. *Signal Transduct. Target. Ther* 8, 267 (2023).
210. Leszek, J. et al. Inflammatory Mechanisms and Oxidative Stress as Key Factors Responsible for Progression of Neurodegeneration: Role of Brain Innate Immune System. *CNS Neurol. Disord. —Drug Targets* 15, 329-336 (2016).
211. Kölliker-Frers, R. et al. Neuroinflammation: An Integrating Overview of Reactive-Neuroimmune Cell Interactions in Health and Disease. *Mediat. Inflamm.* 2021, 9999146 (2021).
212. Olmos, G. & Lladó, J. Tumor Necrosis Factor Alpha: A Link between Neuroinflammation and Excitotoxicity. Mediat. Inflamm. 2014, 861231 (2014).
213. Ottum, P. A., Arellano, G., Reyes, L. I., Iruretagoyena, M. & Naves, R. Opposing Roles of Interferon-Gamma on Cells of the Central Nervous System in Autoimmune Neuroinflammation. Front. Immunol. 6, 539 (2015).
214. Schatt, T. et al. Dogs with Cognitive Dysfunction as a Spontaneous Model for Early Alzheimer's Disease: A Translational Study of Neuropathological and Inflammatory Markers. J. Alzheimer's Dis. 52, 433-449 (2016).
215. Ferrari, D. P., Bortolanza, M. & Bel, E. A. D. Interferon-γ Involvement in the Neuroinflammation Associated with Parkinson's Disease and L-DOPA-Induced Dyskinesia. *Neurotox. Res.* 39, 705-719 (2021).
216. Jayaraman, A., Htike, T. T., James, R., Picon, C. & Reynolds, R. TNF-mediated neuroinflammation is linked to neuronal necroptosis in Alzheimer's disease hippocampus. *Acta Neuropathol. Commun.* 9, 159 (2021).
217. Rivera, C. de, Prenderville, J. & Araujo, J. A. Age-related changes in clinically relevant biomarkers in a Beagle model of Alzheimer's disease. *Alzheimer's Dement.* 18, (2022).
218. Li, S. Modulation of immunity by tryptophan microbial metabolites. Front. Nutr 10, 1209613 (2023).
219. Head, E., Rofina, J. & Zicker, S. Oxidative Stress, Aging, and Central Nervous System Disease in the Canine Model of Human Brain Aging. Vet. Clin. North Am.: Small Anim. Pr. 38, 167-178 (2008).
220. Swanson, K. S., Vester, B. M., Apanavicius, C. J., Kirby, N. A. & Schook, L. B. Implications of age and diet on canine cerebral cortex transcription. *Neurobiol. Aging* 30, 1314-1326 (2009).
221. Frank-Cannon, T. C., Alto, L. T., McAlpine, F. E. & Tansey, M. G. Does neuroinflammation fan the flame in neurodegenerative diseases? *Mol. Neurodegener* 4, 47 (2009).
222. Smolek, T. et al. Tau hyperphosphorylation in synaptosomes and neuroinflammation are associated with canine cognitive impairment. *J. Comp. Neurol.* 524, 874-895 (2016).

223. Hines, A. D. et al. Activated gliosis, accumulation of amyloid J, and hyperphosphorylation of tau in aging canines with and without cognitive decline. *Front. Aging Neurosci.* 15, 1128521 (2023).
224. Petty, M. A. & Lo, E. H. Junctional complexes of the blood-brain barrier: permeability changes in neuroinflammation. *Prog. Neurobiol.* 68, 311-323 (2002).
225. Kempuraj, D. et al. Brain and Peripheral Atypical Inflammatory Mediators Potentiate Neuroinflammation and Neurodegeneration. *Front. Cell. Neurosci.* 11, 216 (2017).
226. Pan, Y. Enhancing Brain Functions in Senior Dogs: A New Nutritional Approach. *Top. Companion Anim. Med.* 26, 10-16 (2011).
227. Han, J. H. et al. Elevated circulating levels of the interferon-γ-induced chemokines are associated with disease activity and cutaneous manifestations in adult-onset Still's disease. *Sci. Rep.* 7, 46652 (2017).
228. Yang, Y. et al. Aryl hydrocarbon receptor dependent anti-inflammation and neuroprotective effects of tryptophan metabolites on retinal ischemia/reperfusion injury. *Cell Death Dis.* 14, 92 (2023).
229. Harari, O. A. & Liao, J. K. NF-κB and innate immunity in ischemic stroke. *Ann. N. York Acad. Sci.* 1207, 32-40 (2010).
230. Yang, X., Zeng, Q., Bariş, M. & Tezel, G. Transgenic inhibition of astroglial NF-κB restrains the neuroinflammatory and neurodegenerative outcomes of experimental mouse glaucoma. *J. Neuroinflammation* 17, 252 (2020).
231. Neavin, D. R., Liu, D., Ray, B. & Weinshilboum, R. M. The Role of the Aryl Hydrocarbon Receptor (AHR) in Immune and Inflammatory Diseases. *Int. J. Mol. Sci.* 19, 3851 (2018).
232. Chai, Q., He, W. Q., Zhou, M., Lu, H. & Fu, Z. F. Enhancement of Blood-Brain Barrier Permeability and Reduction of Tight Junction Protein Expression Are Modulated by Chemokines/Cytokines Induced by Rabies Virus Infection. *J. Virol.* 88, 4698-4710 (2014).
233. Candelario-Jalil, E. et al. Cyclooxygenase Inhibition Limits Blood-Brain Barrier Disruption following Intracerebral Injection of Tumor Necrosis Factor-α in the Rat. *J. Pharmacol. Exp. Ther* 323, 488-498 (2007).
234. Takata, F. et al. Brain pericytes among cells constituting the blood-brain barrier are highly sensitive to tumor necrosis factor-α, releasing matrix metalloproteinase-9 and migrating in vitro. *J. Neuroinflammation* 8, 106 (2011).
235. Ding, X. et al. Propofol attenuates TNF-α-induced MMP-9 expression in human cerebral microvascular endothelial cells by inhibiting Ca2+/CAMK II/ERK/NF-κB signaling pathway. *Acta Pharmacol. Sin.* 40, 1303-1313 (2019).
236. Bendheim, P. E. et al. Development of indole-3-propionic acid (OXIGON™) for alzheimer's disease. *J. Mol. Neurosci.* 19, 213-217 (2002).
237. Chyan, Y.-J. et al. Potent Neuroprotective Properties against the Alzheimer β-Amyloid by an Endogenous Melatonin-related Indole Structure, Indole-3-propionic Acid*. *J. Biol. Chem.* 274, 21937-21942 (1999).
238. Li, L. et al. Synbiotic therapy with *Clostridium sporogenes* and xylan promotes gut-derived indole-3-propionic acid and improves cognitive impairments in an Alzheimer's disease mouse model. *Food Funct.* 15, 7865-7882 (2024).
239. Lee, B., Yeom, M., Shim, I., Lee, H. & Hahm, D.-H. Protective Effects of Quercetin on Anxiety-Like Symptoms and Neuroinflammation Induced by Lipopolysaccharide in Rats. *Évid.Based Complement. Altern. Med.* 2020, 4892415 (2020).
240. Rodgers, K. M. et al. Reversal of Established Traumatic Brain Injury-Induced, Anxiety-Like Behavior in Rats after Delayed, Post-Injury Neuroimmune Suppression. *J. Neurotrauma* 31, 487-497 (2014).
241. Rooney, S. et al. Neuroinflammatory alterations in trait anxiety: modulatory effects of minocycline. *Transl. Psychiatry* 10, 256 (2020).
242. Won, E. & Kim, Y.-K. Neuroinflammation-Associated Alterations of the Brain as Potential Neural Biomarkers in Anxiety Disorders. *Int. J. Mol. Sci.* 21, 6546 (2020).
243. Xu, Y. et al. Network analysis reveals abnormal functional brain circuitry in anxious dogs. *PLOS ONE* 18, e0282087 (2023).
244. Rammal, H., Bouayed, J., Younos, C. & Soulimani, R. Evidence that oxidative stress is linked to anxiety-related behaviour in mice. *Brain, Behav., Immun.* 22, 1156-1159 (2008).

SEQUENCE LISTING (22 sequences)

SEQ ID NO: 1 - DNA, 1572 bp, Pediococcus acidilactici
  source 1..1572: mol_type = genomic DNA
atgagagtttgatcttggctcaggatgaacgctggcggcgtgcctaatacatgcaagtcgaacgaacttccgttaattgattatgacgtgcttgcactgaatgagattttaacacgaagtgagtggcggacgggtgagtaacacgtgggtaacctgcccagaagcaggggataacacctggaaacagatgctaataccgtataacagagaaaaccgcctggttttcttttaaaagatggctctgctatcacttctggatggacccgcggcgcattagctagttggtgaggtaacggctcaccaaggcgatgatgcgtagccgacctgagagggtaatcggccacattgggactgagacacggcccagactcctacgggaggcagcagtagggaatcttccacaatggacgcaagtctgatggagcaacgccgcgtgagtgaagaagggtttcggctcgtaaagctctgttgttaaagaagaacgtgggtgagagtaactgttcacccagtgacggtatttaaccagaaagccacggctaactacgtgccagcagccgcggtaatacgtaggtggcaagcgttatccggatttattgggcgtaaagcgagcgcaggcggtcttttaagtctaatgtgaaagccttcggctcaaccgaagaagtgcattggaaactgggagacttgagtgcagaagaggacagtggaactccatgtgtagcggtgaaatgcgtagatatatggaagaacaccagtggcgaaggcggctgtctggtctgtaactgacgctgaggctcgaaagcatgggtagcgaacaggattagataccctggtagtccatgccgtaaacgatgattactaagtgttggagggtttccgcccttcagtgctgcagctaacgcattaagtaatccgcctggggagtacgaccgcaaggttgaaactcaaaagaattgacgggggcccgcacaagcggtggagcatgtggtttaattcgaagctacgcgaagaaccttaccaggtcttgacatcttctgccaacctaagagattaggcgttcccttcggggacagaatgacaggtggtgcatggttgtcgtcagctcgtgtcgtgagatgttgggttaagtcccgcaacgagcgcaacccttattactagttgccagcattcagttgggcactctagtgagactgccggtgacaaaccggaggaaggtggggacgacgtcaaatcatcatgccccttatgacctgggctacacacgtgctacaatggatggtacaacgagttgcgaaaccgcgaggtttagctaatctcttaaaaccattctcagttcggactgtaggctgcaactcgcctacacgaagtcggaatcgctagtaatcgcggatcagcatgccgcggtgaatacgttcccgggccttgtacacaccgcccgtcacaccatgagagtttgtaacacccaaagccggtggggtaaccttttaggagctagccgtctaaggtgggacagatgattagggtgaagtcgtaacaaggtagccgtaggagaacctgcggctggatcacctcctt

SEQ ID NO: 2 - DNA, 1325 bp, Bacillus licheniformis
  source 1..1325: mol_type = genomic DNA
cacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaaactctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagcgcgcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggcgcgaaagcgtggggagcgaacaggattagataccctggtagtccacgccgtaaacgatgagtgctaagtgttagagggtttccgccctttagtgctgcagcaaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggcttccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatgggcagaacaaagggcagcgaagccgcgaggctaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttggagccagccgccgaaggtgggacagatgattggggtgaagtcgtaacaaggtagccgtatcggaaggtgcggctggatcacctccttt

SEQ ID NO: 3 - DNA, 1541 bp, Bacillus pumilus
  source 1..1541: mol_type = genomic DNA
gagtttgatcctggctcaggacgaacgctggcggcgtgcctaatacatgcaagtcgagcgaacagaagggagcttgctcccggatgttagcggcggacgggtgagtaacacgtgggtaacctgcctgtaagactgggataactccgggaaaccggagctaataccggatagttccttgaaccgcatggttcaaggatgaaagacggtttcggctgtcacttacagatggacccgcggcgcattagctagttggtggggtaatggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgcgagagtaactgctcgcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactgggaaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaaccctagagatagggctttcccttcggggacagagtgacaggtggtgcatggttgtcgtcagctcgtgtcgtgagatgttgggttaagtcccgcaacgagcgcaacccttgatcttagttgccagcatttagttgggcactctaaggtgactgccggtgacaaaccggaggaaggtggggatgacgtcaaatcatcatgccccttatgacctgggctacacacgtgctacaatggacagaacaaagggctgcgagaccgcaaggtttagccaatcccataaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgcaacacccgaagtcggtgaggtaacctttatggagccagccgccgaaggtggggcagatgattggggtgaagtcgtaacaaggtagccgtatcggaaggtgcggctggatcacctccttt

SEQ ID NO: 4 - DNA, 1547 bp, Bacillus subtilis
  source 1..1547: mol_type = genomic DNA
tcggagagtttgatcctggctcaggacgaacgctggcggcgtgcctaatacatgcaagtcgagcggacagatgggagcttgctccctgatgttagcggcggacgggtgagtaacacgtgggtaacctgcctgtaagactgggataactccgggaaaccggggctaataccggatggttgtttgaaccgcatggttcaaacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtaccgttcgaatagggcggtaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaaccttttaggagccagccgccgaaggtgggacagatgattggggtgaagtcgtaacaaggtagccgtatcggaaggtgcggctggatcacctccttt

SEQ ID NO: 5 - DNA, 1459 bp, unidentified
  source 1..1459: mol_type = genomic DNA; note = Bacillus velezensis
atgttagcggcggacgggtgagtaacacgtgggtaacctgcctgtaagactgggataactccgggaaaccggggctaataccggatggttgtctgaaccgcatggttcagacataaaaggtggcttcggctaccacttacagatggacccgcggcgcattagctagttggtgaggtaacggctcaccaaggcgacgatgcgtagccgacctgagagggtgatcggccacactgggactgagacacggcccagactcctacgggaggcagcagtagggaatcttccgcaatggacgaaagtctgacggagcaacgccgcgtgagtgatgaaggttttcggatcgtaaagctctgttgttagggaagaacaagtgccgttcaaatagggcggcaccttgacggtacctaaccagaaagccacggctaactacgtgccagcagccgcggtaatacgtaggtggcaagcgttgtccggaattattgggcgtaaagggctcgcaggcggtttcttaagtctgatgtgaaagcccccggctcaaccggggagggtcattggaaactggggaacttgagtgcagaagaggagagtggaattccacgtgtagcggtgaaatgcgtagagatgtggaggaacaccagtggcgaaggcgactctctggtctgtaactgacgctgaggagcgaaagcgtggggagcgaacaggattagataccctggtagtccacgccgtaaacgatgagtgctaagtgttagggggtttccgccccttagtgctgcagctaacgcattaagcactccgcctggggagtacggtcgcaagactgaaactcaaaggaattgacgggggcccgcacaagcggtggagcatgtggtttaattcgaagcaacgcgaagaaccttaccaggtcttgacatcctctgacaatcctagagataggacgtccccttcgggggcagagtgacaggtggtgcatggttgtcgtcagctcgtgtcgtgagatgttgggttaagtcccgcaacgagcgcaacccttgatcttagttgccagcattcagttgggcactctaaggtgactgccggtgacaaaccggaggaaggtggggatgacgtcaaatcatcatgccccttatgacctgggctacacacgtgctacaatggacagaacaaagggcagcgaaaccgcgaggttaagccaatcccacaaatctgttctcagttcggatcgcagtctgcaactcgactgcgtgaagctggaatcgctagtaatcgcggatcagcatgccgcggtgaatacgttcccgggccttgtacacaccgcccgtcacaccacgagagtttgtaacacccgaagtcggtgaggtaacctttatggagccagccgccgaaggtgggacagatgattggggtgaagtcgtaacaaggtagccgtatcggaaggtgcggctggatcacctccttt

SEQ ID NO: 6 - DNA, 1237 bp, unidentified
  source 1..1237: mol_type = genomic DNA; note = Weizmannia coagulans
tcacttacagatgggcccgcggcgcattagctagttggtggggtaacggctcaccaaggcaacgatgcgtagccgacctgagagggtgatcggccacattgggactgagacacggcccaaactcctacgggaggcagcagtagggaatcttccgcaatggacgaaagtctgacggagcaacgccgcgtgagtgaagaaggccttcgggtcgtaaaactctgttgccggggaagaacaagtgccgttcgaacagggcggcgccttgacggtacccggccagaaagccacggctaactacgtgccagcagccgcggtaatacgtaggtggcaagcgttgtccggaattattgggcgtaaagcgcgcgcaggcggcttcttaagtctgatgtgaaatcttgcggctcaaccgcaagcggtcattggaaactgggaggcttgagtgcagaagaggagagtggaattccacgtgtagcggtgaaatgcgtagagatgtggaggaacaccagtggcgaaggcggctctctggtctgtaactgacgctgaggcgcgaaagcgtggggagcaaacaggattagataccctggtagtccacgccgtaaacgatgagtgctaagtgttagagggtttccgccctttagtgctgcagctaacgcattaagcactccgcctggggagtacggccgcaaggctgaaactcaaaggaattgacgggggcccgcacaagcggtggagcatgtggtttaattcgaagcaacgcgaagaaccttaccaggtcttgacatcctctgacctccctggagacagggccttccccttcgggggacagagtgacaggtggtgcatggttgtcgtcagctcgtgtcgtgagatgttgggttaagtcccgcaacgagcgcaacccttgaccttagttgccagcattcagttgggcactctaaggtgactgccggtgacaaaccggaggaaggtggggatgacgtcaaatcatcatgccccttatgacctgggctacacacgtgctacaatggatggtacaaagggctgcgagaccgcgaggttaagccaatcccagaaaaccattcccagttcggattgcaggctgcaacccgcctgcatgaagccggaatcgctagtaatcgcggatcagcatgccgcggtgaatacgttcccgggccttgtacacaccgcccgtcacaccacgagagtttgtaacacccgaagtcggtgaggtaacctt

SEQ ID NO: 7 - DNA, 1563 bp, unidentified
  source 1..1563: mol_type = genomic DNA; note = Lactiplantibacillus plantarum
tttgagagtttgatcctggctcaggacgaacgctggcggcgtgcctaatacatgcaagtcgaacgaactctggtattgattggtgcttgcatcatgatttacatttgagtgagtggcgaactggtgagtaacacgtgggaaacctgcccagaagcgggggataacacctggaaacagatgctaataccgcataacaacttggaccgcatggtccgagtttgaaagatggcttcggctatcacttttggatggtcccgcggcgtattagctagatggtgaggtaacggctcaccatggcaatgatacgtagccgacctgagagggtaatcggccacattgggactgagacacggcccaaactcctacgggaggcagcagtagggaatcttccacaatggacgaaagtctgatggagcaacgccgcgtgagtgaagaagggtttcggctcgtaaaactctgttgttaaagaagaacatatctgagagtaactgttcaggtattgacggtatttaaccagaaagccacggctaactacgtgccagcagccgcggtaatacgtaggtggcaagcgttgtccggatttattgggcgtaaagcgagcgcaggcggttttttaagtctgatgtgaaagccttcggctcaaccgaagaagtgcatcggaaactgggaaacttgagtgcagaagaggacagtggaactccatgtgtagcggtgaaatgcgtagatatatggaagaacaccagtggcgaaggcggctgtctggtctgtaactgacgctgaggctcgaaagtatgggtagcaaacaggattagataccctggtagtccataccgtaaacgatgaatgctaagtgttggagggtttccgcccttcagtgctgcagctaacgcattaagcattccgcctggggagtacggccgcaaggctgaaactcaaaggaattgacgggggcccgcacaagcggtggagcatgtggtttaattcgaagctacgcgaagaaccttaccaggtcttgacatactatgcaaatctaagagattagacgttcccttcggggacatggatacaggtggtgcatggttgtcgtcagctcgtgtcgtgagatgttgggttaagtcccgcaacgagcgcaacccttattatcagttgccagcattaagttgggcactctggtgagactgccggtgacaaaccggaggaaggtggggatgacgtcaaatcatcatgccccttatgacctgggctacacacgtgctacaatggatggtacaacgagttgcgaactcgcgagagtaagctaatctcttaaagccattctcagttcggattgtaggctgcaactcgcctacatgaagtcggaatcgctagtaatcgcggatcagcatgccgcggtgaatacgttcccgggccttgtacacaccgcccgtcacaccatgagagtttgtaacacccaaagtcggtggggtaaccttttaggaaccagccgcctaaggtgggacagatgattagggtgaagtcgtaacaaggtagccgtaggagaacctgcggctggatcacctcctt

SEQ ID NO: 8 - DNA, 2069728 bp, Pediococcus acidilactici
  source 1..2069728: mol_type = genomic DNA
gaatttggcgttcccagcctctatttttgtaatatgggtgtagatctgttgggttgcgagatagtcgagacgtgttccagccctcagagttctgtggcttctgacactgaatctgcctcacaagcaagtcaaaaatagtataattaatcctctgcgcttcggcgtgggggcttttttgttgtctggacaggttgttttaaagtgtatttgggtgtaggattaccattagtaggagaattagtttaagggttaaagggggagtaggctcttgaattgagttctcctattttttattgaaatgacatcattattctccaacgtaggaagaaaacttatccacgccaattatttcggaaaaataacttaaaatacagaaaaagtccactcgaccaataaatggttaagcggactttccttaatacaaataaagtattacaatgaaatagtaagccaggttcctccaaagaatatcaggcttgccgggaaatcaccagcttagaaataggctgcgtgattttttgtttgtgcaatttattttgatatctgaaaaagacaggtttatatagttaagggtaaaattcatcgttaatacaaaataaatcgcagaatttatattaaagcaaatctagaagcattgcaagcaacatgcatggctaatatattacgattgatggcacgatttactgatataaaatagaaaaagccgaatcaagaagattataaaaggcacccatataggtgcccgcttatttaaacatgaagtactgctatattgtggtggtgctatagtggtgcggtaaatacattaaagtgttgatataacggcgtttataggaagttttgaaatcttgtactctccttattagtacctattagaccctaacgagaattaacgcttgttagaaataaaaatagcttaaagcctatcatatcaaggcattaagctatttttttgtttttgtagttccgattagaatatcactagaaattaaaaagttggttcccattttattttaggagtatttttaaatagtttttttgattttactaaattgcaaaaaagtattcagtacacagagaacgattagattagtaagtctaatgagtacaggattttcatttacctatctatcagtcactaacggggtgtgggaaccaaatgggaactgaatcgctattttactttggtttctaaatttttatctggctttcgattcatcagtttttcaactgacttttcaatcttcaaatctgatttctgtttgtattcgtcaattagatatgaatacactcggctggtaatagatacatcagaatgacctaatcgttttgatattacatacaaatcgaccgtttctgatagtaaataagccacgtgagtgtgtctcaatgaatggaagtgaaaaccaccgtgttcaatgtcacaagccgtcagcgactcttttaacgtcttattgactgctgaagaagaggggatggttccatattgatttaaaaaaatcatttcttttttacttgctggtttaagttccttaatagcagctattaaagtatcgttaattctaatgatacgatcaaaattagctttggtagattggaatttaccgtcttcatagttccaagatttattgattgaaatggtattgaagttaaaattgatatctttccaagttagagcttgaatttcacctaatcgcataccagttccaatcgctagtagaatcatatatttagaagtgaaattcggatttttagtttctaataggtaattagataattgggcggtttcttcaatgctaaggtaatcaatttttcttgaacgttctttatcgaagacgaggttaacactcctcacaaagtccttttggataatttcatcataaattgcgtcctttacacaagcgtgtaacagagaattaaatttagatacggtagacttagcatgatttttgccaaaatctttgatgaacttttgataatctcgtcgagtaatcgaattaatggctttagatccaattggatattttttaaggttattgtatagctgtcgataggtagcataagttcgattagtgacggaactctctttatataattcgaaccaatcccagaaataatcagcaaagacgatagacttatcaatataatcatcgtcaaattcgccgtttaataatttagcctttaaataagcttccatttgacgagcttcgattttacctttgacagtagctgatttatttttacgtttgccatctttttgtacactaacttttactcgatagttatagctaccatctttattgaatcgtttaataattgccattttaacaatctccatttctattgttggaaatggtcctcaatgctaaaatagatatagtaaagagaccacttccaagtggttgatttgttggtagacacactctcaaaactttggtcggaaatgagaatgtgtcttttttgtaggctaattagatttagaccacagtttcaaaatgtcattaacttctgcttctgctgaggcataattaaagcgtgatgaatcaaacatgtagtatatagctccgtaaccaaatttattatcaaaaaatccaatatgttcaacgtccatgtcattttcttttaaataatcataaatgggatgcattcttttctctgtaaagttatcatcgttcaaatcgggaaatgtaatatctgtcataatgccatgaagttccatatagtttaatgcttcttcttttgtacataactcttcgtctttttttaaatatgccatttttaagcttcctttctgaatttatttagtcaagcatcataaagagttgaactgtatctggccaccagagcggggatacctttttttgaaccctcattcggtatacttgtactatacaaatgtttagagaggggccaagaatggataatttaatttatttagtaccgggatttatttcatatatagtattaaggccgtttggattatttaactttcaaaatgattccgatagacagataactttgattattttgtcgttaattaattcaggactttcagcgacacttagtagttatttttggaaaaatattattgttgcaatgtttgtgagtgcaattattattactgttttttattttttgctatttattgtatataataaattttcacaaatgatagcaaacaaattaaatgtaaacctctacgatgatatggggacgttagaacattctctatctcaaaattttaaggataaggaacaatttttgatttcgtttgattttgataacaaatatattgcttcagggtatgttaggaatgttgatgatcaaggaaatcaacaaatagaactctatggtcaagcagaacacatttattccattgaaactgccagaagactttatgaagaaaacgatttaaactctattattatagattataaaaataaagttaaatcatatgtgattattttttagttttaggtgttggagttggagctggttttgcagaagtagttctaggcttagctaaactcttgttctcaaaattacgaccatcttgcgggcgtaagattctagtttctttttcactcaatatattcacctccttaaatatccgaaagggtgtttttttacatatttaaaatctgtttctttttagtatcaaattcttcttgtgtaaggattccctcatcaagtaatgctttatattttcggatttggtcaggaccgtcaagcattttatcgttgctagtattagcggaggcgttgcgcaatgaagatttatattgttctgatgcttcctttattttatcgaccataataggagccgtacttttgtccacttgttcaattaaagttgtaacagcaccatttgtaattgctatttttcctaaaagaagcccttttgaatacgatacaccatttatcatatctaatggaacttcagtggatttaattccgaaaatcatccctttatcaataaatataatcctcttttgtgtaagaaccacaagtacagtatttccatcaacgaacccagaagttgcgtatttaatgacttcatcatcacttaatatctcaggtaaagcttttacttctttcttcgtaccaaaagtatctgaaactccagcagctttcatttgtttttgaatattttctaaattcattttgctcctccaaatatgtacagcttttatagacatcagattgttggtcgtaaggttattcttctggtattccatatgaagaaatcaattcgtttaatgtttctggatatcgatcattttcttctatataaagaacgccaagtaaagcagcagcaaagacgtctgattcgtgttctagcttagagtgtccaaatctaataccagtgtagtatccagataatccctcatgtaagattacatgcccaacttcgtgagccatagtgtagtaacgagagggaaggtacctaattcgttcattcatcataacgacaggttcgtcattatcgtaagttgttttagcaaatggtctttttccaaatagggggagtccattcaacatctatatttaacttattagcaatggcaaatggatcagcagtgttatatctttcaatcacggtttctacagcttctttaattttatcggtattcatagataacacctcttaatcatgtttgtggcgtttccagaatattgtcgtcattgcaagttttacttgctgcttttcttcctcagttaaatcttcgccaccataagtcattccaccttcaaggtttctttctaagaaggtttctaaatccttcgtatctttttcatttgcccattcgggtgtttcgtttttgcctaatagataatctacggttacatctaaaacatcagctacagattcgagagtttttcgactaggcgtaactccctcaggataagtttttgatggtttccaagtataaatagatttttccccaataccagctttacgagccaattcagctaaactatatccgtgttgttttgaaatctttttaactctatcaaatagtgtcatatcagtactccttggggtactgtattgttaaagtactaaaaaagtatcgtttgtagttgactaagtactattttagtattatattaatacatataccaagttattaaacaaagttcacgaacaaaaaacgttgatatagcgactaaactattgtatcaacggaacatgtttattttttcgtttgcttatttactatgtaatcatagtactaaaagagtactaagtcaacacggttaattaactttgttaacaaagaaggggtaattattttgccagatgtatggaaatggaaggaagccttggctaaggcacatttaaaacaagaagaagctgggaacgttgtaaatataagtaaaaaccaaatgtctatccttgttaaacgaatgatattaggaaaaggactactagcatctgatttagataaaaaacgttggaaattaatacttgaatatatcaagtttaagcaagaggagttaggagattcagaggaggttatcacatgaatcaagaacagttacaagaattaatcgataaagtcggaatgtctaatttagaagaggctattaaagcccgaaaaagcaaactaacctatatgaatgtttttagaggaataaaaattgaatctgaggatatcgagaaaatcaatcgtaaacatcacatcgtcacgaatccttatgttgattttaatcgatatagaagtccgtactcaaggaaagggcaagttggatatatcggattcgactacgatggggaggctttgacgcataattctttgggagtgcgtgatttgcatgcggcaattaagacgctgacgtttgcattacttggcgagaagaacggcaagaggctagatgaagatgaattaaagtttgcacgttctgcatatgtgaaattaaaagaactttatttaaatctttacgacttgcggttaatggaattggaaaggtagaaaggttatgaataatagggaagcattacttaaacatttcagtatcaaagttaaaccactaaaagatgaatttggcggggaaactgttaattttgcagaggaaattattaaaactgcaaaaagaaaagaccttacatatgaggaagcatatgcaggtcttgagtatgcctatgaacttatgcgttatcaagcgcaatttcttcaaatgagataagttcatagctagcttcagataaatttatgactggcaaagtattgtcactagagaggtaatcaaaaaataagcttgactcttgaaaagaatataaatccatagaatctacattaattgcgtgggcattgtttttttctttaagactatttatcttgtcaaagctagaattcagtttttcaaatactgtaaaaatatttttttctgaatcaaaatttggttcgaataatgctttataccagttaaataaatttggttttgcaacattgtaatttaaactttttttctttaattctaattgggaattgaagtaccaaacataggagttatctttagaatctttgtttaaaaaatgacctttaaaaatttttccgaaagaatcttgatagattggcatcaaattgtagccattggtatttaatgcatattctaaagcttgcatttcaaaaatagataatttcatttatatcaccacctttttattgaactaacttaattatacgcagaaagaaggaaaacaagtgaacgaattacagaacttcaactttgaaggaaaacccgtaagaactgtcgtaatcaataacgaaccatattttgtcggtaaggatgtagcttctgcaatcggttatcgaaataccaaagatgctatcaataaacatgttaagtctaaatatagaagggagtcaaactatgacagtgattagcgaacctggtatttatcaactagcaggtcaaagcaagttacccacagcggaaccgtttcaagattgggtttatgaagaagttatcccgtctattcggaaacacggagcatatcttacagacaagaaagcttatgacgtcactcacgataaagatgcattagcagacttacttgttcaagcgggtaaccagcttaaagagaaagatttagttatcgaggaaatgaagcctaaagcattatttgctgattcggtcgcagctagtcacacaactatcttgattggggaaatggcaaaggtattaagaggtaatggtgttgatatcggagctaatcgattgttccaatggcttcgtaagaacggctatctgatcaatcgcaaaggaactgattggaatatgccgagccagaaagcaatggatttggggttgttcaagattaaggaaacatcaattagtcatgctgacggatccgtttcgatttcaaaaacaacgaaagtcactggtaaagggcaacaatactttatctctaaatttctaaaaaaaagattagtttagattttgacttttcaaacgttataagaatggaggatttgacatggttgcatatgtttcatggaaaatatttttatttttttgtgtagtagttgctatggcttataaagctggaagcatttctggtagaggccattagtgaagaatcaatttaaaaaggagttgaaatgaatgatacaggttgctaagagctttgagggagcgttcgaagttccgaaaggctatgtattaatcaagtctgttgacttaaaagagttggataagaaggttcatgctcacgaaatttgggggatgaaggaacttcgagattacacgcttaataaaagtgagacatggatcaaacgtcatattttgaaaaatccagcattgagagatgagatacaaaagttacgtgatagaggtacattgaagggtggtgggtatggttctaattggatgatgtttgcagacgatattaaggaatttatcaacgagaataaagaaatcattatgcgggaggagaagtactgaagttagtacgagttgatcatagcaagtacatcaacacggataggattaacgcagtggttgaatataatccaaatgaaacacatatttttactggtgatagctacgaaccttttatcttcaatcaaccaattaaaaaagtactcgacgctatttgcggtagcgaggagcacttaaataataacgagaaatttcattttgaacatggaagtttaatttttgaagaaaatggaattggaaccagaatatttacgagaaatcaagtgaaggctataaaacttttatttaataatatccattagatgggtaccaaaatcagttatatggataaatcccttattaacttcaaaattcctatcgattgtaattattactttatcatctaaagtttgagaagtataggagtggtaaacatcagtgtttttaaatgagttgtaaagattggtaaaaactttatcagttaaccaatgctgaaaatttatttcaataataccaaggcctcgcaaattatctaaatgtaaatcaaggtctttataacacttatctgttgttagaataattggacctgtgacattatgggttgccgtattgtctttgtttgattcagtcaattttgcaacaggtatttggtggattcttaagtcactatcaaaatatgatgtacgtaatttgctaagtaagtttagggcactagcatctttgtaacccagctgagctattactgtagcgtctcttggagtaattgaatcattatattttgaatctaaagatttagagagtaggttttcaaacatttctctaatatcatcctcaccaattttatatttagatttctctagagtttctaaaaaaactggtaaccgagatacatctcttcgcttttcaggtatagagttaatttttttgtggatattatttgcataattatccaatttctcttttgtatatatattccacattaataatggataacagatagttcttgcaagaccgccagcactgtcacctaatattttcccagttgggttaagaatactctctactgtactttcaggtaatgcatcaaatccacttttaattaaattaggatccataactaatcacctcctttcataatgattatacacaaaagaaggtatggaaaatgaatttagaacaaaataaaaagcccgctacagcaatagcggacaaataaaaataatttacatctcaagtatatcacacaggagaattcaacatgatcaacaaagcagttttagtgggacgtctaacaagagaccccgaactacgatacacagcaagtaatgcagcagttgcaagcttcacaatggctgttaatcgtcaatttacaaatgcgcaaggcgaacgtgaagccgactttattaattgtgtgatgtggcgtaaagcagcggaaaatttctgtaacttcactcgaaaaggttcattggttggtattgatggacggattcaaactcgaagttataagaatcaagctgatcaacaagttttcgttaccgaggttgtggccgagaacttttcactgctcgaatcaaaggtacaagcagaggcacatcagcaacaagctccagcaactcaaactaatactcaaacaaagaaacaatcaaatcagaatcctaatgatccatttacaaatggcggacagtcaatcgacatttcagatgatgatttaccgtcctagttggaggtggaagataatgggcgataggagaatgttaagccgtcgagttacagatagtacaaagtttctaaaaatgccaatgagtagtcaggcattgtattttcacttggtactaggtgctgatgatgatggtgtagttgaggcatttgcagtcatgagaaaaataggtgctgccaacgatgatatgcgcttgttagttgctaaaaacttcgtgattgttttaaacgaagacatggtcacatatattaccgattggaatgagaataataatattcgagctgatcgtaaagtggattcgatttatcaacaattactattacaagttgttccagatgcaccaattaagaaggcaaaaaagagagcagatactaaaaaaacaaaacaaatcagtagtcagtcacaaccacaattaacatctggacaaccaatggacgtccagtggacggcacaagataagttaagagaaggtaagttaagagaagataagttaagtaaggttaattcagtagaagagagtgaaaaagaaaattcatccccgaccaaggctactgtctacgacttatatcaagagaattttggagtaatcagtccctttattgtcgaaagcatcgactacgacatcaaagaacacggcgaggaattagttatcgaagctatgaagcgtgctcgtttgaatcaagccaattataagtatgcgcaaggtattcttgaaagttggagcaagcagggtgttaagacgatggaagatgttaaagcttcggatgttgaacacaatcagaagaaaaaaattcggagtggacgtcaaccagtgcagagggaaactttgcctgattgggcgactgatgataatgctcaaaaagaaagtacgaccaaaaaagttgatccagccgttcaagcggtaatcaatgaacaaatggcagctttgacatctcgaagaaataaagaggtgtaacgccatgtatcgattgattgggaatgtttcaagaaaggtatataagtgttccgagcataaatcagatttgattcgatggattaatttgttatcaacttcaaaagggaaatcagtaattcatttgaacatccccgaagcaatgttgatctacaaagaagttaagaaggagcaatcaaaaattgaataaagaaacgctaaaaatgattgaacgagctagaaagggaatttactacaatacgaccgcttggttctgtgaacaaggcgatatcagagataacgtcttagtattgcatccctacgacccgtactttagtagaatgccaccattctcaagttggaatgaagactacaagcgaagtgtaatcagttattttaaacaatactttgcagaagctaatttaaacgtttggttagacaaagttcaaataacagagtatgtggagggatgaacgtgttttatttgagggttaaaggtaccaaggaccaattcatgacaaaaaatctatacgaggttactagtgatttaaatgtagctgtgagctatgaacgacagattcatgcaatcagtcgtaaacaatcctacaaagcttcactaggtacggtggataggtcagcaaagcgatttgaaatcataacagaggaagtggctagatatgggcttaaccagcgaaattgaaatttattttttcaataacaacattgctacgcttgattttgaaacatcaaagcaaggttgggtttacatcacgacggatgctgagcaaccaatgttcagataccacaccaagagtccagaactattacaacataatctaagtaataaccgctggtgtgacatttggctaggtattcggaaacagcaactagtattattctagggggttaatgtgagaacactatacggttacattaaaggattgatattttatttagctgtaattctagtttcatgggcgtttgtactttcagtaattaaaggaattctagtgttattgaatttgtttttcggatagaagggaaatttaaaaatgaaagtgaaaactaagtacaaaacaatggtaccgaagggatggattggaacggttattgacgaagatcgttattcatacctagttgagtttgataattttgaacgtttcgcatttggaaggagtcaagttgaggaggtagaaaaatgttcaaagagttaaagaagaagctttttggtgaatctactagtggtgaaggtcaaacgtatgagtacaattataactataattacacgtttactactaactgtagctgtgattgtcagccagatattgaacaggctgagaagttggtagatatggctaagcggaatgcagagaaggaaaaatgagtaaatcaattgaaataagtaaaaaagaatacatggaagttttggcagataaattcaaatccagaatgttcaaagagtttccatcattattcactgttaaagagcttgataaagccattagtacaacgatggacgaatttaaaaatacggattcgaaaagattaaaggaagatattattaatcttgctacagataaggctgtagatacttatattgaacacttcactcaaatagaagctgtattggatggagttataaaaggaattaagaaatagcaatggattacgcactgtacaaaggcgatgagtttctagttgttggaactgctgaagaatgtgcaaaatatctgaatgttaaagctgattccattaagtggatgagtacaccgactgctaaacgtcgattgaaaagacgtaagcgtaaagaaaaatgtatttcagtaatcaaattggaagaggacgatcagaaggacgaagaaacatgaattgattgctactataaaaaataggtgattcgggggatgaaactttgtcaattgatttaagtgatgaaacaattaacaaaattgtagatgggttagttactcacggtaatcaggttagcaagatggaatcagaaaaagagcttagaaataccaaggagctttttaaaaattatcggttactagaaaatcatactgatattgaattaccaagaatggaagacgatgtcccattatcgaagtatgaattgtcactgtactcattactgggttatcgtgcaagatccaaagagatgattaattttattaataaagtattcgacagatacaaagatatttgtttacatggcacatatgagcagagtaggcgttacggagttattaagtcattgtatatagacagtaatgctttaactatagcaaaactagcagaacgttttaatgtagatgaaaatacaattcgacgtgacgaaaaaaaggcaattagtgagttatcagttatgatattcggaattgatggattaaatgatatgtcaaaatgatgtcagaaacgtgttaaaaaatgccattttgaccatgttaatatgatattgtgccaagatgagatagcttggaacctccaatgggaacttaacagacttacttcgataggtctgtttttatatatgagatgtggcggaataagtagacgctaattaattcttcagcccccttgtcttggagagaagatagaaagtcagttagactatacactttcgtgcgaaagggaacggctattatgtaaggtgcaaatccttaccatctcattgccacatttagtggtatatctccagtagttttttctgcatgatagggtggactccctatcttttttattgtttaattaaaatacagaaaaaattatttcggagatggtatatgatggatgaaaatacagatccttatgctctttatgctcttccagaattttttacaaaagaagaaatcaaaaaatttattattccttatctgccagatataaagaatgagggtaaggtagatataatgtataagtttctggaatatttagaagaattaaaggaaagtgactttgagaaatatattgagttaatttgtttaataaataaaaagatattgaataaattagaaaatgaaaccagagtcgtaggtattacgtactttgatgggttcacagacgttgacaagtcaaatgtagatgaatttgttgatcacttttttaaaggggagatagattcaaacaacatttctcaagcaagaccagaattaaatatgcaacaattggttcagcaccatgtctattctaacaatgagaatcaggtaacaggaattgaactaacttatgttagaccatatatgaaagagcttaatgatgataagtctataagaacagatttcactcgtgtggtttttgactttgtaacaaaaaaagctagtttttattttggctatgataaagtaggcatgggaaattttaatatacatcccgaagacacttttatgaaattaaaagagcgattagaaaagtggtttaatatttattttagttatttagatactgataatgcagtctttaaattttataaaggtctaactgaaaagaacgaaaagagttattatgatgagctcgttaagattgaccatgacagtaataacaatcattctaaaatagaagaattttatatagagatgtgtgacatgttgaacacaaaacttcctggattaatgggaaaaattatctctgaaaataataagaaacaatatctcgaaagaattacccgaatttttatgagaaaaattattgaagatgattttgaacattttaaacaaaaaattttagataaagaagcagttataaagggatttatatttgttgatccattaggtagtagtgtacagggaaaagatggaaatcaaaatgatgacaccgatccgcttgagtcatctaatacatacttggacactagagaatctatttataatgaaagaaaattaaaaagccttagaattaagtttaatccaaaagatgccagatattactttgaaaaacatgtcaggttcagtgcttttcaaaatcttataattgttagatttttaaggaagcctgtatcaaaggagctagaaaaatatgcaattcacgaatttggaaaatttgtacagtgaatatagaaatagtagtaaaaccgaaatgaataacttgctacaaaaaagtgcggagaaattagatgggtggttattaggacaagatattagaaagcgacaaaacatcaatgcgttagaatttgctcaagaagaaaatgtaccagtaagaactgctgtcattttatttaatgatgcttgtagcaaaggaatgtttacggcaaaataccgatatagaaatcccagaagtgggcaagtaatagcatttggaaattctccgaaagaaataagagaaaaagcggtcgataatatgattattgacgacgaaactgaagaacctatttgctttatagaagaactaatagaaaaaagattctacctaaacgaagaacccaaaaatggttttcctttttataatgtgagtagtgacgagattgttcctgaactaacgaaagaatttttgagtaatgaaggtatgacagaattttgtagcgagggaatgttttagatgaagagtagtacaacagttaagttactgataatcttgagttttgtagtaggatatttttttgaaaacatattgaaatcaaccatcgagataattcaaaatcccgaatgggttggggcattagcaacgttattttctgtcccaatatctacgtattttgtgttaattcaattaaagaaaggtgataaagatagacattatgatgctagaactttttttgttatcagctggccaaacaagaataaagttgaagaggttaaaaaaaatggttcatttattatgcatcctaagaatatgggggtattttctttagaaaaattaccaaaggataatgagcatacttttttttctataagtaacagaggtactaattttgcgaagtatgtttttattgaggtagtatacaaagaaacaaccgaagtcttttttatttcctccgtattaccaaatgaaaaatatattgtaataaccgataatattatcaatgataacaggttaaagataaatgagattaatatctattattgtagtattttaggggattggataaagcaaagttatataactggagagcccatgggagaaataagtaccactagcaaacctaaattcgacaagaatgatttcaagaccgatgttgtaaatggaattgaacgtgggaaaaactaaaggtgtcttaatgctatcaattctagatggctagttattttatataatgttctggggtgattataaatggaacgctttcagaaaatatgaagtagacttaatttaataaattttttttttgttacaaagtgaaaggtaagcaagatggacataaaagcaataacagatttgtttagattaaaagaacatcataaattctcaatagcagttattacttcagttatgattattttcaaaaaaaatataatcgaaaactttaatgcagaaaaattttatcatatatttggcataataatttttattttgatggtatctatgtggacaatagtattagttgatttaattacacctattataaataaatgttgtaaatccataaaaaatactttaaaaaagcgaaaaaatattaattttttaagtaaattaaatgaaagacaaaaacaaattgtcgaaaaattatatcattcggaaggatacagttgttacttgaaacagcaagatgctgatgttttattccttcaacaaagtggtgtaattatgcaattaaagtcgaaagttctatttcgagaaaaccaagttgaagatattaataatccaccgataccatatgttttacaggtgtgggttattgattatatatcagtgcaaggacttagaaataagacatgaaagtcatataacttaattgttgtatggctttttaatatctgcgtatatttgataggcttacttatgtgggtatatttttgtgttggagggaaattaaatgaattggaaaagacttggttttttggtggtccttattgcgatattagttctaccttggctaattggagtggcaattaataatatccccaattttggatcagttggtagtcaatctgagtggttgagtttttggggaagctatgccggatcaataattgcagtattaggagtatattggcaagtaagcaaacagtcccgtgagactagagatgaagtggataagcagagacaacagtttgaaaaacaatttaaagagcagaaacgccagtttgaaatacaactcaatgaatcaagaagtcaattggaagaatcaaaaaagaatgattttattaattcactcaaattaaacgacgtaaatttattgaataaaatttttgaacgcacaaatgatgtatactatgaactcgaagatatatatttagatataggtaaaatgaaattcaaggaacacattgctgataaagagaagattctaactgcatttgataatagattcaatatggtagtagatccgtatggaacatttttaaatggacaaatgctattgttttcatatccgagtgaagaaatgaaaataaaatggaatcgaatagttaaatgcgtggctcaggtaagagatgaaatcataaaatctgaagaatttatgattgacgaggaaaacttagataatgcatataaaaggcttttaaaatcactccttgaattttctgaagtagtagcagccagcagaaaaaatttaactggtattgttaaataaaatggctcttcgtcaactgttgttggtaaactaaattttgaaagttctaatcacttggtgattagggcttttttagtatgtatgcggaaaacgtaaagtactctaatcctaaacttaaaaaaacttcggtagccaaagccagctcttttaatagctttgattttattatttaatccttctaaaggtccatttgagtgttgtgtaatgaaggtattatggatttcatcatgatgagtttgaagcattttaagcgtactaagcatttcttcagaacaaccttcggtgttccaaaaggcggcattgtaattgttccaatctttgtgtttaagtgcagcttgaagtttatttaagacgttgtaagtttgcttgagagcgggatcaagatttaacagccgatctacaatatctttggcggtgacccagtaagggaaataagtccatttatgaaattgttcaaaatctaactgttcatgaggcactagcaataatttccaatagcgtttaagtgctttaaattcacgggaagatggggcaaattttttcattatgcgaactctagtcttattaaacgcccgattaagggcgttgacgatatggaacttatctacgacgacaatcgcatttggaaagatagttctagtcaactttgggtatgtatagttcatatctgtgacaatgattctgacattttccctggccgctagatcataacgtttaaagtgtttttctagtcgttggatagtccgaaaaggaagaatatcaattaatttatgagttttggcgtccatgaattcaaagctcatggcatcagtagcggttttagtacttttgatttcatccatcaagattacttctggaagccagtgaaaatttggcttaaaatcgcgttcagctcgtaatagttgacgtccaacaaaggagtcggatgtcgaaagttcattagcaatatgttttaaagacactggttcagcaagtttttctaggcaagctttacgggttggattagaaattgtgcagtgcttgggaactagattggtttgcgccagaaaattagtttggcattctttacagcgaaagtatctgcgctttaacttcaagacggtatcatttccaagagctttagcaaagcaaacggtggttaaccgccacccatacctaataatctgtccattattcataatgccacatttgggataagccatcggcttgtagtctaaagtgccttccaagcgaataactccatcacattttcgagcaccatttttaatttttatatgattatcatctatacctaacaaaagcttagtagtatccttacacgtaaggacattcacttctttctgaaaatcttcgtcgtggttgattttttctgaacggacagtgagtgtccgttttttatttaaacaacaaaggaaggagatcaatatcaaattgacacttgcatttaaccgtcaatctgcttacaataagtaagtgaaatgacaacggcaatgaattattagcgtattctttgttatgaagccattttagaatagttagatttttaatcggggggaagataccatgacaatgattaatggttatgaacaaagtgatcgtgaagaaaaaatagatattttgaatttggaatccttagaaaaacgggctgaggagataattccagcaggtggatttggttacattgctggtggctctgaagatgagtggacccttaaacaaaatagaatggcgtttcatcaccgacaaattgccccaaaggccttaagcgggattgaaaaaccagagctaaacactgaaatttttggaattcctttgaatactccggtaatgatggctccagctgctgcccaggggctagcacattctcaaggagaaaaggatactgcgcgcgggcttgcagccgttggtggactaatggcgcaaagtacctattcatcagtatctattgctgaaactgctgccgctggcggagacgctccccaatttttccagctgtacatgagcaaggattggaattttaacgagagtctgttagatgaagcaaaaaaggctaacgttaaggcaattattttgacggttaacgccaccgtggacggatatcgggaagctgacataaaaaataagttcacgttccctttgccaatggcgaacttaattaagttttctgaaggaaatggtcagggaaaaggaattgaagaaatatatgcttctgccgcgcaaaacattcggccggaagatgttaagcgaattgctgattatacgaatttaccggtaatcgttaagggaattcaaactcctgaagatgccattcgagcaatcgatgctggagctgccggaatttacgtatccaaccatggaggccgccaattaaatgggggacccgcttcttttgacgtcctagaagacattgctaccgcggttaacaaacaagtaccaattatctttgatagcggcgtgcgccggggttcagatgtgtttaaagctttggccagcggagcagatttagttgctttaggccgtccagtaatttacggattagctttaggcggagctaagggagtgcagtcggtattcgaacacctaaaccacgaattggagattgttatgcaactagcaggcacgaagacaattgaagacgttaaaaataatagtttgttgaatatcaaatattagactgtaaaatttcccatttcaggcttaataatcagaaaaatatgtaattaataaatcagcttactgagtgcatgttcaacgattttaccgcagcttttcgctaagatgaagaattagtattttagttttcatgatcggcgacctcgataatctggtagcctggctaagtgactaagaggttgataatgcaacgcaacgctaacaagtacagcaatttttgaatagctcaatatcaagaaatacctcagccgatttggtggttttgaccaaatcggctttttgattgtttgtagtcgattattacaattgatagcattaagctaaattaaaagtgggggagcaattctcccttttaattaccaaaaaatagcgccatgcaattgatttgaagaagggattaacgatgcgaaaattaaattataatcaccaagaccagtggaaaaaagaagaccggacgacacaatcaccaatcttgattgaaaaagccgggttagaaggcaaacaaaaccaagtaattagtagaaccaaaccgtacgccgctacggaggtacataacaaccttaataacctgtctttaacggctaatggggaaattaagtctgatcgacgtcgctttcaattaatggaggtccactttcaccatccggcggaacatcgttttgagggtgaagccgagccacgagttttagaagcgcactttgttcattatggcagtttgaaacaaccgctggtagttagcgttacatttaaaataggtcttaaaaatgaagtgttcgagaagatattagatgctatggaggacggagcggtgacccagccgttaattttagaggaattaatcccccaagacggaaatttttatcggtacatcggttccctgacgacccctccgttgaccgagggggtggaatggttggtatttgaaaatgcgccaacgattaacctacaacaactcaaccgatatactgccgtatttgccgctcctaataatcgagcgttacaaaatttgaatggtcggagcatcgagaagtatgaactttaagaaagccccagaagctagtttatcgattactatgtacttacgttagctttatcgccaataattgttaagcggatcattcaaaacggaatgaggtaattataaaaaagtgactaataccaccactggggattagtcactttttatttaactgataaaatatttaagagttaatgtaatgctgtatagaacgtaaagaatccaagaaagatccccgggacgttggctacaataattggccagtcgcgctcagccttgaaataaccgtatattgtccaaacggtgcagttaatcccagcaactagcggttggataggattcccgtaatcaccatgcatattggagattatttgggggatgtatgaaacgtacatcaatacggagagtacggaagccatccggccaataattcgaataactttagtttcttcttgcaagaaatcatctcctaaaacaacttagcttttagagtcatcaatttttggacttattcccgcacacagaatcgaactgtgtccggtcaccagagcgggaaaggcgatttaatttaaatagcaaattaaatcgaatgaataatcgcaccaatcccagtaatcataaagaataatcctactaggtaatagattgataggattgaaaaggctgggtaaattagtaaaagaacgcccaaaataataccaattacggataaaataacgtcaaccataaaatacttttcgttaactaatttaataacgttagagagccacaatgatattatcgaatccatcaaaaacataattgcaaacgaaattgcgacaaacaaaattccaaattttccgttaaacaacattaaaatcccgataataatatcaataactgcgttaaaaaccacccatccagagttttctaaagcatttctaaggacggttaatttgtaaatcccggacaaaatcgcggtaattgccgcaataacgactaccgcactaaaggttgctagaggatttcttagagaaataaccgcaacgaaaatgcttaagattccgacgacaaacatgaatggatcaaatctgtctaataacttattcatgtaaaattcctcccaaattaatgtacagcttttatagacgtcagattgttggtcatcgagtagataaggatataaaaattacttccagaataaattttatcccggatccattaccttttagactgatggttcttgatttaattttaaccgtattatacaagcaaataataaataaaaaaagaaaagttaactgattttgattaattatttcttatgttaccaatataaaaaagcccacaaatgcggacttgtctagtaaatttaaaattttatatgtgcacacgccgtccatgtatcagactgacgtgataaattaataggcaaaatatattaagcaaataaaatgatagctaattatgtaaaatataggtagaatgccccaatttttaacgaacgatcccaaattcattcaattaaaatgggtgtagcttgtccaaaaatactggtatttcaactagtttagcaacttgtaagaaactatcattttcctaactattttttctgagcatctgcaagcgttaaatttgtaatcgctttaaaaagcatttaacataacactcgtagaaaaaaactaactcaaggaggaatgaaacatggctaaagaagaagaaaagatgactcgggaagaagcaggcaagaagggcggagaagcaaccgctaaatcacacgacaaggatttctaccaagacattggtaaaaagggtggcgaagcaactgcagactcgcatgacaaggatttctaccaagacattggtgaaaaaggcggggaggcaacttctgaaactcacgacaaggatttctaccaagacatcggcgaaaagggcggagaagcaacttcagaagctcatgatgaagaattctaccaaaaaaatggaaaaaaaggcggagaagcaacttccaaatcccatggcaaggacttttaccaagaaattggtaaaaaaggtggaagagctaactccgacgacgattaattataatcttgcatttagtataaaacatttttaaaaaaatacaagtttttttctacaatccagacctgatgattaagagtagtcacgaacacttttaattatcaggttttttgtgtcttataagattgggtatatttttttgaaagggtagtgctataatggattgtcgttttttattgacaaatagtaagcatggattgagggaaagctattggaagacgtaattgtattaatgaaaaaacatacctctgtaagaaattttgcggacacatcacttgcggatgaggttaaggaacaactgataattgctgcgcatgcgggtgcttcgtcgaactttgtacaagctacctcgattattgacgtgacggatccgtccatccggggacaacttgctgaaatttcaaagagtgctgcctacgtaaagcaaagcggagccttttttgtgtttgtggcagatctgtatcggcaatcccaaatcttgcaacaacagggtctagacttagccggaattaaaaacatggaggcactaacggtagcgattgtggataccgccattgcgggggaaaatctggcagttgccgcagagtctttagacttaggaatctgctatattggcggaattcgcaacgatttaacaaccgtacgcgatttgctaaaccttcctaaatttacggtgccgttatttggaataacggttggaaaacctacgcgtaaaaatgcggttaagccccggatgccgctgcataataatactttcaaaaatggttacgatcggcaagcggcgcaagatttgagtgaataccaaaaaattacgcaagcttattatgcgaaccggtcttcgcatgcccaagagaccgactggatacggaaaatgaccgatttttttgctgaaccgcgacgtactgatgttgccccatttttattagaacagggctttacgctaaattaaaataattagagagtgggacaaaagtcggataatttgcgagcattaactgaaaattgaccatgatgcctgaattgggcatgatggtcaatttttgattaagcggaaccaactgacttttggcacacgttttgactctattgaagtcaaaataccaaaataactttttaaggacttttttatccttgaaaagtttttttcagcctcttttgctattcaaagcttgctaattaccttacgttaccaaatatactcgaaactgaattaagtgtaacttggcaatgtgtccaagtggtggttgtcggctaaagtagcaaacatcataggaggaataccatggaaatcgaaaggcatcgaattttaaagcttttgtcaaccgtaatgacggctctttcttcaataatggtagttttagttgcatttttaatgaagatgattttagattgtgcgatgaataaggactttggggctctggaacgttcaattggcatttcgatactttacatagcaacctattttttgattaattatttgaaggaggtcttagtagcccggtatattaagaatgaaatggaggacttacggcggagcgtctaccgtaccattatggaacgggattatcaaagttactttagcaaaagcaacggcgagtacatttccgctttgactaatgacatgaccacgatcgaagataattactataaagcttactttttgattgtacaagccgtagtaacgtttgtgattgcgattctttcactagtggtgattaactggcaattctcgatcggggtgttagcaattgctggctttttcttagcgaccgcgtcgtttactgggatgggattgaatgatttacgaactagtattcaaaaggacatggtgaaatttactagtaagactaaagatttgattgccggatatgaggtggtccgctcttttaatgcgcaagataaaatgcaagagcagtttgatcgttacaatcataatttagaggaaatgaagctaaagtttagcgttcgtcagggaatcaccaaggtaattaacgaaaatttagtactcctgattatattttctattatgattcttgggggctggtttgtgatcactggcgcattagtaatgggctcgttaattgccattgtccaattgttaaacagcgtgatgaatccaatcaatatgatgttggtagcggtaaataatagtaattctactaaaaccatgcgtaaccaaatcacggaaatgcttcagaataccacaattaaaaatgatgccaatcaagcaactcacgggacatttaaccaagaaattttgttagcgaagcttaattttagttatgatggggcaaagacggtaattcaaaattttagttttgcatttcaaaagggaaaaaagtacgcaataattggcaaaagcgggtgtggtaaatccacgttactacggttaattcaaaattgttatcctaattatgacggtgaaatgtgggtagacgaccataattatcgggagatgagcgatgcaagttttttaaatttattttccatgatccaccaaaacgtatttattttttcagggacggtccgggaaaacatcaccctgtttaaagattttccggaacaagaaattgtcgctgcggcaaagagtgcagggcttcaattcctgcttgaaaaacttccccaaggattagatactcctattaaagaagctggaaactctttatcaggaggagaacgacaacggatttcgattgcccgggcgttaattcgtcaagcaccagtattgttgcttgacgaatttacgagtgtgctagatcaatttaccgcacagacaattgaaaaagaacacttaaagagcagacttgcattcacgttactcataaacttagcgaggctgacgcgcatttatacgacgcaattttagaaattgacgcgggtcagttagttaaagttacgcagccgaacgtttaattttgccaaaaggtcgggtaaaatttgttaaaattctggtagtcgatgtagaaagagtatactggacttgaataataaaaatttgcggaagaggggaactcaatggcagacgatttaacgttatcaatcaaaacaacggcggaaatgacctccaccgaattatgggaagtttttcaagaacgagttaaagtttttgtcgtggaacaaaattgtccgtatcaagaagttgacgagaaagatcagaacgcgcgccatgtaatgatcaaaagaaacggtcggctggtggcatatgctcgaattgttccgcatgacgatccaaattatattagttttggccgagtacttgtggttaaagagtttcgggggcagcatttagcacaacgtttggttcaagcaaccctggatgaaattaaacgagtggcaggcattcgaccggttaaaatcgctgcgcaaagttacttacaaaatttttatgcgcaatttggctttaaacccgtttcagatgtctatttagaagataacatcccgcacctagacatggttttggaatgaccgaaagtttgtaaagtgttttacaaaagtactccgcaaagtacctaaaaagcgttatagtataggtgtgaaatgctaaacaaagaaaggatggtttttaaatggctaagaaagttttgattgcaacgtattcacggacaggcacgactgccaaagtagcgaaagcactgtacgaattgcttccagctgcggatcggttcaccattgaagtggctcctgggacctttagtgaggaaatgacggaagtttcagagcaggcaactaagcaaacggaaaccggaaatttcccgccactttcgaaagcgattccaaatgtgagttcgtatgatttaatcttggtaggtagtccagtttggaacggagccccagcaacccccatccattccttcctaacggatttacaaggctatcaaggagtggtagcgccattctacacgttcggcggtgatccggggatttttgaaaagaccttcaaagaatgggctggagatttgaaagtgaaagctggacatggtggcgaagaagacttagctgcatgggttgatgaactagtgaaataaccggattattcaaaacaattatgcataaatgcgggcgttatcattttttctgacaacgcccgtttaatataattaataaaattttttacacgccgtattaaggagttccatacggataaaagaatggcgtgggaagtctcctttactaaattaaagataacgcccttcattaaaaatgaactaggagagttgacgcttgataagtcgaccggtatgctttagtcaactacttatagaattagcaagggcacgatgccaacgattcgccataaatttaggttattgaaatccttagtgttagatccacaaaatcaaatggtttaaacttggaggctggaagcaaaaaatgagaattttagttaccgggggcgcaggctttattggcgccaattttatgaatatgtgggtgccccgccgccccaaatttgaatttttgaatttagacaaactaacttacgcggctaatctggataaccttaccgtctctcaagaaagcaattaccacttttgccggggcgacattaccgaccggttgcaagttcgccaaatctttcaggattttcgtccagaagtggtaattaattttgccgccgagtcgcacgtggaccagagcattgtcgatccagcaaagtttatcaccaccaatgttaatggtacgtttaacctcattgaagagtttaaagaattgtgggcagaggattacacccacaaacgatttcaccaagtaagtacggatgaagtttatggtttcttaggggccacggggagctttactgaagcgagcccttatcaaccaagtagtccgtattcggcttctaaggcaagtgcggatctgttagttcagtcctacgggcgaacttttggggtgcccatttcaattacgaacgctagtaataattttggaccttaccaacatccggaaaaattgattccaaaggttatttttaacgcactccgtggggaaccaatccccttatatggaaccggggagaacgtgcgcgattggctctacgtcagtgatcactgtgaagcaatttggcaggtggtttttcaagcaaaatcgggtgcacgttttaacgtgggtgctgaccatccgttgagcaaccaacaactagtgggagaattgttagctattttagctgaaatgacgggcaaatcggtcgaacagtatacgcagctagtacagcacgttaaggatcgtcccgggcatgattttcggtacgcaattgacgccagcctactcgaacaacaattaggatggcagccacaaacggagtttcgcgcgggattacgagcgacagttgatttttatttacagcaatatcaaaaaggtaagctttaaaaccataataaaaggcaggggaacgggcccaaaattggatggtttgagcattaactaaaaaggcgaccattatgcctgaatttggcataatggtcgccttttggctgagcgggaacatactaacttttggcgtacgtttgcttctatcatcaaggcaacgtaccaaaattattttccccaaaattctatctttaaaaagaattttttgtgtttcctcagctctcgatttttaattatgctcgtttagctttgaggaatttttcaatccgcgcaattgcgttagttagatcgtccatacttgctgcatagctaaagcgaacgtagccttcaccaccaggaccaaagctagaacccgggataacggcgactttagcttccttagcaagttgcatactgaatttgaagtcatcttgttctaagtcacccggaattttagccatcaggtagaaggtaccttgcggcttgctgcattcaatccccaacttaacgagggcatcatgcaaataatcgcgccgttttttgtattctacgcgcatcggttcgctatcgttgagcccattttgaaaagcctccaaggccgcgtattgggcaaccgtcgtaatgctggtaaccgacagctcgtgaattttttcaatttgctcaactaatggagctggtccggcaatgatgcctactcgccagccagtcattgcatgtgacttagaaaggccgttaagcacaatcgtttgatctggtaatagatgagaaatcgagtagtgtttttgatcaaaaatcaagtcgctatagatttcatcactaattacgaaaatatcatactttcgcagaatatctgctaaagcggtcaattgttctttagtgtaagtcatccccgttggattagaagggaagttgagaataattgccttagcacgcggatgtgcttgtagagtattttccaattgttcagggctaagtaggaaattattttcagccgtattcatgtagacgatttttccctggttagttttaacgattgggaagtacaatggaaaaattggcgttggtattaaaacttcgtcaccttcgctaacgatggacgttagggtggcgtacattccaccggtaaccccagccgtaatgacgagttcattttctggatcgtaatcttgatcgtatttttgttttaagtattgggctgccgcttgacgaactttggggtccccagcggtggcggtgtaatggctcttgttatcccgaatggcttgaacgccagcctctttgacgtgttcgggggtattgaagtcgggttctccaagggttagcttaattactcctggaattttagaaatttcttcattgtatttaaaaacttgcgccatttgagtattctttacagatggtttgatgcgttctaatagtgcgttaactttatcactcatgtgcagtcctcctcgtattaaaatggttaatttttactagccggattgtcgctgacttactgtccaatcctcagatcaacgttaatcttgaataggacgcccccctttggtagttagagatgaaaaacgaatggccataccaaagctcaaaattaaagggctggacttagctcatggtttctcaatctccctctaatgatttatgataacactaaatggaattagccgaataggtaatcaataaaattaagttactagaatgtgggaaagctgaaaacggttaatgtgacatttttgaaacaaattattgaaaatccctagtttttctgccattttggggctatactagcaacttggaaggcttaagcctccatatattaactctgatatcccatccaataactggacatttacggatgtccaaccggccgctatccaaccgatagtggtttttttattattggccattgaaaacggtttctacgtaatgtataatttgcaccaagcaatatatatattacaaaaggtggtgggttatgaaaaatcagcgtttaaaaattgctcgtttagaaaaagaccttagccaagccgaactggccaacttgattggggtaactcgacaaaccattggcttgattgaagcaggtaactataacccgacgctcaaattatgtgtagcaatttgtcaagctttagacaagacattggatgatttattttgggaggacccatcatgagaaaaaacgttgttgatgaacgagttaaacgaatccgtaaccaaattgcttacgaagctttaacaatcttactgacgctattggcgattgcaattgccttacaaatgacaatttttaagatgccctggtcggcttacgtagtagaggcctttggcttacttagtactagcaggtggttacgtagtggtccggatgctgtttaacggcattagaatttttgatgggcgttatgaaaaaagtttcctactattttacgctgggattgactggtttaaatgcctatcagaactaccaccgctaccagcgtttctaccagggaagtcgaattggctattttattgcggcgaccggaatcctttttattagcagtttaattttgggactttgggtaatggagctactaaagaaacttgatttatggaatcagcggcgtattaaacgacgttttgataaagatgaataagtttttagatatcaagctgctctgatgatagttatggtaaccccaagtgtttatttatgatgactaatatagtgttgttaatttgctcgtgaagaaaaacgtcaagcagccgaactgttttagaaaaattagtaaataaaatagagttaaaaaactatatttagcgggattaaatcaataaatttattagaaatggcgtattttacttttagactggaataggatagaattagtaatcataatcagcggaaactagaaaataaaaaaagggtgaggtggtcaacaattttaaagaaaatcaaacaatttttacggagtaaccagttacaatatagcaagaaatatattcgcccaatgatgacacctgaaagcgtgtacgtttttaaatttggtaaggaagaacttaataatcgggtaattattaagtatacccatacctggacagggcggattaaaattaatgaaattgatttgcggttacatggacaacaaagtccccggatttttcaccgggaaaatgaactgcttgcttatttgaagaaacatttgacggagcaagacggagtcaaggatatcaaacgctaaccgaattacagtaaaacgagaaatttttaaataaactattgacggggttatcgaatgtgcgtatgattatcccttaaagaaaccttaatttggtcccgtgaggccaaaaggctaattgctcgttgaatactccgactaattcggggaaaaccatcaaaaagcctcttggatcacagctggatccaagaggctttttgcattaagaaagggagtagtgcaagttatgtcaaagcaaaagcaaggacagtaccgcaatccggaagcaattttggatattaatgaatgccctacgtttccgcatttagtcggactatcgattcaacatatgtttgcaatgtttggttctacagttctagtaccgattttggtaggcttaaatcctggaatcgcactttttagttcgggggtaggtacattactgtatattctgattaccaaggctaagattcctgcttacatgggttcaagtttcaccttcattgtaccgatgatggcgctcatgaaaactacgggatatgaggggattgcccaaggaacaatttcagtcggagtggtgtatctgatcgtggccttgatcatcagccagctaggttcggactggttggaccgaattttacctccggtagtggtgggaccaatcatcatggtaattggattatccttggcgggaacggccgcaaaagatgccaccatgcgtacggtgggtggtcaaagtgtttatgaccttaagtattttgcaattgcgttaattaccctattgattacgatcgttttcaatatgtacttaaagggattcgttagtttgattcccattttgctaggtttgattaccggatacatcgtagcgttgattctcggagtggttgatttatcgggggtggcgcacgcacattggctaatcgctccaagttttgaaattccttttgtaagctatcatctacacttgagctggggagcaattctgagtatgatgccactagccttcgttacgatgaccgaacacacggggcatatcatggttttaaataccttgacacaccgaaacttcttcaaggatcctgggctgcaccggactctgtcaggggacggggttgcctccatcgtggcaggattcattggcggtcctccagtaaccagctacggagaaaatatcggggtgttggccgttaccaaagtacatagcgtttacgtgttaatgggtgcggcagtcagcgcgattattttcagctttattggcaagttgagcgctttgattgaaagcattccgagtccagtcattggcggaattagtttcctattatttggaacgattgcggctaatgggttacggatcttgattgatgaacacgttgattttaatcagaaacgcaatttaatgattgcggcttcgattttagtaatcgggattggtaatgccagcttgaacttaggggatctaagcttttcgggattagcagtagcaacggttctcggaataattttaaatttagtacttccccaaaaggcgttaagtgaaagataaatatcagcttgaataattaagtggttagtcagaaggaatgcttttcaagaattgaagttcttggaaagcatttttatttaccgtctataagaaagatttgctagcagacagtttgttcggggctaacttgaaaacgacggtaggactcaaatttggtttgaccgccatcttgatagtggtgtcaccagctccccggttttagtttaagttcctcttttctaactgcagactttttgatgggtaaaattagctttacgtttcgaaaattttagtcaaatgcggtattatagtatctaacatgagataacataggagctgatcaggtttgaaatggaccgaggtaaacgtaaaaactactaacgaggccgttgaagcagtaagcagtatttttgacgggcttgatgctgtaggagtaaaaattgaagatgccttagattttaagaactaccaggcttcttatccgagtgaattatatgaattaaaagacattccccacattacggaaggggcaattgtttcggcgtactatccggaatctacggacgttagcaaggtggttggccagttaaaagcaaagcttaatgaattacccaactttgggttggacgttggcccggctagcgtaaccaccgtggaggttcaagacgatgattgggctaccgcttggaaaaaatattaccatccggtgcggatcacccgttacctaacggttaaaccaagttggagtgattaccaagcaagtcaaccggatgaaaaggtgattagtttggatccgggacgggcttttggaacgggaacccatccgacgacccggctatgtttgcaagcaatggaaatgatcatgcgtggaaacgaaacggtttacgatgtgggaactggttctggcgtgttgagcattgcggctaaactattgggcgcagctaaagtggaagcttttgatgtcgatgatgatgcaattgccgctgctcaagaaaattttgacttgaatccaatcgctaagtcaattgcggcgcggcctaacgacctcctcgagggaattaagcaacccgtagacctcatcgtagcaaatattttgtctgacgtactagtgccaatgattcctcaagccaagtcgctgttgaataaaaatggccggttagttatgtcgggaattattgatgacaagcttccattgattcaaaagacgttggcggcaaatgactttaaggttaaccaagtgctaacttacggggaatggcgcggagtaattgtgtcacaccaacttgaagagtaggaggctgctatgcaaaggtattttattaacgaagcattagcactccaagatgaattcacactttctaaggcggattcgcaccatttattgaaggtaatgcgagcacagattggtgaaaaaatcgaagtagtgggtagtgatcaaagggtttggctaagtcagttgcttgataatgcagcgccggcgagcttaaaggcggtacaagagatcactaaacctgtggaattgccggtagaagttacaattgcctgtggtatttctaaaggggataaaaacgagcaaattattaagcggggcacggaaatgggtgcaagtcattttcaatttttcacagcacgttattcagttgcccgctggaatgaaaagaaaattgaccgcaaattgcaacgctttgaggaaattgctaaggctgctgccgaacagtcccaccggcaaatgattccaacggtggaaattatttcctttgcggacttggttaactcaccagtgcagcatcggatggtggcttatgaggaatctgcgaaagaaggggagtttgctaattttaagcgggttttatcaaatacggctagcggggatgcgctcctagcagtatttggcccagaaggcggactggctcctgaagaaatcaagtcgtttaacgacgctaattttacacttgccggcctcggaccccggattttacgggccgagagcgcaccaatgtatgtgttatcggcaatttcatatcaatttgaactgcaatagtgaggggaagaattatgaagaaaatcgctaatttggagatttcagcccactggcgttacgttttatttgcgtttttaattggaattgttttgccaattgtgctgaaattatgtcatactccatcggtaatgattgttttgtggctactaatcgtgtttaactctttagcaagctacacgtttggtaacctgattaagtcgaatggtttgcactttatgtttttatttttatttccggtattatacttaatcggggcaataatcatcttgccgcattacgcaaattactttgctatcgtatatttctgtattgaaatattatcctataacttatcgaatagctaaacattgcaatttgtttataataaacgtatactttattcaataagaccgaagcacgttgtcactcgataccgtgcttttattgtattttgaggttggtggtgatgttaatgtccaaagaaccagtattatcggccaatgacgtaatgaacatgtgccgagaatatatgaatgaagagcacacggcgtttgtgcaaaaggcctgtgactttgcttcctatgttcataaggagcagtatcggcaatcgggagaaccgtatattatgcacccgattcaagttgccgggattttagccaatttaaagatggatccggagacggttgcgtcgggctttttacacgatacagtagaagatacgttgattacactgggagacgttgaggagctatttggtcacgacgtggcggtcattgttgacggcgtttctaaaatcagcaagattaagtataagtccaaccaagaacagcttgccgaaaatcaccggaagcttcttttagcgatgtcacaagatatacgagtaatcattgttaaattggctgatcgcttgcacaatatgcggacgttgcgccatttgcgtccggataagcaacggcggatttcaaacgaaacgttggaaatatacgcgccactagccgaacggttaggaattagcactatcaaatgggagctagaagacattgccttacgttatttgaatccccaacaatattatcggattgtccacttaatgaattcgcggcgggctcaacgagaagaatatattaattcggcaattggtgagttagaagacgcgattgctgacctccacttgaaacacgtggatatctatggtcggccgaaacacatctattcaatttatcggaaaatggttgaccaacataaacagtttagccagatttatgatctgttggcggtgcgggtaatcacggatacggtgcgggactgttatgcagttttaggcgcaatccatgctaaatggaaaccaattccagggcgttttaaagattacattgccatgcctaaggccaacatgtatcaatcgttgcatacgaccgtggtaggacctgaagggcgcccgctggagttccaaatccggacggaagccatgcatcgggtggccgaatacggggttgctgcacactgggcgtataaggaaggcatcacggacgaagtcaaccaaaatgctaccgatgctaagttaaattggtttaaggaaattgttgaattacaggacgaaagcaatgacgcagcggacttcatggaaggtgttaaaggtgacttatttggtgaccgcgtttacgtatttactcccaaaggcgacgttttcgaactgcctaagggggcgggtccgcttgatttagcctacaccatccataccgaagtcggtaatcatgccaccggtgcgaaagttaatggcaaaattgttccgctagactacacgattaaaaacggggacatcgttgaaattttaacttcaaaaaattcagcaggtccaagtcgggactggttgacaatggtttcaacccggcggagtcgtaacaaaatcaaacaattcttccgccaggctaatcatgaagaaaatgttgaaaagggtcgtgaaattttaactaagcagttagaacaaactggttacgatcctagcgagcttttggaagatgaaaatctcgctcaggttgctaaacaattgaatttcaaccaagtggatgacttgttggctgccgttgggttcggtgatttggcccccgtggggattgctaaccgactaactaaagacattcgtgaacaggctgaagctgatcaccaaaaagaaattcaacggcaaatgcttgaaaatcatcaggcaatttccactgacgaccatcgtccgaagagcaaaaccaaggcatcttcggaaggcgtagttattgagggcgcggataatctactggtgcgcttgagtcattgttgtacgccagttcctggtgacccaattgttgggtacattactaaagggcggggcgtttcggttcaccgaaaagattgtccgaacgttaagagtgccgaagaacagggtgaacgaattatcgaagttagttgggaagatcccgacgatacttcgggaaactattccgctgatttggaagtacaaggatacaaccggaacggtttattaaatgacgtattgaaatcggtcaacaacgcgacgcgtaatctatcgtcaattaacggaaagattaaccataaccgaatcgtggtaattagcctatcgatgggagtgcataatctggcccatctagaacgggtgatggaaagtttgaaaaacgttaaggacgtttacgtagttaaacgcccgacccattaggagtgaaaaatgagagtagtagttcaaagagtgagccgggctcaggtaacgattgccgagcgctcggtaggaaaaattaatcgaggattaatgctgttggtggcttttaacgatcaggacaccgccgctgaccttgattatgccgtgcgtaaaattactaacttgcggatttttgaaaatgaggaaggaaagatggactggtcgatcaacgaagttgggggagccattctgtcagtttcccagttcaccttgtttgcatcgacgaagaagggtaaccgtcctagttttaccaagtctggaaatcctgaaaccgctagtcggctttatgatgaatttaaccaacgcctcgcccaaactggaattccggtacaaactggagaatttggtgcggatatgcaggttgagttggttaatgatggtccggtgaccattcttttagatacgcaaaataaagaataataaagcaaaagaggctgtgaaaatggggcgcactgacaagtaaacccgatttttgcaacctctttttaagtgtaataaaggagtaataaaatggatattttttatgattttgacgggaccttatttaatacctatccggtaatggtggccgcgtttgtggatgctgctcagcaagcaggagtaacggtaaatcctcaactagtctacgaacaaatgcgacaacattctttaggatttgcgattaaaacgacggccaaagctaacggtctcgacgctaaccaatttaaacgggtgtttcgtgaaatcgaaacaccacgattaattgaagcccagccattttccgacgtcaaagaattgttggctcagattactgcccaaggtggacacaatttcttattgacccaccgtaaccaagccgcaattgatttactacaaaaatacgggttgcgggattactttaccgactttgtgacgggagatcaagattttccgcggaagcccaatccggcctctttaaattatttgatcaccaaacatcacgttaatcaaaaagcagcgtacatgattggcgatcgaaatttagatatcgatgccgcacatcacgctgctattaaaggaattttatttgatccagaccaactgattgatgtgactagtgccccagaatttacaaccactaattttgctgccattagggattacttagctaagtagttttctagccctttgcggacggcagtagcaaccttttgagggtagctggcacttgaaattagtttaaagtcgtccctagtgttgatgtagccaccttcaatcaaaatggctggacggcggttatcccgcaatacttggtaattagcaaatttaactccgcgattgtataaaggaactgatttaatcaactggtggttaaccgcttcggctaattgaattgaaccattatcatgataataataggttgtgtcaccagttcccgaattgtttacgtcagccgaatcgtaatgaatgctaataaatgcatccgccttaacttggttggcaatttggggacgtttagctagttccacgaaggcatcgtcatcgcgagtcataataacctttgctccagcattttttaaggtttgttggatggtttgcgaggtccgcaacgtatattttttttcttgatgcttttgattaatggctaacgctcccgagtcaactccgccatgtccagggtccaggacaattttggattcggctaatggagtttctttttgcccttttttaaaggttcggttagtaatccaggaagggatccaaccagttttcgtatcgtcaaaacgaacccggtaccagtcgttgcttttggaaactacggtcaccttttggtattgatctaaggaaccgacttttttagccgtgcgattaggcgagttccgaatggccacttgatcgagtcctacgtacacgctctcggcgctgaatagggggacaattactaaaattgcggcaatgaggaagccggctgatataatgatttgcaaggtatttcttttaataaagttaaaaataatctctttgttcatattccgctcacttaacattttattgattcactttgtccattatatcaaagatatgacggaggtttatgaaagaatctagcttgactaactagcatttttttagtacttttaataataaagttaatataaatcggtgaaaaggactattaaatattgattacatgttgtagagagctcgggggatggaaaagagtacatggatcgtattgaagacaccttggagatgggttagcagccgttatgatgctatagagtacaatctaaggtggtaccgcgtgttgacgcccttgtttatacaagggctttttttattttctgttggtcccttaagactctaagcatttttcataatagtattttaaattcgcccaaattccttatttactgacttaaaaactagttgaggtgatttatatgaagtatcaaaagcctaagggaacggcggatattttgccgccatactctaaagaatggcaatttgtagaacaaaaagcgcgggaaacttttgcactttataattatgaagaaatacggacaccgatgtttgaaaaattcgaagtcttttcgcggagtgcgggggatacttcggacattgtcactaaagaaatgtatgattttgatgacaagggcggccggcatattgccttgcgccccgaaggtaccgctggggtagtccgggctttcgtggaaaacaagttgtatggtcctgaacaccaaaaaccagtgaaggtttactacatggggccaatgttccgttatgaacgtccccaatccggacggttacgtgaattccaccaaatcggggtcgaagcttttggaagtgacagtcctaaaattgacgtagacaccattaccatggcaatggacttccttagccaattaaaggttgcaggactgaaattggtaattaacacccttggtgaccaagcaagtcggcagcaataccggcaagccttaattgattatttggaaccgcactacgatgaacttagcgatgattcaaaagaacggctacataagaatccgctacgggttttagatagtaaggatgccaccgatcaggaaatcgttaaggatgcgccaagtattttagattacctaaccgaagatgctcaaaagcactttgcccaagtgaaggaacaacttgatgctttgaaaattccttacgtagtggattcgtcaatggtgcgtggcttggattactataatcacaccatctttgaaattatggttgctgattctgctcttggaaagggcgacgttaccatctgcgcgggtggtcgttacaacggattagtacaggaattgggcggccccgaagtttctggagttggctttggcttaggtgtagagcggctcttgttactattaaacgaacaaactcaagcagccttacaagctagccggctagatttctacgtggttggcattggggaagctgtacaaactgagacccttaagatcgttcatgaattacgtaaaatgaactttgttaccgaacaagattacttggaacgaaaaccaaaggcgcaatttaaatcagccgataaacttaatgcccgttacgtaattacggtgggcgaagctgaaatgcaagcgcacgtcttcaagctaaaagaaatggctacggggacggaaaagaccttatcactggatgaactaaaagatataaaaaatgatttaaagtaacgtgaggagaaaaagatgaagagaacaacgtatgcgggactagttgatcaacaataccttgatcaaaccgttaccctaaagggatgggtacaaaagagacgtaacttaggacaattaatctttattgatttgcgagatcgggaaggaattgttcaattagtttttagtaacgaattttcagcggacgcattggccgttgctgaccaattgcgtagtgagtacgtaattgaagttactggggtggttaaacaacgcaagcctaaggacgtcaacccgaagatgaagacgggggaaattgaagttgaagttcatgaagccaaaatcttgaacaaagctaaaactccaccgtttgacattgaagacggggtgaacgcatctgacgaattgaagatgaagtaccgttacctagatttacgtcgcccagaaatgttgaagggtctcaaaattcggaatcggatcactcaagcggtacacagctacctagatgaacaaggtttcttagatattgaaacgcctgacctaactaagtcgactccagaaggggcccgtgactatctagtgccttcacgggtttaccctggacacttttatgctttgccacaatcaccacaacttttcaaacaattgttgatgggagcgggaattgaccgttactaccaattggcacgttgtttccgtgatgaagatttacgtggagatcggcaacctgaatttacccaaattgacttagaaactagtttcttgaccgcggaagaaattcaagacattaccgaaggattaattgcccgggtaatgaaggacaccttggatattgacgttaaattgccatttgaccgaatttcatggcaagaatcgatggatcgcttcggtactgaccaacccgacgtacggtttggaatggaattaaaggacatcagtgaaattgttgctgattctgaatttaaagtgtttagcggagcagttgcaaacggcggagtggtaaaggcaatcgccgttcctgatggggctgctaaactttcccgaaaggaaatcgacaagcttgctaagtatgtagaacgcttcggtgccaaaggcttggcttggttgaagattactgaccaaggctttagcggaccagtagcgaagttctttgatgaagctaccgaaaaacaaatcatggctaagacagacgctaaagtgggcgacttattgttatttgcggcggaccgcaagaaagttgtcgcggatactttgggttatttgcgggtagaacttgctaaacgcttcggcctcatcgatgaagaccaattcgccttcctgtgggttgtagattggccactgtttgaatatgatgaaggtgacgaacgttgggttgcggcgcaccacccgttcaccatgcctaatgaagaagatttacattacctagatgaaggcgaagatccgcataaagcacatgcgcaaagctacgacatcatcttaaatggtttggaactagggggcggctccatccggattaacacccgggaagttcaagaaaaaatgttgaaggcccttggatttacgctagaaaaagctaacgaccagtttggctatttgctaacggcgctagattacggtttcccaccacacggcggactcgcaattggattagaccggtttgctcgcttgctagctaaacgggataacattcgtgacgtgatcgcctttccaaagaactccaaggcttcagagccaatgaccgaagcaccaactccggtatcggaagaacagttggcggaactatctttggacgttgatattcgtaaacctgaaaaataactttaaaaaggtcgggaagacttttgttggaatgaaaatatctaactaggttagacaatttacttagtcgctaggatgttttcataattgcaaaggtttttccgcctttttttatttttaaaccggactaataaaatcattaattaatcggtatttaatgataaaagggaagttatcttaaaaatctccaataaccgcttgaaaaccttcattttaaccgcggtaaaatgttatattaaatgttgaatttaaataaaatatgaaagtgattgatatagggaaatgggtcatcagataaataagattgttaaacgacatcagtacgttgcacgaatttctacggcgtttatttacgcagtgttagtttcgattgcgatgaatttattttggacaccggggcacatctatgcttctggagttacgggagcggcacaggtggctgctacggtcttaaaacgatttttttcgatggacgtttcggtcgccatcttactttttgcgttaaacgtcccgttatttgtattagcttggaaggcaattagtccgcggtttactatttttaccattatctcggttggattagccagtatcatgattaagtggattcacccggtcacgttaactaccgacccgattatctgtgctctctttggtggggcagttaacggttacggaaccggattagcccttaaaagcgggatttcaactggtggattagatattttagggatcacgattcttcgtaaaacggggcacagcattggaagcatcaacatcgcctttaacattttgattgttacggccgctggtttcctatacggttggccctacgcattttactcagcaattgggttgatcgttaacgcaaaagtgatggacatgacgtatacgcggcaacaaaaaatgcaggtgatgattattacggatcggcctaagagtgtgattgatagtatccaaaataatatgcgccgggggattaccattatccatggtgcagaaggtgcgtataaccacaaagaaaagacggttcttttcacgattgtttcgcggtatgagatgccggaattagaagcagcgatggaagtttccgatccgcacgcttttgtaagtattacggacacaattaaaattctaggtcacttttacgagccgaccttataaggggttattttcttgaagaagttatatttgctgctagttcgactagttgattggtttttgcgccgacgtcccacgcactttaaaattgcgtattttatgagttttacggggaacgccaagtttattaaacaattagccagccattttggtactgacgcggtgctgctggtttatgaaccggctgtaaaagcggaggtccaacgcttaaaaagcgcgggagtggtgcgccacacgcttgagttccgcaaatttcaaataaccagttttgttaggggaatccgggctgcccgggttgccctatttgataattattatcctgaattaagtgcgattgctaaattgaaggaacaattttttatccaaatctggcacgctaatggggcaattaaggcttttggctgggaagaccccagcacctatcatcggtcagtagccgaccagcaacgatttcaacaggtttataatagctttgacgaaattgtggtggggtcagctaaaatggcagaagtctttgaacaaagctggaaagttagctcagctaaactcgctcaaattggatacccgcgttccgaccaatattttaatgaagcttgggtacaaaaggctcgggccaaagtttttcaggattatccgcagtttaaaaaacaacgggtgcttttatatgcgccaacgtaccgcaaagacgttacgtttgagctgcccaaggattggtcccatttgctagttcccgaagatgccgttttagtggtgcggctgcacccgcacttaagcgaactggaacagcagctggtggcgaattctccagatcgggtggtgacggttgaccatcacgttaccacccaagagttattgtgtgtagcggatacgctgattaccgactattcttcgatcgcatttgactttagcttgttagataacgccaatgcggtgattttctttacatacgatcttgcacaatttgaacaaacggttggcattcaagccagcttcaaacagatgtttttcgacgagctagttgagaacgtagccgagctcaacgttgctttgcaaagccgccattctagcaagaatagtttgcaaaaaataaatcaacagtggaacgagctaaatgatggccatgcgggaacccgactaattcagcagattgaagggattttgacgaatgcgtaagctcaaacaagtacttaaaattataattcgatacggtttaatactgattaatgatgcgttgatccagttgccggttcataagggtcgcgttttatttgaaagttttaatggtaaggggctgacggataatcctaaggccatttatgatgaattacttaaggagtttccggaaaaccgttcccagttagtttggggcgttaagggtgaattttaccaagcaatgactactcgatttccggaagctaaaatcgttaaacgctggtcgttaacttggatttggacttcggcaaccgctgaatattggatttttaattcgcggatgccaacctggtggaaaaagaaccgtcggaccacctacgtgcagacttggcatggaaccccgttaaagcaccttgctttagatatggatcaggttaagtttcccggaaatagtcgggaacgttacttagcagaatttgttaaggaggcggatcgttggaactatttagtcgcggccaaccaatattcagcagatatttttgaacgcgcatttagttttcatcaccagtttttaaaaactggttatccgcgtaacgacgttctttttcaaaagaataacgttgctgcaattgccaaattaaagcaaaaaattattggtaagtcggactgccgggtggttacctatgcgccaacttggcgggaagatgattttattaaggtggggcattatcattttcgttggcattttgatttaggtgagatgctgcgcgttttgcctgacgacgtggtgctattgattcgtccgcactacttagtcacggatcggattgatatttcgtgctacgaagaccgggtggtggtggattccactagcgatatgaacgaaatttatttggttaccgacttattaattaccgactattcttcagttatgtttgatttcgccaatttacgtcgaccaatgttgttttttgcctacgaccttgattactaccgggatgatctgcgtggcttttactttgactactatcacgaactaccgggccccattgccactactgcggcagatctgctccgggaagttcatcagttagcgcagaatgattttgctattttagatcaatcgcggtttaaccaatttgctaaacgctttgtgcaatgggagcagggggacgctgctcaacaaattattaaaaaaattcattacgggagggattaatcttgattattggatcacacgtcagcatgagtggtaaaaaaatgtttctgggttccgtggaaaccagcattgctaacggcgccaacgccttgatgatttataccggggctcctcagaatacccggcgtaagccaattacagaattaaaaattgaggaaggccaagcactttttaaacaacataactttcaggcaacggttattcatgcgccatatatcgttaacctgggaaatacgttaaaacccgcgaattttaaatttgcggttaactttttacgagaagaagtgcaacgagcagacgtgttgggagctagtcaattggtactccatccaggcgcccacgtaggtgcgggagcagacgcggcaatttcttcaattattgaagggcttaatcagatcatcacgccggaacagcaagttcaaattgcacttgaaacgatggctggaaaaggtactgaagtagccacgaactttgaacaaattcgtcaaatcattgaaggggtaacccataacgataaactttcagtttgttttgacacttgtcacactaacgatgcgggctacgacgtgaagaatcatttcgacgatgtgatggctgaattcgatcaggtgatcggtttagaccggatcggagtaattcacctaaacgactcgaaaaatgaattagggagccataaggaccggcacgccaaccttggatttggaacaattggttttgaaactttatatcgcattgctcatgatgaacgcttggcgaagatacccaagattttggaaactccgcaggttaaggatccggatggcaagaagcatgctccttaccgccttgaaattcaaatgcttaaatcaggggactttgatccggatttattaacgaaggtcctgcaagaatagtgtttgtttaggcgttaagcgcagactagaacggtgtattgtaaaacacgcgtcagagaaaagtcgaatagttggtgaacgttaactaaaaatcgctcattatgccaaacttaggcataatgagcgatttttagttaagcagaataaattgagttttggcgcacgctttggcttcattaaaaacgatgcaccaaaatgatttttttgcctctttttgctgatcgtgaaaattaacgtaaatgcgttaatttttgatactgctgactacttaagtgccaggttccagaatgaaccacgggaagatttttaaccgtaatggtgtggttccggtagataaaagcgtcaattttggccgacggattaatttgaacgattttaaaatgacggagcaactggctgttctgaggcttttttgggtgaactctccgtgctgaccccaaatcgccaaggaggttagataagtaactaattttttgatgattagtgatggtggcgattttactttggtgtgcgttataaacttgggcgtagtcttgcttagcggcagagctaggacgatgcgtgaggtgccatcctaaagtaatgcttccaattaacactaccgcaaatcctaagaacactaatgtttttttcatattaaacccttcttaaatgaggttacgcgaggctttccataataattgtcgcggtttcttcgattgatttattagccgtattaattactaagcagccgatttttttaaataggtcgtccgcaaattggagttctttattaatgctgtccatatctgcgtacgaggaatcggggttcaaaccgtatgaaatcatgcgttgccggcggattccgttgagaacttccttggtggtggttaaaccaaaaattttatcgcgatcaacctgccaaatttcttcaggaatttgggttttaggtaccaatggcagattagctactttataccccttattagcaaggtaaagtgataacggcgtcttagaagtccgtgaaacccctagtagaacgatgtcagcttttaagaaaccagcgggatctttaccatcatcgtaggttaccgcaaattccattgctgagatcttatcgaaatagttttcattaagggagtggcgtcttcctggagtattggaagaagttaggccggtctcctcggcaaaaagctggatggcgggggtcagaacgtcaaaatattttaaatttttttcttggcaaaaagctttagtgcgttggttaagctttggatcaacaaatgtagaaaaaatcattgccttttcccgttcagctttttttaaaatgctatctagtaaagaaatggtctgggtgaaggggtagcgagaaaaacgcaagtgggcctctaaaaattgggcagcggcggcgcgggctacttgatcaccagtatctccgacggaatcggaaatgataaaaacgttagtaatttgtttgttttctgtcataattaattcgctcctgttatccttttatatgatagtaacataactttaaaaggcaagaaaacggtttcgataaacaaatcgttatgcaactagttaattatttgttgttgacggtatggtttagttcagttataatgtttaagaaacatgagtactaagtacgaattgttatttcaaagctcggagggagggaatcacattgtcaaaaacagttgttcgcaaaaacgagtcacttgatgacgctcttcgtcgctttaaacgtacggtgtcaaagtctggtactctacaagaatatcgtaaacgtgaattttacgaaaaacctagcgtaaaacgcaagttgaaatcggaagctgcaagaaagcgcaagaacaagaaacgcttctaatccgatcatcgctcctgaatttcaggagctttttttgtatactaaaaggagaataaaaatggattttacaaagcaaattaacgacgacttaaaaactgccatgaaggcccatgataaattaagcttaagcgtaattcggatgatcaagtccgaactcttaaacgaacaaggtcgggttggtcacgaattaaccgaagatgattttgccacggtaattaaccgcgcttataagcaacggaaagattcaattgccgagttcaaaaagggtaaccgcgatgacttggtaaaagaaactgaagctgaattaaaggttgttgaaaagtacatgcctaaacaactaagcgatgacgaattgcaagaaatcattaaccaagtaattgaagagaccggggcaacttcgaaggcagactttggaaaagtaatgtcgacattgatgcctaaagtaaagggtaaggcagacggtgccaaagttaacgaaattgtaaaaaataccttaggttaggggaaggtaacgtgtctgaagagttgttcgaaaagaatctcatattatcagatccaaatttagaaatgtcactgcttggtaatcaggaacgcttcgtgccgattattgaggaagggatgaacgtcaaggtacttccgtttggcgaacgaattaccgtaaagggcgcacaaactgacgtagaacaaaccattgcaattttgaaaacgctggttcaagttttaaaaaccggggtgcaacttagcagcaccgatttcgttagtgccatgaagatggctgaaaagggaaccttaaactacctgcccgagctttattcaacggtcttaattaaggatgcgaagggtaaaccagttcggattaagaattttggacagcggcagtacgtggaatcagtcaagaataacgacgtgacgtttggaatcggtccggccggaactggtaagacatacttagcggtggtgatggccgtagcagctttaaagcggggcgacgtagaacgaatcattttgacccggccagctgtagaagccggtgaaagtctaggatttttaccaggtgacctgaaagaaaaggttgatccatacctccgaccagtttatgacgcgttgtatcaaattattggggcagaacacactacgcgtttattagatcgtggtgtaattgaaattgcgccgttggcttatatgcgcggacgtaccctcgataacgcgttcgtaatccttgatgaggcccaaaatacgactaatcaacagatgaaaatgttcttaactcgtttgggatttggttctaaaatgattgttaatggggatgtgacccaaattgacttaccgcgaggcacccgcagtggcttgaaggaagcacaaattgtgttaagtaacgtcaataaggtagcgttcgttaacttcaccgctaacgacgttattcgccatcctgtagttgcgaagattgtcaaagcttacgacgaaaaagaagcgaaaggataatatgatggatattcaaatatttgatcatactgaagaagtaccccaacaacatttggatttaattgcgaacattttagactttgccggaaattatttaaaattagacgtggcaactgaaatttcggttaccttaatgcataatgatgaaattcaaaaaattaaccgcgaatatcgccacgtagatcgtcctactgacgtaattagttttgcaattaacgacgaagatgaagatattattatggatcctgaaatggcagaagaaattccggataacattggggatttgatgatttcggttgacaaagttgctgaacaggcggaatttttgggacattcttacgaacgggaactaggatttttatgtgtccatggtttcttacatcttaacggctatgaccacatgaaaaaggaagaccaagaaaaaatgttcccgcttcaaaaagaaattatgagtgcttatggtcttgaaagataaacgccaaaccgaaaagaaccgctcactaatccaatcgattgcccacgcgatgtacggggttaaagatatttttctacgggaacgcaacttccgttaccactgtttaattgcggtgttagtagttggctgtggtttagcaattcacttgtcactgatggaatggattgcgatcgtggtttgtatcggagcaatgtttgtggcggaagcttttaattcagcaattgaacgattggcggactttgcttgtaatggcaagtaccaatttctagttaaacaggctaaggatgccgcgtcagcagcggtcttactaaccgcagtattcaccgtcttgattggattattggtttttgcacaccactttttttaaaattaaggaaacggaatcgtgattatggaagaaaataaacaagcttttcattcgggctttgtggcaatcgttggccggcctaacgttggtaaatcgacctttttaaattacgttgttggtcaaaaggtagcgattatgagcgacgtcccacaaaccacccggaataagatccaaggtatttacactacggatcgcgaacaaattgtctttatcgacactccaggtattcataaagctcacaataaactaggggactttatggttcaatccgccatatcttcgttaaacgaagttgatgcggtaatgtttatggtcaatgcggatcaaaaacggggtgccggggataactacattatcgaacggttgaagaaaattaagaatcggccaatttatttggtaattaataagattgacttagttcatccagacgagctgttaccgattgttgattcgtaccgggatgctttagattggaccgaggttttcccaatttcagcgttacaaggtaacaacattaacgagctcttagcaaccttgagtaaacagatgcccgaaggtccgcaatattacccaagcgaccaagttaccgatcatccagaacggtttgtggtttctgaattgattcgggaaaaagtattgcagttaactcggcaagaagttccccattccgtagccgtagttattgaatccatgaaacctggtaaggatgacctcgtggatattagcgcaacgatcattgtggaccgccccacccaaaagggaatcatcattggcaaaggcggtcggatgctaaaagaaattggcagccgggcgcgagtggacattgaacatttactaggtagccgggtttatcttgaactatgggttaaagtttctgaaggatggcgtgataaacaaggaattttgcaatccttcggttataaaaaggacgaatattaaatatgagccaattggtgaacgcggactttactggcatggtgatgtttgccaaaaatcaccgggaaaacgatttgttggttaaattccttaccagggaatatggtaaacggatgtttttcatcaagaatgccaaaaagaaggattttaagttgcgttcggcaattttgccgtttacccacggtcgttattcggggttaatccggagcaacgggctgtcgtatattaacgctgccctagacgttaaacagtttgaaaatatttttcaggatattgaattaaatgcctacgccacttttttattaaatttagttgacgctgcatttgatgataattttaaaattgaagcttggtttgaccggctagcccgggcgctgaccctgattgacgctggtaacgatgcggaagtaattacggatctaattcagattcaattgctaaattcctttgggattgcaatcgtttgggatcattgtgtcgtttgcggacgtcgcgatttggcattagattattctgagtcgcgaggcgggatgctttgtcaaaatcactggcatttagacgaacaccgctggcaccttagcgttaaagcagctaaaaccatggcaatgcttagtttggtcagtatttttaaattaggccagatttcggtttcaccagcaactaagcgagaaatttggcagttaactgagcgaatttatcaagatcaagtcgggattaaccttaaaagtcgtcattttattgatcaaatgcaaaattgggcgcattaattatattgacaaccaattaaaagttttttattattatctctgttaaatcggacagtgaagaacaaagcggattttccgtactattagcgaaaccaggatagtggaagctggttaggaacggttccgtggggcatttggagtccttaagagataaatatttcaagctgtcggtgagaaattaactcaccggaagtagggtggaaccgcgataattatcgtccctacgtagtgtgttttatgctacgtaggggctttttttgtccgtaaaatttaaaggaggaacttatgaataaaaagctttcggtccaagaaattattttaactttacaaaaatattgggcagaccaaggatgcatgttgatggaagcctacgatactgaaaagggtgcgggaacgatgagtccgtacactttcttacgggcaattggccccgaaccatggaacgctgcctacgtagaaccatctcggcgtccagcagacggtcgttacggggaaaaccctaatcggctttaccaacatcatcaattccaagtagtgatgaagccgtcaccggaaaatatccaagaactttatttgggtagtttaaaggctttagggattgatcccctcgaacacgatattcggtttgtagaagacaactgggaaaatccttcaatgggttgtgccggtgttggttgggaagtttggcttgatggaatggaagttacccaatttacgtacttccaacaagtgggggggctcgaagtacaccccgttaccagcgaagtaacatacggactagaacggctatcctcctatatccaagacgtagaatccgtttttgatttagagtggggaaatggcgtttcctacggagacatttttaaagaacctgaatacgaacattccaagtattcatttgaagaatctaaccaagcaatgttggaaaccatgtttaacgattttgaagccgaagctaaccggttaatcgaaaaaggcttagtgcacccggcttacgactacatcttgaaatgtagccacaccttcaacttacttgatgctcgcgggacggtctcagttactgaacgagcaggattcctatctcgaatccgcaacatggcgcgtaaagtagcccgcgcatttgttgaagaacgtgaaaaacttggtttcccattattaaaaaatgacgacaaggaggtaaaataatggctcatagttatttattagaaattggtttagaagaaattcccgcacacgtggtgaccccgagcatccaacaattagcacaaaaagttactaaatttttgaaggaaaaccggctcagctatgattctattgagcaattttcgacacctcgtcgtctagcaattcgaatcaatggacttggcgatcgtcagccagatattgaagaagatgctaaggggcctgcccggaaaattgcccaagatgcggatggcaattggacaaaagcggcgattggttttactaaaggacaaggcttaacagttgacgacattacctttaaaaccattaaaggcacggaatacgtatacgtacacaagttaattcaaggtaaaactacccaagaaattttgccaggcattaaagacgtggtggaatcattgaacttcccaaccatgatgaagtgggcgaactacgactttaaatttgtaagaccgattcgctggttggtgtccatcttggacgacgaggttttgcctttccaaattttggacatcaaggccggacggcaaagccaaggccaccgtttcttaggtaaaacggtcgacttagctaatccaagtgagtacgaagaaaagctacaagctgaatttgtgattgttgacgcagaaaaacgcaaagcgttgattcgtgaacaaattcaagcaatcgcccaagaagaaaactgggaagtgacgccgaacgctgacttattagaagaagtaaataatctggtagaatggccaacggcatttagcggaaaatttgatcctaagtacttggcaattcccgaagaagttttaattacttccatgcgtgatcatcaacggttcttcttcgtgcggaatcaggacggcaagctgttgccaaactttatttccgtacggaatggaaacaaggaacacctagaaaacgttattcgtggaaatgaaaaagtgttaacagctcgacttgaagatgctgccttcttctacgacgaagatcaaaagaattcgattgactactacgttgaccgacttaaaaaggttagcttccacgataaaatcggtaccatggcagaaaagatgacgcgggtcggctccatcgctcaagtaattgctaaaatgctcggtttagatgcagaaacagctgaagacttgcaacgtgctgcagcaatttacaagtttgacttggttaccgggatggtaggtgagttccctgaattacaaggggtaatgggtgaaaagtatgctctattgaagggcgaaaaaccagccgtagcgcaagccattcgggaacactacatgccaaatagtgcggaaggtgaacttcctgaaaggactgtgggagcagtattagctttagccgataagtttgacaatatctttagcttctttagtgcaggaatgatcccaagcggttcaaatgacccgtatgctttacggcgtcacgcatacgggattgttcgaattcttgctcaacgggattggtcactagacttgaacaaatttgaagaagctgttaagcaagcgttggcggacgaccaaactagctttggggtagacgtagataaaaactttgccgaagtggtggaattcttcaatgaccgaattaagcaataccttgatcaccagtcggttagctatgatattgaagatgccgtgcttgccggaagccagcacaacgtaacgacaatcattgcggctgccgaagtgctaactaactcgaaggctgcggattccttcaaagatgagatcgaggccttaacccgggtacaacggattgctactaaaaacaccactgccggtgacttggcagttgattcgcaattattcaataacgaaactgaaggtaagctctttgacttgatcactaagattgaagcgatgaatgatgcggacatggcagtcttctttaaggaattgactagtttgacgccagcaattaccgaatattttgacgctaccatggtaatggataaagatgcaaagattaaagcaaaccggttaaacatgatgagccgtttagcaaacttggttcttcgtgttggagatttgactaaggtaatggttaaataaaaattgaaattttaaaaaagctgcgagctcgctagcgaggctgtggcaatagttatttaaaatctgttgacagtgattgaaaagtgattactgccaacagattttttggtggagtgaaaaggttagtagggctgccggtgtctgcgctagtttttagaattttttgtgaaatttttgggggaggttgaggtagcttagtctataaatgaggtaatcctaatatttaagcacttatttaacatacttgacaaaagtgttaattataggtgcgttttgattgcttattagtagggagtgctgtaatatactatcgtatgagtctatcttacggaagtgggtgatagaatggctggtatgattccagaagaagttatcgacaacgtccggtccgccgtgaacattgttgatgtagttagtcgatacgttcagttgagaaaagctggaaaaaatttgtttggcatttgcccatttcacgatgaaaaaacaccttctttttcagtatccgaagataagcagatttttcactgtttcagttgtggacgtggaggaaatgtatttaagtttttgatggatctggaaaaaattagtttcccagaagccgtccggcgcgtggcggagtttggcaacgtccccctagacgataagtacgtaaagaagtctcctaagtcagcttattcagcggctcaaagtgagatgattggcttatatgaaaaggctgctgaactttatcaccacgtgttggtgaatacgcaactaggtgaaaaggccctcgcgtatttaaaaaagcggggaattactgaagcagacctgcaggattttgatttagggtttgcaccggcagaccaagatttgctgttaagttttcttaaggaacagcaaatcgatcaaaaacaaatgcaagattcaggactatttattgaaacagcagacggttcgttaaaggaccggttttttaatcgaatcatgttcccaattaaagataataatgggaagattgtcgctttttccggacggagcttggtgaaggatgaccaacatccgaaatatttaaacagtccggaaactagcatttttaacaaaggaaaggtactctataacttttcgcaagcccgccctgaaattgtccaaaagaaaaccgttattttatatgaagggtttatggatgtaattgcagctcaccgggcccaagtggctaatggaattgccacgatgggaactagtttgacagaagaccacgtgcgagcactcaaacgagttgcctcccgtgtagtaatctgctttgatggcgacgagcccggccaacgtgcaattgcgaaggccattgcgttaattaaacagactagtgatttgcaaatcagcgtcatttttatcccggataaccgtgatcctgacgaatacgtgcgggataagggcattgagtcttttcaaaaactaatgaatcagactggggaatccagtacggcatttttattgaaatttgaccggatgggtttaaacttagctaacgaaaacgatcagctggaatacctaaaaaaagctctccgacggattggtgaattaaatgacgctttggaacaagacctatatcttaaccaacttgctgaagaatttagtattgataagcgtgatttgaagaaccagttacgggaaagcgtggctgatcggattgcgcatactcctcggcagtttgatccgggaccggcccccgcgccgccacctacttttgaaaatcaagttgagaaaaccgaaaatacttctaagaagctatcaagtgtggatatttcgcagtaccggttgttagcccgcgcacttaatcatcacgacgtatggttgaaattacaaagcttgccggatttttattttccaaatgagcaactggaaactatttatatgttggctggaggatacctagccaagaatcaagaatatgatgcggcagacttcatggattatttgaaggaaccagagttacagtcggtagtggctaatattgagtcgattaatttgagtcccgattacacggaagaagaaatcgaagactatattagtttgattaaggacgtggccccgctcagcgaacagatttcaaaagttaagtcggatttaaacgaagctaccagattaggtaaccaagaattacaacagcaattaacgctaaaacttatttctctttatcaaaaacaacaacagctccaaaattagagggggaacagctaactatggcaagtaaaaaaagtgaaatcaaacgtaaaaagagtgaaagtatcatttcttcaccagaatttaaaaaggcagttaaccaaattattaaagcacaaaaaagtgaacacaaggttaagtacactaagcttacccgtgatttgatcgataaattcaagttgactgacgaagacgtggatgacttaattcaacggatcgaagacgccggaatcagtgtggttgacgaaaacggtgacccgagtgaaaaggccttaaaggcacaagagatttcaaaggaagaattagacgatactaaagctccggccggagttaaaattaacgatccggttcggatgtatctaaaagaaattggccgggtttcacttttaactgccgatgaagaagttgccctagccctccgaatcgaaaagggtgacgaacgtgcaaaacaagaacttgccgaagctaacttgcgtttagtagtttcaattgctaagcggtacgttggccggggaatgcagttccttgacctcattcaagaaggaaacatgggcttaatgaaggccgttgaaaaatttgattaccaaaagggattcaaattttctacctacgcgacctggtggattcggcaagcaattacgcgtgcgattgctgaccaagcgcggacaatccggatcccagttcatatggtagaaaccatcaataaattaatccggattcaacggcaattgcttcaagatttaggccgtgaaccaatgcccgaagaaattggtgcagaaatggacatgccttcggataaggttcgcgaaattcttaaaattgctcaagaaccagtatctttggaaaccccaattggtgaagaagatgattcacacctaggcgacttcattgaagaccaagaggcaactagtcctgctgaccatgcggcttatgaattgcttaaagaacaactagaaggcgttttggataccttgacagaccgagaagaaaatgttctccggcttcggtttgggttagatgatggccggactcgcacccttgaagaagtgggaaaggtcttcggcgtaactcgtgaacggatccggcaaattgaagcaaaggctttgcggaaactgcgccatccttcacgttcaaaacaattaaaagatttcttagattagcatttaaagaggttccatacaggtcgcagatttgtatagggcctctttttgggatagcataaaataaatacaaaaaataccgggagtttattttcatgaattcaaataatttatcgccacgactaaaagtagttgcgagtttagttccaaaaggatccaaaattgccgatattggttcggaccatgcttatttagcgattaacctggttagaaatcaaattgcaacggctgcgattgctggggaagttgccccggggccgttaactaattccaaaatggaaattgaaaaaaatcaggttagtgatttgattgatgcgcggttaggtgacggattgacagtcctaaaaccagaagatcatgttgacgtgatttgtatcgcggggatgggtggcttgttgattcggcggattctagaagaaggccaagcaaagttatctggagtgcaacgattggttttacaacctaacgttggggaatacgaactgcgggagtggctcatcacccacggatatcaaatcactcatgaagacattgtggctgaagattatcacctttatgaaatcatcgttgctgagccaggacaaatgcaattgaccgaaaccgaattaacgtttggcccatttttaatgcagtctgctaacgctactttcttgcgaaagtggcagcgggagttgaaacggctaaaatcaattcaggataatttagaacgacatccacaacatggtggcgaaaaattagcggaagtatcaaaaaagattgcgcaaattgaggagatgttgactaatgttggcgaaacaattaattgaacgttttgaagaaatggcacctaaagaaagtgcttttcctaaggatccagtcggattgcagattggagatcttaaccagcccattcaccgcgtattagtgactttagacgtccgtcccgaggttgtggcagaggcaattaccaaaggatgtgattttatattttcacatcatccgttgatttttcgaccggtgcgtaatctggatttgaccgtaccacagaatcaaatgtacgctaccttaattaaacattccattggggtttactccgcccacactaacctagacgtggcggcgggtggtatgaacgattggttagcacaggcaatgtcccttacggaagtgcaacccgtttattctgcgcactacgaccgcaatattggacgaattggcagtttggcacaaccccaaacggtgaatgagtttgccaagactttaaaagaggtcttccaacttgacggtttgcgggtggttgctgaagataaccaggcattggtccgtaaagtagcggtcgtaggcggtgacggcggtaaattttatccagaaatgatggtggccggtgcggacgcgtttgttactggcgacgtgtattaccatactggtcacgatatgctggcggatcatcttaatgtttttgacgtgggacacaacgtggaaaaaatctgtattgacgaattaacaaagttatttaaccaatggaaggcgacgaatcaatggcaagttgaggtttgtccgtcaacggtgaataccaatccttatcaatttatgtagggggtaattgaatgaatcctgaaaaaatgactactgcgttacaagaagcgctgggtgaggcgcaacaaattgcggtcaaccgtcagcaccaagaaattggggttccggaattgtttaaatttttagcccaaccagatcaaacggtgggaactttgctttcagagctcggagttagcaaccagacggtccaagcagaactagaccgcgaattagctcaaattagcatcgttagtggtagccaagttagttatggtcaatcaatttctactgaattaaatcaattattaattcaagcagaacagcgtcgccaaaagctgcaggatgaattcattgcggtggatacggtattcttagcgttgtttgatttgaataataatgaatttgctaattttttaaaacagcagggagtaactgctaaaaaagcattggagaagattgaagaatttcgtggaggtgaaaaagtgacgtccaaagaacaggaaagcggatataaagcactagagaaatatggtacggacttagtaaaacgtgcgcataacgagaatcccgatccggtgattggtcgagatgaagaaattttagacgtaattcgaattttatcacggaaaaccaaaaataacccggttctaattggagaacccggagttggaaaaactgccattgtcgaaggattggcacaacgaattgcaaagggagacgttcctagtaatttagccaataagaccatcatttccttagacatggggtccttaatcgccggagccaagtaccggggagaatttgaagaacgcttaaagacggtcctcaaagaggtcgcaaaggcggatggccagattattttattcatcgatgaaattcacacaatcgttggcgctggcaagaccgaaggcagcatggacgctggtaacttactcaaaccaatgttggcacgtggtgaactccacctaatcggggctacgacgttagacgaatatcgcgaaaacattgaaaaggataaagccttagaacggcggttccaacgggttttggtaaaggaaccttcggtagaggacacgattagtattttacgagggctaaaggaacgttttgaaattcatcacggtgtgcgaatccacgataatgcattagtggcggcagccaagttatctagccggtacattaccgaccgttatttgccagataaggcaattgacctgattgacgaggcttctgcaaagattaaagtggaaatgaactcaaaccctaccgaacttgatcaagttaaccgccagttgatgcggctgcaggttgaagaacgggcgttaaaaaacgaaacggatgaagaatccgcaaaacgcttaaaggcactgcaaaaggaattggcaactactaaagaagaaaaagttaagttagaatctcgttgggcggcccaaaaagcggaaattaaaaaaatcagtgataagaaaaacgaacttgataaggcaaaacatgacttacaagaagctgaaagtgcctacgacttagatcgggcagcggttctccagcatggtaccattccaactttggaaaaagaactgcaggatttagaaaatgagtctgaaaacactcaccaagaatggcttgttgaagagtcggttactgacagagaaatcgcccgggtaattagtcaaatgactggaattccggttgcgcggttagtagaaggcgaaagggagaaactacttcatttagcggataaattacatcagcgagtaattggacaagacgaagcagttcagtccgtagccgatgccgtgttgcgctctcgagcaggtttacaggatcctaaccggcccattggttcatttatgttcctagggccaactggagtagggaaaactgaattgtcgaaagctttagctgaggctttatttgattcggaagacaacatggttcggattgacatgtccgaatacatggaaaaagaatcggtctcccggttagtgggagctgcaccaggttatgtagggtatgaagaaggcggacaattaaccgaagcggttcgccgaaacccatattccatcgtcctcttcgatgaaattgaaaaagctcatccggaagtcttcaatattttattgcaagtgcttgatgacggtcgtttgacggatggccaagggcgaacggttaacttccgaaatactattttaatcatgacttctaatttaggttcggaattattgttaaagaaccagtcggaaaattccattgacgcagatattcggcaacaagttcgcgacgtcttgcaaggatactttaagccggaatttttaaaccgggtcgatgatatcatcatgttcacgccgttaagcaagacggacgttcgcaaaattgttcgaaaattagttactcaattatctgatcggttggcagaccaagagattaagttgaatatttcagaacctgcgcaagattacattgtccaacaagcgtatgatccggcatatggcgcacggccgctgcgacgttacatcgtcaagaatgtagagacgccattggctaaggagattattagcggacgggtaaaaccgaagtcagcagtaatgattgacgtgctcaatgaccaattagtttttcaaaatgtaagtaatggttgataaacaaaaaacaggctggaatgtaagtaattccaacctgtttttactttttatagggttgctatctggttaaatttaaaagatagctctttagcttaattaccggtatttttttgaaagccacggaattaagttagaggtgatgagggcggtaatggcagccatcgtaccaatctccaggctactgtatggtagtacttctagggcaccaccgatataaccgagtacttcgccaaaaataaatgcccaaaaaataactacgatttgtttcatcattattaattgacccctttctcgaacaaagctattctagcacaaacttaagggaaaataaattaaacttgaattttggatatgcctaatacatttagtataattaagaaaaacacgggagggaaaatgatggcttttgtaccgctacatgtcttaagttcgtatagtttgttgacgagcccaacaaaaatcgctgagctggttaaaactgccaaagatcgtggttattccgcgatggccctcactgataataatacgatgtatggcgcgattgaattttatcaagcctgtttgaagaatgatttaaaaccgatcgttgggttgaccatttggttagatagtacccggggcatcgacaatcagtttgcgttggtgttgctagctaaaaacattaacgggtatcacaatctactacggattagttctgccaaaatgacggaaacctccgcaaaaccaacacttacgtttaatgatttacgagcttattggaaagatttagtggtgatcgtgcccccagttcgttccgaagttaatgaattattggagcggggaatggctaacgatgcccaagcactaatcaaagaatatcaacaatcaattgactccccagatttatttttaggaattaatgggcagcagtctcacgtcatgcgccaaacactgacccagatggcgcagaaagcagggattggttgtttaccgcttcccagcgttgaatatttaaatgaagaagatcacttcgcaacccaggtgctgcgcgacattgattcgggaaaagttttgcagcatccggaacttttagcaaagggcggcggtaacaactggctgaagcccgcgactgaatttgttcgcgaatacggtcagttgggtgatgccgaaatgctaacccagctggatagggtggttgctggaattaaccttgaaattccaatcgtaagtccgcgtctaccacagtttgcaacccctaaccagcaggattcattcacttatttgacccaactatgtcagcaagcattaacccagttgaaggaaaatgttccggacgcagaacgttatcaagcacggttagatcatgaattagccgtgattaaagaaatgggctttgcggattactttttaattattcacgatgtggttcaatttgcacaccaaaagcaaattttaactggtccaggtcgcggatctgcggccggttctttagtagcttacctattgaaaattacgagtgtggatcctttgcaatacggacttttatttgaacgtttcttgaatcccgaacgagcgcagatgcctgatattgatttagatatccctgatgatcagcgggaagtcgttttacaatatgtacacgaccgctatggtcaccaacacgtggggcagattattacgtttggtactttagctgctaaacaggccattcgggacgttgcccgtgtatttggggaaatgcctaataaaattaaccaaattagcgcactcattcctaataaattaaacatcacattaaaacaagcagcccaaacctctcaccggttacgggattttattgaaagttcgccgaaaaatcggtttatgtttgagacagcgtgccggttagagggacttccccgacacttttcaacgcatgcagcgggaattgttttaagtcaagacgaactggtggaaagcgtgccggttcaagatggtaacgaagggatgctgatgagccagtattccaagaattttgttgagcaagttggcttattaaagatggatttcttaggacttcgaaacctttctttaatgaataacattttagaactggtccaccgtatcgaaccacaatttgagattgaaaagattgatttaaacgatccgcaaactttacagttatttcagcggggggatactagcggagtttttcaattcgaatctacaggaatccgtaacgttttgcgtaaagtacaccccacgaacttcggactcgttgttgcggttaacgccctctatcggccgggaccaatggaaaatattgaccggtttgttaaacgaaaggatcatttagaaccgtatcggtttcctaaccaaattttggaacgggttttaggtgagacttacggaatcttggtttatcaagaacaggtaatggaagtggcctccgcgatggggggcttgagcctgggccaagcggacttgttgcgacgggcaatgagcaagaaaaagcatgccgtaattgagcaaatgcggacgaattttattcagggtgctgttcaaaagggttatagtgaaaaaattgcccaacaggtgtaccggtatatcgaaaactttgctaactatggatttaataaatcccacgcagttgcttacagtaaactagcctttcagttggcgtaccttaaagcacactatcctggtgatttttatacggcattattaaattccgtggtgggcaatgatacgaaaactaagacttacattcaagaattaaagcggttaggaattcctacgttagctccagatattaaccaaagtagcgcaacttatacctaccaaaatggtcaaatccgaatgggatttaccgcaattaaggggttacgccgcgactttatccagcatttattagcggaacgtgaacggggcggacaatttaagacggttgacgactggttacgccgaatgggcaatcaggggattgacgaagatgtaattgataaattaatttttgcgggggctttggacagctttggctataatcgggcggaactagacgaatatttacccgaactgcttaaggggattacctttagcggtcaaaatgtggacctatttcaaaagctaatgccgacaattaaaagccgtcccgacctaccgcttgatgagaagttggatcgggaagaagaattacttggaacttatgtttcagctcatccagtagaacggtttgcggaattaattaaacaacgccgttttgtcccaattcagcagtttaaagctggagaaaaggtaacttccatagtttatatccgcagcattcgctcaattcgaacaaagaagggcgaacctatggcatttgctaaaatcagtgaccagacggatgagtgtgaagcggtaatcttcccccgcgtttaccaagccacccaacttttagaaagtaaacgagtactgcagttaacgggcaaagttgagcaacgggaggaccagctccagctaattgttgatcagattgaagcgcctcgacaaattgcacatgggcaaacgcactggctaattaaagtacccagccgcaaaaatcccgctgatttccaaaagagattatttgggatgttcaaagagtaccatggtaaagttccggttaccttggtttaccgagataccaatcagcaacgagcactatccgaaaaatttagtttacaaggaacacccgaagtgaagaaagcgtttgaaaatttacttggaacagatcaaatttcattggttgaaaaataaaacgtgtattaaagcacttacattgaaagaattggcaaaatggtacagacaactgattttaaaagtgatagaatcaacaatgaagttttgaaaaaactcaatatttctatttgaggtgaaaaaatgaagcgtattggtatcatgacaagtggtggggatgctccgggcatgaacgtagccatccgcgccgttgcacgaaaggccataagctcaggtcttgaagcttatggaattaattatggtttcgctggtttagtagctggtgatattcatgaattcaaggcaacggatttagatgacatggtttcgcaaggcggaactatgctgtactcagcccgttaccctgaatttgctcaagaagaaagccaattaaagggtatcgaacaacttaagaagttcggtattgatgcgttggttgttattggtggagatggttcataccacggtgctcttcgcttaacagaacacggatacaatacaatcggccttccaggaacgatcgataatgacattccgtttaccgacttcactattggttttgacaccgcattgaatactgcagtagacgcgatcgataaggtccgggatactgctaagagtcatcaacgggtgtttgcggttcaagtaatgggtcgccacgctgctgatattgctctttgggcaggagttgcttcgggagctgacgcagtgattgcaccaggttttgattacgatgtggaagcaattgctaacaagcttaagagaaaccgtgctaacggtaaggattatggaatcatcgtaattgctgaaggcgatgcaaactctgaagctgctccagagtttattaaaaagcttaagcaatatggtgacttcgacgctcgtgctacggtaattggccacgttcaacgcgggggcgttccatctgctaaggaccgtgtcctagcaagtaagatgggtgcttatgctgttgaactacttcttgaaggcaagggtggtttagcggttggaatcttggataacaaggttcaagcacacgacatcacggacttgtttgatgcaaaacatcaagcagacgactcactttaccaattaagtgaggacttatcgttctaattttttattttattaatttggtataaaatgatctaaaagatcttttataatttaaaatcaagggagagattctgtaatgaagaaaaccaagattgtttcaacacttggtcctgcaagtacatcagttgacacgattgttaagttaatcgaagctggtgcaaatattttccgttttaacttttcacatggtgaccatgaagaacatttaggccgctacaacatggttaaggaagcagaaaagattactggtaaatcagtaggtattttgcttgacacaaagggtgctgaaattcggacaaccgtccaaaaagatggtaaccaagaatatcacacaggggataaggctcgtatctcaatggatgctagcttagaaactactaaggaaaagatcgcggttacataccctggtctttacgacgatgttcatgttggtggacacgttctctttgatgatggattacttgattttaagattgacgaaaaagatgacgaaaaccgcgaattagttgtgcatgctacaaacaacggtgtccttggttcacgtaagggtactaacgctcctggcgtatcaatcaacttaccaggtattactgaaaaagatgctagcgacattcgctttggtcttgaatcaatgaacattaactacattgctgcaagttttgttcgtaagcctcaagacgttcttgatattcgtgaattacttgaagaaaagaacatggaagatgttcaaatcttccctaagatcgaatcccaagaaggtatcgacaacactgacgaaatcttgaaggtttctgatggaatcatgattgctcgtggtgacatgggtgttgaaattccagcagaaaacgttccgttggtacaaaagacattgatcaagaagtgcaacgcactcggtaagccagttattactgctacacaaatgcttgactcaatgatcgaaaacccacgcccaactcgtgcggaagcttctgacgttgctaacgctgtttgggatggtactgatgcaacaatgctttctggtgaaagtgctaatggtgactacccagttgaagcagttgctacaatggctaaaatcgaccaaaaagctgaaaatgctatggctgatgacggtaaccttcaaatcaatacttttgatcaaagtgacgttactgaaacagtggctgctgccgttgctcgcgctgctaagaacttgggcgttaagacaatcgttgctgcaactcaatcaggctacacagcacggatgatttctaagtaccgtccagatgcagacatcttggcaattactttcgacgaacgtgtacgtcgtggtttgatggttaactggggtgttcacccaatcgttgctgaacgtcctgcaactactgatgaaatgttcgaattggctgctaacaaggcagttgaccttggttttgctaaggaaggtgacttaatccttgttactgctggtgtaccagttggtgaaagtggtacaactaacatgatgaagcttcaattaatcggttctaagttggcatctggtcaaggtgttggcgacgaaactgtaattggtaaagcagttgttgctacatcagctgacgaagctaaccaaaaggctgttgaaggcggaatcttagttacaaagacaactgacaaagattacttaccagcaattgaaaaatcaagtgctttggttgttgaaaatggtggtttgacgtcacacgctgcagttgttggaatctcaatgggtattccagtaatcgttggtgttcaaaacgctacatcaattctttctgacgatgaattaattacggttgattcacgtcgtggaattatctaccacggtgcttcaaactcactttaagatttaaagtgaaccattaaaggcttggggtctaggaccctgggtctttttttgtgcgctggaaaatgagtgttttctaagtaaaaaagcgcccaatatgaaaagaaaataatttgctaaatctttttgaaaatacgttgaaaaacggggatttgcatttttcgcctaagccaaaatagtgtacaatagtataataaataaacttttagattaaagaatgaatgcgaagcttcgttggggcttcgtattataattgaaaagaaaattttttatgtaaactgaaaagttcggagtgaaaatattggaaagctggctttttttaatagggattttattagtttcttggttgggaaaaaaccaatcattaatgattgccacaattgccgttttactatttaagctgctgcctaattctgctaaactctttagcattattgacaagcagggaatcaactggggagtgaccattatttcagtagcaattttagttccaattgctacgggaagaattggtatcatggacttgattaactcattcaagtcaccagttggctggattgcggtcgcttgtgggattttagtttcattattgtcataccaaggggtcggctttttatctgctagcccagaggtgacggtcgcgttagtcatgggaacgatcattggagtggttttcatgaacgggattgctgctggaccaattattgcttctggaatagcgtacttaattattcaattattacaaatccaaattaaataaacgggagaaaacatggaaacattattaggcaaaaagattcaggcgaaggttattgatgaaaatgaccaattttattttgcacaggctgaagatggcctcacttatcgcattgacaaaagcgaaataaagaagcctttaaaaaaggatagtaatttcagcgggttcgcttacgaaaatgctaaccacgaacgtcaaatgacgcgcgaagccccaaaagccactaccggaaagtacggttgggggatggtggttaaggttcgcaaagacttaggagtttttgtggatatcggtttaaataacaaggacgtggtggtttcgcttgacgaattaccaacggaaaccaagctgtggccacacgtggatgatcagttactagtttgtctcacggtggataataaggaacgaatgtgggcacatcctgccgattccaccgtttttaaggcgatttctgtccgggcaaataaaaaaatgattaaccagaatgttactgcaacggcataccggctaaaattagccggaacattagtaattactgatcaattccaactaggctttatccatccttcagaacgggatcgggagccacgtttaggtgaaaaggttcaagcacgggtgattgggattcatccggatgggacgttgaacttgtcgttaaagccgcgcaattacgaagcgcttggcgacgatgcggcgatgattttagcgttgttgcaacaccgctcggataggcaactaccttttaacgaccacagcaatcctagtgatatcaaagaacattttgggattagcaaaagtcgttttaaaatggcgattggtcacttgcttaaggcaggcgtaattgagcagaccactgatgggattgttttgaaggagcaataggtgatggatgatctgattaatgattatctccacgctctaaaagttgaacggggactttcagataatacaattgtgagttatcgtcaagaattgcgccacttgcaaaattttttgcaggagcaacatattgcggatattaaagatgttgatcgttataccatcttaaactacctagatgctttaaaacaaactggccgggctcgcagttcttcgattcatacgatttcaagtttaaggaaattttttaagtatctgctgcttaacgaccaaatccaaacgaatcctatggctaatattgacccgcctaaacgggcgcagcatttaccatcggttttgaccactgaagaagttgaacggctgcttaaagtgcccgatactagtaaacctttgggaattcgagatcgggcgattttagaagtgatgtatgcgaccggtctacgggtcagtgagctgattgcgttaaatctaaatgaacttcatttagagatgggacttattgaaacggttgggaaaggaaataagcaacggattatcccaattggggacgtagcgatccaatggctagaacgttacattaacggtccgcgaagagcgttgctgggagctaagcgatacaatgaaattttcttaaaccagcatggtcacccgttaacccgacaaggagtttggaaaaatttaaaagctcaagttcaaaaagcaggaatcaagaaaaatatcaccccgcatacattacgacattcttttgcgacacatttgttagaaaatggtgcagatttgcgtattgttcaagaactactaggacacgcggatatttcgacaacccaaatttatacgcacattactcaacagcggttggtggatgtatacgataagtatcatccgcgagcctgataacaggggagcaaaatgttagttaaatatacagaatcaaaaagacaaattgcaatgggcttattgtcaacgattgatgcgtttggttcaatcgacgttgttcagcaagttctagagcgatataccaaaaagaatcggcaaatttatctagaacgtagaaatggtacttacattggattggtactaattgttttggaggcagattgcgtagttatagaacggatggccttcatcgccaatgaagaaacggtttttaatgaaaatgaaatctttcggtcattattatcgatctttccagaccggcgcttaatgggttctttaaaaacgagtgcaatgattgaaaggtttgaaatggggcaagttgatgaaagttaaagtgtataacttaccggacgtgaagctagccgattttgaggggccgctcgatttattattacacttgattcgtcaatcgcagatgagcatttacgatatccgcatttcagaaattacaagccagtatttacagtatttgcatactcaggaaactctgcgattaaatattgccggagaatacttagtaatggcggcgaaactaactgaaattaagggaaaaatgctgttgcctcacgaagaggatgaagaattggttgacgaagatccccgaactgatttagttgaccaattaattgaataccagatttttaaaacggcctctgaaaatttacgggacttagaaggcgaacggcaacgctcgttttcgagacctgagatggaaattgaccccgcaacggtcactagattagcacctggaatcgagcttaccgatttgcaaaaagctttacaaaaagtacttgctcggcaagcattgttggagccagtttcacgtacggtacagaccgaaaaagtttccatcgaagaacaaatggattttgtgaagagaaggatccaacagcgctcggtttgtcgttttgaagatttgtttaccgtccgggtgaaccgggaagtgttggttaccacttttatggcaattttagaattagccaagaaccagcaaattaaattgtcacaggattcggcagaccaatcaattacaatcaagataggtgaagttaatgaacaaggaacaaaaagttgaagggctactttttgtagcgggagctgaagggattgcattggctagcctagctgaattaaccggctacgctaagccagcggtaaccaccattttggaaaagttagccgaaaaatatcgccaagaccccaattcggcgttaagcttgattcaaacgggcggaacctataaattagttaccaaacccgagctagcttcgctaattaaaaaatattttgctcgttccaaccaagcgggattatcggcggcagctttggaaattttagcgatcgtggcgtaccggcaaccaatcacccggattgaaattgatcagattcgcggtgttcatagcggaaccaccttacaaaatctcgtccttagaaacttagttaaggttacgggacggttgaacgaaccgggacgaccgaaagcatatggaaccaccgcagaatttttagactattttgggttacaagatcttacggaactgccggcgttgcctgaagataccgaaaattccgcagaagatcaagataatgaggatttatttttacaagagtttgaatcaaaaatgacaaccaacaaggagtaaccatggcagaagaaagattacaaaaagtaatggctgaggctggagtagcttcgcgacggaagtccgaaaagctaatcgccaaaggacacgttaaagttaatggacgggtagtaaaagaattgggcaccaaagtagaacagcatgaccgaattgaagtcgatgaggtgcctattcaacgcgagcaaaacgtctatttcttactaaataaaccgcgtggtgtaattacttcggttagcgatgataaaaaccgcaaaacggtcatggacttttttccagacgttaccgaacggatttatcccgtggggaggttggactacgacacttctggcgcagttttgatgactaacgatggtgaattggctaaccgcttaatgcatccgaagtttaaatttgaaaaaacgtacactgctaaagtcaaaggactggtcaatgggtcagccttgaagcgtctggaagaaggagtcgtaatcgatcaccgcaaaactgctaaagccaaggccaagctgattagtaccgatttagaaaaaaagacatccatcgtgcagctaacgattcatgaagggcggaatcaccaagttaagaaaatgttcatggcggttggccatccggtgcaaaaactacaccgcaatagctactctttcttatcaatcgatgatgtgcaatctggaaaatggcgcgccttgaaactgagcgaagttaaacgtctgaaacggtaaacattcaaatgaaaccggaagacggattaattttttttgaccgccatcaaagtcgccgaccaaaggtgattttgaatttgttgaaaaacaagctaacggtatcggcactttatggcggcttagaatacgggttgctaaattacattggtttttggaaaaaactggatcgtcaggaattcctaaatagtttagatcaagcagttaaaatgggctacttaactggggaacgggatgcgttaaaactaacggaacggggggcacagcaacaaagtagagttttgccgccaccggaagctagtttacgagtcaaatttgatcccgcaattaagctttggctaatggcaacccaggtagtttcggagtatagttttaaaaatacgcggtacatcccaataagtgaagactctcagataaacttcatggtaaaaaagtggtttgccaactggaaacaaagtgaaacgtcccgtccaaaattggttcaggaataccaacaggctttgggtgcactttgcgagcaattacctaaagaagaagccgactggtttgtaaactacttacccaaccatcacgacttgggattaacggtggagcagcttgcccgggttaataacgttagtccatttcaaatggaattacggttacgcttaatttttaggaaaatttttagctcggtaattaataatcaagtgacgccctttaatcaattaattggaatggttgtgcaaccctctgttttgcccaaaagtacgtggcaaactttgcagctattacaaaagggttataatgtagataaaattgcagaattgcggcgggtgaaaattaatactgtaaaagaacacttactgatgatggcaatcttgctggatgattttccctgccaacaatttttgagccctggtgttgctcaaatgaaaattgcgggaattgattttcaaactgcgttgcaggaatatcctgagctaaccttttttgattttcggcttagccaaattagatttattaaggaacggcaaagacaatgacaatttcggaccaattaatttatgataaattgaaggaccggtttggatttcaggaatttcggcccggacagttggaaattttacataaattgctggaagggcgaagtacgctagcaattttgccgacgggagccggtaaaaccttaatttaccagatgtatggtttactagtccccggaacggtagtggtggtttccccattgttatcccttattaaggaccaaatccaacggttgcgtttgagtggcgagcgtcaaattgcagagcttacttctcaagtagcgttcaccgatcaactatacgtattaaaccatctggcggaatataaatttatttttttatcaccagaaagcttacaaaaagcagaggtacaagggcgaattgcccgcttaaagattgcgttgatggtcgtggatgaggctcactgcattgtgcagtgggggaagtcgtttcgtccggactatttgcgaattggacaagtccgtcagcagtttggaaatccattgacgttagcgttaacggccactgctagccggaacactcgctcggaaattttgcgatacctcgccttaaatgttcaaacaactgagcagtacgttgcttccgtagaccgcaaaaatatctttctagattttttgtcaaccgataacgtcgctgataaggaagaattgttattaaatctgatcgaccagctaccgggcgcgggcattgtatacttttctagtcgaaagattgctagccaagtaagtgaactaattaatcgccaacttaggcaaacggctgcgccataccatgcggggatgtccacctatgaccgactacaagttcaaagtcagtttcaaaaaaatcagcttgacgtgatttgtgcaactagcgctttcggcatgggaattgacaaggctgatattcgttacgtaattcactaccacatgccgggcgacattgaaagctacgttcaagaaattggtcgtgccggacgcgacggtaagtcaagcgtggcgattacgttgtacgcgacgggagatgaaatgattccaactattttaaatagttattcacttccaaacactgatggattgccgttgtcaaatggtgaacagcaaactgaagagcagcaagctttggttaattattatcgggaatttggtctaactgaaagccaattaaaaaaattatttaaaaaacaagcgcaacaaaaggaacaacagattttagaaatgttaaaattaattcggactacgggatgtcaccggcgctttttattgcaacattttgatgaaccgtttacgaaacacgatgaacaatgttgcggttcgataagtgatttcacagaattcgggttgcaagagccacatgattctagtaaattggcgatgatgggctggaaggacaaattagcacaaatttttgcggctaactagcctgttttacgtagtcattctaaataaaatattgtaaaatacatcatattggtatgcattaggaggacgaacattgagtagcaaaaacaagaaaaacaaaaaatcaatcaaaaagacttcgtcaaatgaagttactgaggaacaagctactaacgaaaaggtagcaaacactgaaaataaggcagctgcttccacaacggatcctaaggaatcagcccatgccgagcaaacagctacgaatgaacaggctgctactgaagagcaagcggcaagtaagtcggaacgcggcgagtttcataagcaaaaaaagcggactaaaaccattgtaggttcgatgatttgggtagtaatcatcttggcaattgcgtcgttagcttattacatgacccaacggcaagattttcagcaaaaaactgcgaatactacaaccactcaggtagctaaatcaagtaagaaaaattcggcaagtaaagccaagtcttcatctaagaagcatgaaaaggatgcttcgtcatctgctagttcaacatcatcaacgacgaaaaagaacgacgacaagtcaaaatcgtcatcagtagaatcgtcagcaagctcgtcaacagcatcctcaagcagtgcaacaacgcaatcctcaagtagcgctagttctgcagaaggtgcgtcttacgcaacggtccaagctggtcaagggatgtatcgggttgcggttaacaacggaatctctgttcagaagttgatggaattaaacgggttgaacagtaactccgaaattgaacctggacaacaattaagagtaaggtaggtcgttagttagtttatggacaagaaattacaaattgcaattgacggacccgcatcagcagggaaaagtacggttgctaaaattgtcgctaaggatttaagttacatttactgcgatacgggcgcgatgtatcgtgcagttaccttaaaagcgatgcaaaatcactttgatttaaatgatgaagaaaagatcgcgacaatgttgacagaaactaagttaaattttgaacccggtgatcccgtacaaaaggtctttttggacggaaaagaagtcacggaagcaattcggcgaacggacgtaaccaatgcggtttctacgatagcggctcaagaacaagtccgtaaagtattgacggactggcaacgcgacttagccaaagatggcggaatcgtcatggacggtcgcgacattggttcagctgtattaccaaatgccgaagttaaaatttttctcgtggctagtgtccaagaacgggccgaacgtcgctataaggaaaatattgcaaaaggcatggatacagatttagaacaattgaaaaaagaaattgaaattcgggaccacaaagattcgacccgagaaatttcgccactcactaaagctgccgatgcaatcgaggtagacactactgccatgtcgattgaagaggtggtacggaagattttagacattgttcatgaaactgtattcagaaagtaacaacaattactagcaattatgcaattttttcgatattatataagtataagtgctgtaaaagggggattattcggatggccgaaaatgatgttaatcaaaacagtgatttactcaacgcaattaatagcgttgaagaagtaaaagttggtgacgtagttactggcgaagtacttgatattgatgacgatcgtcaagtgatcgtgggaattcaaggtgctggtgtggaaggtgtcgtacctttacgtgaactttctacgcaacatatcgacaatattaatgacgaagtaaaaattggtgatgaactagaacttgtagttatttcacggattggtgacgataaggaaggtggcagttacctactttctcgtaagcgtctattagctcgtaaagtttggaaagaaattgaagaaaaggctgctaatggcgaagaacttgaagtaccagttactcaagtagttaagggtggtttggtagttgatgctggagtacgtggatttattcctgcttcaatgattgaaaaccgctacgttgatgatttaaatgcttataagggtcaaactcttaaagttaagattatcgaaatcaagcctgaagacaaccgtttgattctttcacacaaggcggttatcaatgctgaacgtgctgaaaaacgccaagaagtattaagctcattgcaagaaggcgaagtcgttactggtaaggtagctcgtcttacaaactttggtgcctttgttgaccttggtggaattgacggacttgttcatatttcagaaatttcatacgaacgggttgaaaaaccttctgacgttcttaagcctggtgaagaagttcaagttaaggttttaagtgttgatccagaaagagaacggatttcactttcaatcaaacaaacccaaccaggaccttgggaaaatattgctgaaaaagctccagtaggtgctgttttagatggtaaagtaaaacggttaacggatttcggtgcattcgttgaagtcttccctggtgttgaaggattagttcacatttctcaaatttctcacaagcacatcgctactccagcagatgtacttgaagaaggtcaagacattaaggttaaagtacttgaagtacatccagaagaacgccgtttggcattatcaatcaaagctttagaagaagctccaaagagtgaaaagaaagcttctaaggctccagcaactgactacagcaaggatatgccagaagaaacaactggtttcacactaggtgatattattggtgatagccttaaagattcagataaataattcaaaaaattgttaggattaataatttaacatgtcgagtgctagattatgcctatcaactcagttagaaaggccttggcggagaatgatagtctgtccaagacctttttaatgttgtatttagaaagggggccaattgatgggaaatccaactgtagcaattgtcggccgaccaaacgtcggaaagtcaacaatttttaaccgaattgcgggggaacgaatctccattgtggaagatactccgggagtaacccgagaccgaatttatacccatagcgaatggctaggccggaaattcaacttaattgatactggcggaattcaaattggtgaagaaccatttttagaagaaattcgagatcaagccgaattggcaattaacgaagcggacgtaatcatttttatcgtaagtgtccgggaaggcgtcagtgacgcggacgaagcggttgctaaaattttatataaagccgataagccggttattttagcggttaacaaagttgataacccggaattacgccaagacatttatgacttttacagcttaggttttggtgacccgtacccattatccggaagtcacggactaggtttaggggacttactggacgcagttatcgctaattttccagaaaaagaagagcaagaagatgacgaggcaatccgctttagtttaattgggcggcctaacgttgggaaatcttcactcgttaacgcaattttaggcgaacaacgggtgattgtttctgacattgcgggaacgacccgggatgcaatcgatacgcgttttacaagtaatggtgacgaatttgtaatggtcgacaccgccggaatgcggaaaaaaggaaaaatttacgaaaataccgaacgttatagtgtgatgcgggcaatgaaagccatcgacaacagtaacgtagttttggtagtactaaatgctgaggaaggtattcgagaacaggataaacggattgcgggttatgcccacgaagcgggacgggcaatcgtaatcgtggtaaataagtgggataagctaaaaaaggataaccatagtttatctaactttgaacagtcaattcgccaagagtttgcttacctcagctatgcaccaattatctttgtttctgccgttacaaaacaacgtttatcgcaacttcccgcattaatcaaacgggtcgatgaaaatcaccgtcgtcgagtgcaatcatccaccttaaacgacgtgttgatggatgccattgcagttaaccctacacctagtgagaacggcaaacgtctacgggtttactacggtacgcaagttagcatacagccgccaaccttcgtgattttcgttaacgatccggacttaatgcatttctcgtacgaacgcttcttagaaaacaaaattcgcgaagcattcgactttgagggaacacctgtgcatttaattgaacgtcgtcggaagtaattcttaaataagtattatagatgccgtttttaatgcaaaaagcgcaaaaaagcttgtcacagcagactctgtgtgatatatttcaagttgaaataataacagattattgtttcaccgtttttgatttttcaaaaatgacaaaacaccttgttttgataaacaaaattcaggaggtgaaatatacatggcaaacaaagcagaattagttgaaaatgttgctaagaagactggtttaaccaagaaggatgcaacagcggctgttgaagctgtatttggctcaattcaagatgacttgaagaagggcgacaaagttcaattgatcggtttcggtactttcgaagtacgtaatcgtgcagctcgtaagggtcgcaacccacaaactggtaaagaaattgaaatcgcagcaagcaaagttccagcattcaagcctggtaaggctttgaaggacgctgttaaataagcggatttctgaacttgggtcagcatagctctgttatgctggctttttgtttgcctgtaaaaattatgaataacgaagaagcaaattactctaaaagagcattagacgccttagaatcgggacaaattgacgaattcaaccgattatacggttgggcgttgagaaaagatgatgacgagaccctttataacctagccggggaactgtatgctttggggtttgatggcaaggcactccggatttatgaaaaattgatcgaacgatatcctggtgatcatgaattaccggtattggctgctgaaattttggtggaccaaggagaaaatgatcgtgctctagcgaacctagaaaagattcctgaagattcggaattttacgtgtcggcattaatggtggaagccgacctttatcaaactgaagaattatacgaggtttcggaaagaaaacttttagctgctgagcaacttgccccagacgaaccggcaattcaattagccttaggggagttgtactacacaatgcaagactatcctaaagccgtcacgtactacctcaggctgattaagcaagggatccctatgatgagccaaatcaacattgtcgagcgtttagcggcttcctatgcggcttctggcaagtttgaaaaggcaatcgcttattatgaacagattcatgatgaagacttgactcccgatattttaatgcaggagggaattacctatctgcagcttaatgaagtgcaacgcgcgcagacggtgttagaaaaagttgtcgacatggactcatcgtacagcagtgtctatccatacttgattgatgcgtaccgccgcgatgaggaatgggataagggcttaaccgctgcacaagaggggttagcggctgaccaatataacccggacctgtatttgctggctgctgaaatggctgagcacgcccatgatgacgagttagttgagaagtacctacaaaaagctgtagaattggccccggataatcaagcggccataattcggatcaccgatttttataatcgtcaaggtcgttacgcagaaacattaaattacgcgacggacgaaatcacggatgcccaattaaattggaacgtggcgcttgccgagtggaaaacggaagactttgcgggagcacagaagcattttagtgctgctgcgaatgatttggctgattctgcgccgttcttgctagattggtaccacttcagtaaagaaaatggtcaacttgaacaggcggtagacgtagcgcggaagtatgtcaaattggtcccaaccgatttgaatatgcaagatgaattagcagatttggaggtgcagggttattaatcgttggcaagataactttaagattaaagattgggcgcctaaatttaacaaaaagatggtcgaggttatgcgtaaaaatcaatttacggcagaacaaccggcggactttacgaaatttaacgacgcaagttttaatgaacaacaaacgttaatgaaaaatgtgattgccaaaaattaccaaattaaactactcactagttttaacgaacgaaccgtttacggagtcgttggtaaaaacgcaaccggtcagtttttctatgcgctagacaagaatcttccggaaaaaatttcgactgcggagttaaaaacattgctctaaaatgctcttagctatgttatagttttattacacaaggctaaaggagtgattggaagaatggcaaattcggtatatttagcagcacctttcttcagtgatttacaaattgaacgggtacggaaggttgaagaacttttaaagaaaaattcgacgatcgacggtgataacatctacgttccaatggatcaccaatacgaagcagaaaagtttggtacttttaagtggcaagttggcgtatttgaagctgacgttcgtcaagttcgtaaatcagacgtggtggttgcaattcttgattatgctaaacaagatgaagaagtgatttcagatcctggaacggtatttgaaattggcgccgcatttgaaaatggcaaaccagttattttagttcaatttgacgagaccgacaagattaacctcatgttggctcgtagtcacgcagcattcttccatggagaagatattaaaaatttagctacctatgattttaatgagttaactccgaaatattctgatttaacggtcttttaaaggttaggcagcggtaataaaaatgcagaaattgccaattggcgacttctgcattttttgtattattcaggttgtttatcggaatcgtaagtgaatccttcaccaatggcttcgtgaacgtcgattacggaagtaaacgcgcgggggtcgacgcgttcaataattcgtttagctaagttgagttcgttaggaccgattacgcaataaaccatctggtgttcgttattggaatacgcgcccgtcatttttatgtaactggcaccacgaccgagctcgtccataagggcttctgcaatttcttcattttgatcactgatgatgattaagccgtggccggcgtaagctccgacctgggtcagggaaactaagcgggagaaaacgtaggcagctagtaacgtgtacatcatgtgcaagacgtcaatgtagcaaagcgaaatggttaagacaaccgcatcaagcgcgaaaagggtgtgtcccattgcaattccgcggcgcttttccaaaattcgggcaacgacgtcggttccaccggtagttccaccaaaacggtaaacgaccccgctcccgaaaccaccggcgatcccggcgagaattccggcaatgaacatgtcgtgatgaatatccaagctaatggggatgcgttgccaaaagtacaaccaaaatgaaagtgctaacgttccaaaaattgtgtaaattaaggaacgcttacccaaaaagcggtaaccaattaaaattaagggaacgttgattaacagcgtggaaagcgcgggatcaatcccaaacaaggcccgcaatatcagagttaccccggtgatcccaccctccgcgaggtgattggggatgttaaccacggcaaggccgagcccgtacagacaacagcctagcgtaatcatgacgaaatctaacaaccgaattgattcatctttttgcataaacaacctccttattccttatgcagtacttgcaaatatcataccatagaagtggaacttccttttcaaaatcagggtggtttctggtagtattaaatgtggattggatgtgagaatggtgcagttagaaaaaatgccacaagagtttgaagaagcacgaaacgtgttacaacaaatcgaagaagctggatatgaagcttattttgtgggcggtagcgtccgggatacgttgcttggtaagcccattcacgacgtggacattgcgacgagtgcttatcctgctgaaattaaacaaatttttaaacgaaccgttgatacgggaatcgaacacggaaccgtaatggttttaactggggaacatagttacgaaatcaccacttttcgaacggaaagtggttaccaagattttcgacggcctgatcaggttacgtttgtccggtcactaaaggaagacttaatgaggcgcgattttaccattaacgcctttgccttacgggaagatcgaaccgttattgacgtttttgacggtttaaccgaccttaaacagcataaaattcgcgcggttggggaccctaaggcgcgttttcacgaagatgctttgcgaatgatgcgcggagtccggtttgctagtcaattagattttgtgatcgaaccgcaaacgttagcggccattaaaatgaatagcagtttgttggctaaaatctcggtggaacgaaccctagtagagtttcaaaaaatgatgctaggaaccaaccctaaccggggactagctgatatggttgccacgcggctcaatgaatactgcccaggattagccggtaagggagccgtactgcaggaattactggcttatccgctaagccagttagaaaacgaaaaccaagtttgggcgcttttagcgtggatgttgcagctacgtggcgcacaaatcaaccgctttttaaagcagtggaagacctctaacgaattgatccgccacgttacggcaaccgttcgggtacttagcatgctggatagtaccggggtggatcggatgattttatttgaagctggtgctgataatgttgctaacgcagtccgggtggcgcaaattttaggccatgacgaacggggatggttggatacttaccaaacgctccaaatcaaatcacctaaagaattagcggtgaccggtaaggacttgattgcaaaccagatcgtcactccgggaccccaaatggggcggattttaaactccttaaaaactatggtaattaacgatcaattaccgaaccaaccagaagcattgtttacagcagcacgaaaattagggaaagatgattgagaatgaaaacattaaaggctaaaaatttaaccaaaacatatggggaaaagcaactctttcagtcgattaatttcaccattaacgaaaatgatcggattgggttgatcgggacgaacgggtcaggaaaaaccaatctcttaaacgcggtcgctgggattgatccggccgatagcggcgagtttgaagctcccaacgattatcggattgcctacttaaagcaaagctcggagattaaccaatatgaaacggttcgagattttatttatagcggtgaccaagaagtttttcgggtcatcaaacgttacgagcaagttttagctcaatatactgataatcccacttcaagcacgatttttgagaagtttaccaaagccgaagatgaaatgaaccggctggacgcctggaataccgaaagcaatatcaagacaatcctaacgcaactccacgtggatatgctggatgccccaattaaccaactatcagggggccaggtaaagcgaattgcgctagcgcaggctttattagaacccgcggatttattgctactggacgaacccactaaccatttggattttgactcaattgagtggctagaaaagtatttagccgattacaagggtgcccttttactagtcacccacgaccggtatttcttagatcgggtaaccaaccacatctgggaactaagcttcggtcacctgtacgaatatgaaggtaattatgctaaatacgtggaacaaaaggcgttacgcgaacagcaaaatgaagctagccaagaaaagaagtataagctttataagcaagagctggaatggattaagcggggtcctaaagcccggggaacaaagcaacaggctcgaattaacaagtttgagaaacttgatcaagacgtgcatgcgcctaaagaaattgaccaagacgttgagattggactaacccaacaacgattaggaaaaaaagttattgaaatcaagcaccttgatttgcaggtgggggaccacccgattgcccgtgactttaccaagttgattcaagctggcgatcgaattggaatcaccggggccaatggtgcgggtaaatcttccttcttgaacgcgattgccggaaagctccccattcaaggcgggacgattgacattggtgaaacggttaaaattggctattatactcagaagatggagcccattccagaagacaaacgggtaattaattacatcaaggaaattggtcaagaagttgttaaccgggacggtgaaaaaattagcgttaccagtttattagagcaatttctctttccaaagtttatgcatggaagtttaattaaaaaactttcgggtggtgaaaagcgccggttgtacttaattaaggtcctcatgcagcaacctaacgtcttattactagacgaaccgacgaacgacttagacattgccaccttaaccgtattagaaaactaccttgaacatttcaacgggaccgttttaacggtttctcacgaccgctatttccttgataaggttagcgatcaattattgatttttgatggtaacgggcagattgaacaatacactggtcaaattagcgactaccttaaacagcgggcgcaaaccacgtccactagcgctaccacggctaagccccggacggaaccaactcccgtagccaaaccaaaaaagaagaaaaaaagaacctatgccgaagaaaaagaatggcagacaattgaagcagaaattgataaactagaacaaaaatctaaaacaattaccgaacaaatgaacgaatacgctgcggattatggcaaactatcggaacttcaggctgaactcaaccaggtatccgatgagttagagaataaaatggcgcgctgggagtatttggaaagttttgaagaaggggagtaacgggatgctcgaagaacaatacctgaacctagaaagatacgtcttagaaaatggtcaccaaaaaaatgaccggacacaaacgggaaccttgagtacctttggctaccagatgcggtttgacctcagtgaagggttccccctgctgactaccaaacgggtgccgtttggcttaattaaaagcgagttgatgtggtttttgaagggtgatacgaatattcgctatttgttacaacacaagaaccacatttgggacgaatgggcctttaaaaaatgggtagagagcgccgaatacgatgggccagatatgaccaattttgggcaccgcgccttgactgatccagattttaacgcacagtatcaagtgcaaaaggatcgttttaccaagttaatcttggaagacgacgcctttgctgctaagtacggcgatttgggaaatgtatatggtagtcaatggcgggcttggaaaaccagtactggagaaactattgaccaaattgaaaacgtgattgatttgattaagaaccatcctgactctcgccggatgatcgtgaccgcttggaatccagaggatgtcccaacggctgctttgccaccgtgtcactcgttattccaattttacgtggctgatggcaagctgagttgtcaactttaccaacgtagcggggatattttcctcggggtgccgtttaacattgctagttacgcattgctaacggcgatgattgctaaaacttgtggtctagaagttggtgaatttgtgcatacccttggagacgcgcacatttacagcaaccatattgcccaagttaaggaacaattaactcgggaccctcgtccggctccgcggttgaagtttaaccaagttcacgaaaatatctttgattacgaaccagccgacattgtggtagaaggctacgatccacaccctaccatcaaggctccggtagctgtttaagaaattaggagatttgcatgattacaatgatttgggcggaagatgaccgtcatggaattggtcggcagcaatccatcccgtggcacataccggatgatatggcttttttccgacaaactacgctggaccattcggtaattatgggtcgcaagacttttgagtcgattggccgtccgttaccgcgtcgaacaaatctggtactaactcaccatccggaacatttgccctcggaagttcggggattttcttcttacgaagaactgttagctagccttacgaaaacggaaaagcatttcgtaattggtgggtcagcggtatatcataagttaatgccggttgcggatgaattattgatcactaaagtaactggcgactttcaatgcgacgtatttgctcccgtggtggataaacaaaagtttactttacaggaagaacgtccgggaaaaagtgtacctggagttccagaccacgtttttcagcaatgggtcaagcgtaattaattttgggtgaaattaactatgaaaaagccatgacgaaagagagtgggacaaaagtcgggtaatttgcgagcattaactgaaaattaaccatgatgcctgaattgggcatgatggtcaatttttggttaagcggaacaaactgacttttggcgcacgttttggctctattgaagacaaaacaccaagacaactttttaagatccttttcatccttgaaaagcattttattagttttttcccaacctttttattaaaaaacggcattattcagccaaaaatcaacagagattgttataataatattattaagcaagcgagttttactaacttaattgaaagtgttaattgacgttggttggctcgtaataattatgatacaagggaaagtggaagcatatgactcaaattaaaattgtcaccgattcatcctgtggtgtaacagatgaagaaatcaaaaaatataatatttcaatcgtaccattgagcgtgatgattgatgacaccgtatacgtggaaagggagaccatttctaacgaagaatttattcaaaagatggccgagtcaaattcactccctaaaactagccaaccaccgctaggtaaattcgttgagatgtttgatcggttaggtgcggatggcagccaggtgattagttttaatatgcttgcggccattagtgggacggtacacactgcgcaacaagctgctgaactaagtaagtccgacgtgacggtggtggatagccaatttaccgatcgggcactagcctttcaagttattgaagcggctaagatggctcaggctggagcaaccaaagaagaaattctagaacgagctgcctacattcgcgaccacactaaactttatttaggtatcgttaaccttgaaaacttagttaagggtggccgacttagtaaggttagtggaatgcttggcggattgttaaatatcaagctgcttttgcaggtaaaagatggtaaattagacgttgctaacaaagttcgtggtatgaaggccatgaagaagatctggcttgatatttacgaagaaatgaaacaaagcggtaaaattaagtcagtcgggatttcacatgtgcatgctgatgaaatggttgaagatatgaagaagcacgttggcgaacttttccctgtgaaggatattgtggttcgtgaaacggtgccaatcattgctacccacactggcatgggcgcattttgtttactatattacagtgaagactaacctttagggctaaaatcgaataagcggttttggccctaatttggtttaagagtgaggaaaaatgaaaaaagttttaaaggaaattgtgtttagcatcgtgggggtgcttttaatcacaacggtttttttgtgggccatgggttttttcaaaagctcgcagcctagccactcgccaaatcctaccccaactgccgttaaaaagagcgtgaagctcaaagctaagcagccacagcctgcaacgtcgcaagtaaagattctggcgctaggagactcgctaacccagggtgtgggagacactcaggacaaggatgggtaccaaaagcgactaaaaaagcaaattgtgcaaaaaaaccttgcaggtaaagcaaccgtttatgatgaagggattagtggcgaacgtagtgaccaaattttacaccggttgcagaatacaaaacggattcaaaaagaagcggctaaaagtgatgttttggtggttactgcgggaggcaacgaccttttccagaacttacaaaaaaacgttagtgaatcagaaagtcaaattttagtacgggttaataaagttagcctagaatatcaaaataatttacggaaaatttttgaaattgcccggaagaataatcctaagataaaaatcgtgatggtgggcatttataatccattttacgtgtacttccccaacgtaactagcattacccaagcggtaacgacttttaatacaactgctaaggcgacgactgatgaatttgacgacgctacttttgtgaacatcaacgctttatccaaagggcagtttactactaaacaacaaatcaaaaaattaaagaaacaaagtaccgaagatgacattgcggtagtggaaaagagtcgggtggaagctcggaaagtggacagtaaagaaaagaacgcatacctttcaaatgaagatcattttcacccaaatgacaaggggtatgatatgatgacaagtaaaataaaatccgctttgcaaaaattggaagtttttgattaggagggcggaatgaacaagtatttatataatttttggaaatggggatttttaactctggtagcgttattattggcggggagtgtttacgtgggctttaaagcgagcttaccagtcccccagtttgaaaaaacggctaagaaggatcctcataagtttgaccaagtaccaatcatgttgaataaaacgcagttaaatgacttaagtgcggcctatttgaaccagtttcaaaaaagcaaagactttacctaccaatttagaattggaaaacattacgcgattttaggcggccaaattgaagtcctagggcaaaaagttcaatttgcgttaacgatggtgccttcagttactaaggggggcaatattaggcttaaagcacacagcttgtcagtgggaacgttaaaattgccagctaaggtggttttgaaatatatttcccgcaactatgaattacctaaatgggtaattattaatggggatcaggcactgctacgtttagaccagatcaaaaccacaaataaagttagtttccaagttgaaaagattgatattgcacacgaccagtttaaattcattatcaacgtgcctaaatcagcaaactagccgagttgtcgtgaagtagaggaggaatattttgagaaaaacattttaccagtttttaatgacccaacggaatccggaacctaatgacgaagttgaagagtttgcaaaccaagcttttttcgaccaatcatttcctaaacaagaccgggattttgaagaaatcagtaagtatctagagctcaacgggagctatttgcaaaacatgaccatttttgatcaggcttggcaacgatacttggaaagtgaacagaattaatgaaaaaatttattaatcgacacccgtaccttaccgtggttgggtcggtaattttagggagtgttattaccttggcgggggtgatgacttttctactgggtttcactaattcatcagcagaccgccaaaccaatttaaaccggattgcgagcgtttataatcaaattgatgctaattattaccggaacgttgattctaacaagttagctaccggggcaattaacgggatgctggcaaccttagacgatccgttttcaaactaccttaccgatagcgacgcttcctccttaaatgatagcgtggcgggatcgtttggcggaattgggatccaagtaattaaaaagaatggtcatatcgaaatcatgtccacgattgacgggacccccgcacaaaaagcgaagctgaaggccggcgatcagattattaaggttaacggtaaatcagttgctagtcagtcgttgtccaaaacgatgagcattatgcgtggtaaggtgggaaccacggtggaattggaactacagcgcggagacaccacctttactaaaaagcttaagcgcgccaaaattccggtcgaaacggtgaccgggaagctattgaagaataaggtgggatacatcacgatttcttctgtagcagagaagacggcgagtgaactaaagaagaacttgaagaagctagatcatcaaggggctaaatcatacatcatcgacgtgcgtaataatccgggaggcttgatgcaacaggcgttgaagatgtcttcaatgttcttaaaagatggccagccaattatgcaggtcaaaacccggagtggtaagcctgaagtttataaggctagccataagttagacgggggctacaaagttaagaaaccggccgtggtaattattaatggcgaaagtgccagcgctgccgaaatttttgcggctgctttgcatcaatcagcggggattccgttggtgggcgcgcaaagctacggcaagggaaccgtacaaaatattacccagtacacggataatgacgaacttaagctaacgattgctaagtggttaacgccggacggaacctggatcaataaaaaaggactaacgccagattacaaagccgactatcctgaaatggcctacatcaccacgtttaaccaccataaaacgtaccaagtggggcaaagcggtaccgatattaagaatctacaaattgcgttgaaagatttgggttattattctggcaaagttactaaagattacacggaaagcgttgcgcaagcagtgcaagcttaccaacaagctaatcatctaacgattaccggaaaaactgacgcgaagaccatgcgttctattgaacaagcggtaattaacacactttcgaagagtgaccccgcgttaaataaagcagaacaagtgcttgctaagcaaaaataagtatgaatcaaaacttttaacatgaacttcaatttagtaaaagtaattagggtctcgtcattaagttggcgagcccttttttaatacggaattttcaaaataatagtgaatctttaaataaaaagcggatggagtctggttctttagctaaaaaatgtagtatcataaattaaagtttagatatgacttaggaggctactatgaccacattttattgttattctaagtgtagtacgtgtaaaaaggccgaaaaatggctaaaagagcagcaagtttcgtataaaaaaattgacctagttgaacagccgccaactaaggcgcaaatgctggatttttttgctaaaagtgatcagaatttacgctattttttcaataccagtggaatggactatcgtaagatgaaacttaaagataaggtagatacgatgtcaaaggaacaagcagcggaattaatgtcgcagaatggcaaattgattaagcgcccactaatggttgacgatactaaggttacttgcggttttaataccgcggtatatgaagaaaactggctttagtctaagaaaaaattttatccaaggtggaataaaagctagtttagaaaagtaatctgacaattcggtgcctactaatttgttcctacgtaaaagagaacggaacaagaaccggtagtttgcgagcattaactgaaaattaaccatgatgcctgaatttggcatgatgatcaattttttggttaagcggaaccaactgacttttggctcaattgaagtcaaaaaaacaaaataaaaacgattcatgaggaagtttcacctcatggatcgttttttttgtttagagacttttgtcacagcccttatttttacattagttagtttattttttgacgcgattattaacttcgcgggcattgccaaatgagacggtaataattcggctacgcattccccatacgtagaaaatgaacgccgctataatgatcacaataaagtcgaaggggtagtgaattaagtttttaccgttaaaatcggcgctaccaatgtaggacatgattgaaagaaaaattagatacacaattagccaaagactactacgcaactggttaatggtttctttccaatgtaaacgccactcgtaatatatgaaaattggtaagccaagtaaaataactaggataacttctaccgtagtgggccacattgcccagtaaatagctaaggaagctaagatgaaggctaacggagccatgaatttaattgcttttaaccggacgggccggttgaaacgcgaggccatctttcttaacgaaaccaccgtaatcgggcccgttaggtaagcgattaaggttgaagttgagatgacacttgctaaagtaccccatgacctaaaaatcgaaaccattaccatacttaaaacggcattgaaagccattgcgatccgtggaattccatacttagcattgatcttccctaaaattttaggaaaatggttattactcgacatggcggctaaggcccgtcccgttgaagcaacgaaggaaactccggtaccaaatggtgaaatgaaggcgtccaggtaaagtaggacggacaaccagtgaatccctaggaggattgctaaatcggcaaagggagattcaaaattaatcccgtgccaacctgatttagcgatcaatgaacttggaattgaagtaatgtaggtgctttgtaaaactaagtaaagtacggcactaatcaaaagggagatccccacacccaagccaacgtttcttttagggttcttaacttcattacccatattaattaccgtctgaaaggcattgaaggaaaaaataattccagaagccgaggtggcagcaaagattgaagccgatccgtacggcataaactcagttaaagaatggccgtaattttctggatgaaaaccgcttaacgttaaaaagatgatggtgattaagggcacggcaattttaaagattgaaattaaacttgtaaacctagttaataaagataccgaccagtaatttaagagggtaaagattaaaatgaaacaaaatactactaacaaaccactagtcgtgatggtcccatttttgaaaaagtgatgggtccaattagcccaagcccacggccaggtactcatgtattggaccgaggcaacggcttcaatgggaattaaggtaattaaagaaatccagttggcccaagaggcaatgaagcccaccagcgaaccgtggctgtattgggcaaatttactcattcctccggattcgggaaacatggtgcctagttcgatatagttgtaggcaatcacagcaatcacgataaacccaattatccaagaaaagattgctgccggacctgccaccgaagcagcctccattgatccgaaaagccacccggaaccaattagagaaccaagtccgagcattactagctgaaaaagatttagttttttaataaaaaatacgctccttaatttttgattgataaggaaaatgttaacgtatttgtaggtataaatcaaattggtataggttgcgcttgctacggtataaaaagattttcttaccggattggttgaatttgaaggttagttgctaacctagctgttaatttagcatggtctttttaacgttaggaaagcccagccatgaacaggggagaggttaattttagtgattcggtgaaaaagataagttttgtaaggaaggtaccaaactcaacggttaaaaattatgaacttaagaaactataaagaataatgcaccctagtttttggctcaggattggtgttagacttcaagtgaaattgcacactaaaattaggaggggcattttggataacgataaagattttattatgaaacaggtgaagtcgtttgccgaaggactgggatatgtgcttggaaagaaaaggaacggagatatcgaggtggtttttcagcaagaaaatcagcaaaagaataagtttttagccgaaatagagcagtatcttgagaagaaaaaatatcgtgaggcgattcaatctttttttaaattaaaatatgaactcgaaccaggagagtacctaaaaattggaaaccaactcttagataaattaaaagctcgactagctgatgaagacgagcaggttttactcttggaaagaagtttgaaaaattttaaggagcggtggttgggaaaatagtgctcatttgcgaatcccgctttatcagaataagttatgttgttgagcataacggggggttccttatgaactgtacagagatgaaaaaatattgtactaaaagcaaaaaatgaaagcgttgacaaaacaaaattagaaatgataatattaagaagttaaagaattaaatatagaaaaaagcttaaaagagtacgtaacttttctttgagtaatgtgaccgaacaaagggcaggactcaggcaagacacgttttagccaattaatggcttagcgtgttttgcctgagtttttttctagaaaggagcaggaatgaaagtaaaaaagatactaaataacaacgttgccattatatctaaaggtactcatgaatcaattgcatattctccaggaattgctttcaagaaaaaagttggacagcaaatcgaggaaaaagagattagtaaactgtatgttctagattcaaaagaccgtttagaacatcttagttttttattaacccattctgataaaaaaatcattgctttggttaatagaatcgttgattacggtgaaaattacctaaaagttaaggtgactgattatttgtatttagcattattagatcatatttcgtttgcgttaaaacgaagtcaaaaaggacagtttattgcaagtccgctggtatgggaagtaaagaaattttatccccaatattacgaaattggaataaaggcaattaactggcttaatcaggcttatgaggttgattttccagaagacgaagcaattccaattagtttgcactttattaatgttcaagatgaacagaacaatgtcgaacaaaaggttaaagacattacggtactgagagatttactaaatataattaaataccattttaatatgaattttgatgaaagcagtatcaactacctgcgcttggtcacgcatttacagtattttattgaccgtttaaattgccacgaactgtccacgaaaatcgacgtaaacgttttatatgaacaaataagggaaatttatcctgaagcgtttcgagtggtacaaaaaattgataattacattagtaaaagtttcgggcagaaaatttcttctgatgaatatacctatttgatgatccatattaaccgagttacaagcagaaaggacgttggaaatgaagtataaagagtttaatgaaaatattatcaagtacgtcggtggaaaagaaaatatccaggcggtagtccattgcatgacaagactgcggtttacactcaaagatcgtaataaagcaaatacggcagcactcaaggatttagatggggtaattgacgtagttagtaacaacgtggcttaccagattattattgggactcacgtagtggatgtgtacgatgaattaatcgatttgttgggaatcagtggtaacgataaagaagaagtacataaggtaaaaaagaactggattaaagcagtgttggatgtggtttcagaatccatgacgccaattttagaaccgattatttgtgcaggtttgttggcagcctttttatcgatcatctcgcttacggggttaatttcaccaaatagtcctacttaccagatctttgacgcattgcgggtttcggtattttacttcttaccaatcttaatggcaatgagtagcgccaaacgtttaggtgccagcccgtacttggcggttgcgttagccgcaacaattttatcggagagtatcaacggagtaaaggggcttaatttatttggaatcccgttgccccaaattacgtacgcaaatagttttattccgattctcttagcagtttggtttatggggtacgtaaccaaatttgtgaaacgaatagttcccaacgctttacagtattttatgactccgctacttatcatgctaataactttaccggcgacgctactagtttttggcccgttgggttattacctaggtgaaggaattattgccttctttaatctattaatgaagtatgttggtagctggtttgtaatgatgctttattcagcgttacaaccgttcatcgtcatgttaggagcgggtaactttatcatgccagtggttgcctccttaatttcggctaacggttacgatcctgcatttatttcttcatgtaccatctcagatattgcagttggtggctcaatgttaggatactttttgagaacccgtaaccgtaagcaaaagcaactatttggaacggtgaccctatccgcaattctaggggttacggaacctgccatctatggtgtctttgttaaatatcgtcggcctttcattgccgttatgattggcggaggcttaggaggcttatttgccggtcttactggtgtaaaagcatattcaattgcttggggattatttggtttgccagcttacattggtaaaggacatttcatgaacttatggttgatggttgcttccgttattattagctttgttggtgcggcaattgcagcattcttactaggtgtgcctgctgaagattccgcagaagatgaagctggaaatgttgataatgcggttgcttcaaaattacaaacggtatctttgagtagtgtagtgaagggagatttagtccagctagccgaagttggcgatgccgcgttttctacgggatccatgggtaaaggaattggcattaagcccactgacgaccacatctatgcaccaattgatggaaaggtaactgcggtttttccgactaaacacgcaattgggattaccggaagcaacggaattgagaccttgattcacatcggaattgacactgttgaattagaggggaaatatttcacgctccaagtaaaagaaggggaaaccgtttcccggggggatgttttagcggtcgtagatttttccaaagtggtcgaggctggatatgatccgaccgtgatggtgattattactaacacgaacgactttttagacgtaattcccagtgttaatcaaattgtaactgacaaagatcagatgctaaacgtagtgctcggataaggaggaagtaatgaaatttccagataactttttatggggcggaagtattgctgcccaccaaacggaaggagcttggaacgaagacggtaaggggccagcaattatggactacgtaacggttggtgagtatgggcaaccaagaaagatccaccagacaattgatccagaatgtcggtacccatcccatattggaattgatttttatcaccggtatctagatgatgttaaactctttgcgcagatggggtttaaggcacttcgaatttcaattgattggagtagaatttatccaaatggcgacgacttagagcctaatctaaaaggaattgaattttatataaatttagttgacgagttaaaaaggtatcatatcgagcctatcgtaactctatatcattttgaaatgccaattaatctggttaaaaaatatggttcttggcaaaatcgctcggttgttgagttatatctcaaattttgcaagacgatgtttacagcgttgcgcgggaaagttaaatattgggttacctttaatgagatgaatcatattgatccacaaacggaggctagcgacatctttacgtatataatcgctggcttgaaatattccgaaatgaaagataaaccgcaaacgttggcaaccattggctacaacatgaccttagctagttgtaaagcagtccggttaggacatgaaattgatgcttccaataaaattggctgcgtattcggaattgaacccgtttacccaattaacagcgatccggaaaatgtaatgaacgcctttagacaaatggaccgtgatttttatcaaattgatgcaatgtgtaacggcgagtttccgcagtacaaactagcagagtatgaagatgacgggattcatttggcggtttcaaaaaatgattccgctgattttaaacaaggaaaaatcgattttatcggaatgaattactatgcctcatcggtggccgaatatcatggggcaaaggaagcaaaaagtacactttttggcggtttaactaatccttttttggaaacgagcaagtggggctggacaattgaccccgtgggaattcgatacttattaaattatacgtatcgaaagtatggaatcccaattatgattactgaaaacggactaggtgcggaggatcgattggatgataatggaaaaatccatgatgactaccgaattgattatttacgtaaacatgttcaagaagtcaaaaaggcagtagaaattgaccaggtaaattgttttggctacttaacttggggtccaattgatcttgttagtgcgacaaccggccaaatgagtaaacgatatgggttcatctacgttgatctggatgactccggacgcggaacattgcaacgattgaaaaaagattcgtttgcttggtacaaaaaggtgattaaatctaacggaaaagatttataaaatattttataatttggaaggctagaagaaaaaatacttttcaaggatgaaaagatccttaaaaagttgttttgatattttgccttcaataaagccaaaacgtgtgccaaaagtcagttggttccgcttacccaaaaattgaccatgatgccaaattcaggcatcatggtcaattttcagttaatgctcgcaaactacccgacttttgtcccactctctttttcaaatcaatatctgaattcccttagatctcaaattttctaagcattctgccaaatattgttggtcatgttcgggatagatcgggtcggtgagcggacaaggtgccaatgctaaataagctgggcaatgcaacccccggtaagtggggtcgaaccatttagggtcaggatgatatccccgcacctgcatttcagccatcactaacaaatgaaattggtacaacttgtatggcgaatgggtaaaaacgtaatcgacggtggcgtgctttttatcccagcccttgccgcggagcgccgcgacttcccggtgctgacctaaaagctgggcccgaggcagtttggaaattaatttctcgtgccataaacgcatgaactcggcctcctgtattaatttagtttaagaatagcttaatcaaagaataaatggaattaacttgactgaggaatttttacttaagctgtaatgctcgaacccggttaagctaaagatgtatttttcaagtcgaatatggtataaatagctacaaaaatcgcaaaccctgactattttggaatagataactcactaattaggagaaaaagcctcttaagtggtgggcgctagctcagtacgtgcaatttgaatttaactttttttggggggtaaaaaatgaaaacgtttttgacagcgtcgtctttgaacaaggtgattttactagattatttattagaaagtactacgtggcgctcaagcaaagagcttgcaaaggtaatcggtgtaacggaaaagtcgattttaaattaccttgaagaattccagcaattatttaaggaaaccgggcaaaaaattcagctgtttaacgatcataataagaattttcaaatcgtaaaggaggaggatttccccatttacaccctatatttgaagttttatcaatcttcttataattataagttgattgacttcatgtatcatcatccgcaccagcggttaaccgattatgcggaaagtcagtttacaagcttatcaacggttttccgctatgccaagctattaaaaccttactttaaacgttatcagttagaatttttgccgtaccgtctggaattaaagggcagtgaaactaacattcgaagcttctactattatttttattggaattcaacccgggagatcgcagatgattggccgtttagtactgaattgtcggcaatcgaaacggtcattactgacttcgaaaaggtgtatgcggttactttagaaccgcttcaacgtaaaacttttgcttattggttagcgattacgttagaaagaagtaaagttgttattgcaacgacggacgcaacgaagcaaagggtgattgatagcgatccgactttcaaattaatgcaaaaatggcataaaatatgcaatctgccgttaagcagagatgagttgtattttctatatcaagtgatatatgatttcgggattattgatggtaatccgaattatgaaaacagctatgcgttagctcaccagcaaaatcagacggactcctacctggccgtaatgaatttggctagggtggttaaagaaaattttgagtttcaattggcaactgacgatttagaattaatgtttaattttattgcttttcacgaacggagcgccttttttaacggtaattccgacgtgttttttaaccgttcttacattatggaattaaaagcggagcgcccaagggagtttcaaataatgcaggaacttcgtaaacatcttttaaaacgtgcgcagccatcagttaaggctttactaactaattggcagcaactatttctaaactattattttatcttagattattacgacctcttcgctaaaaaagttacgcctatcaaaattttagtgcaggatgatttgcatcacacccaccgattgtggttgatgaataaggtgcgtacttactttggtcattcctttgcgtttgagttttacgattaccaaacacccattgcagaagtagatttagtgatctctaactactacattgatactggaaatacaccattaatcttaatgaaaaatttgcccacggaacgtaactggcgacaactaggagcaatgctttatcaattaaccaagtagcccccagggcaaattatttttggaaattataactcgaatagttaaagaaccgctccagaagctaagtattctggggaggttctttttagttgaaaaaccttttaatttttttctgaatcaggaaaaaagttggactagtaactaaaaaaggggcgtgcgagaatgtttttaaatcgatgaggttgattaaatttaaggaggaagtattcaatgaacaagaaagcaatgatcacaagccttgcattaggaatgttagttttaaatgcgtccacggtaatggcgtcccagatttccgaggcaactaataaaacggacgtgaccttgaccgctggttctggtaaggatattcatccagtcgtccccgatgatacccatgatgatgattctggaaccggtgacgtgggttcgctatccattccgtacgcttcaaacattacgtttggacaacaggaaattaaggcagaagatacggactattatgcattaaacaaaaaacctcacgtgcaggttaacgacacccacggaggtgcgaagggttggagtttgggagtagcaatttcacctttcgtaggtgccaacggaaaagaattagtgggggccaagatgtcccttacgaatggaaaggtagtaactaaaaacaaccaatctccgatgccgaaaatcactcaaaatacttttgaattaaataaggaatatcaagaggtaatgacggctaaggaaggccagggagccggagcatttgcggccgtatttgaaggaaaagatggagaaaatgagaatgtcaaacttcacgtaccgcgtgctggtgtagaagcacaaagttattctgctgatttaacttgggtgttgaccgatgcaccatcttaaaccaattaaacaaagcccaaaactgtattttcttagctttattctggtttacgtatcctgcattttactagcgctaacttttccccatgccgtagctgcgaacacaaaagcaaataaccgggtaacctttgatgcggaggcaattttaccgaagaatcagcaatctgatgccagttattacgatttgcgggtgcacccgggaaataatgagcgactatttattaggttgcgcaatctcactaacgaaaagcaaaccgttattattaaaacaaataacgcggttactaaccggaatggcgcgattgattattccaagtctaagactaagttactaggaggtccgactttcaaacaaatgatttcgggaccgcagaccgttacgctgaaccctaaggaagtgcgtaaagttgactatcatttaaagatcccctcaaaaggattcgaaggtacggtgctgggcggcttttattgttacgcaaagtctccgaaacgaaccactaagcaacaaagtttaagcctaataaataattttgcttataccatcggtgcaaagctgagatgttcaaatagtcaagtgcgacccaagttgtcattagaaaaggttactccaggattagacaacggttacttgacggtgtttgcaactttacaaaattcagcgccgacgttgctgagtaaattacacatgcgggctaccgtaacccaaaaaggacatcgtaaggtgctaaaggaaactaaccagcaaatttcgattgctccacgagtgcgttttcggttgccaattagctgggacaaccagcccttaaaaagcgggaaatatgttttaacgattgttctaaaaagtgccgctggtaagaaatggcaattcagtaaagaatttacaattacgggtgccgataccaaattaaaccaaaaggcggtggaagttaaaaagcctattaataaccggttgatttacctaatcataggacttttaattgcagtgattttacttctgagtggttatatttatcggatgaaacggaaagatagtaaaacggagaaataaaatgaaattttggggtgggttagttttattaacattactatttaacgtagagggggtggtgctggccaacgagcgcaccaatagtgaagtaggcattaccttttatcaaaaaacgaccgcaaatcaagtagtaccgatgcaaaaggtttcccaaccaaatcaggattatctaaagcggcctcctgcaaaaaatcctcgatttcaacttttaccgcaaactaacgaaaaaataggtttaggactgatttgggcaggaattggtttgatttgttgcgttgtagcaagcaaagcgtaccaaaaatttttaaaaggcaagggggatgacgaatgaaaaaagttccaagtttaatattagcaacttttctcataagcttctggtggctaacagccagcgcgaaggctagtctaaggccattgcccactttcgaaaattttcagtgggctaatcaaacggtcaccccggctgataatacctttataatgcataacggtgcacatacggtggtgactcccttgaacggagatgcaactgtaaatcggttagtggttgatcaaaaaactaacgaaagccgagcgctggtaaaaaacgttggttttcacaaaggtaagtcggtaaatctattggttacgttaaaacgaaacaaaagtaatttaaaaggaggttcgttgagtttttctaagacttatttcctaggtattgacgtcgatggtgaagtaaaggtgacctataattttgttgatgagcacgataatcccttaactattaaaacggcctttaattattatgggctcaatacaaataaatatattggataccaaaatcccgattccgtcattagtgcgatttacgcgaataacccaaccaacattatgtatgacacagaagaccagtggatgtatttgaagaatattaccgctggcgttccgtggcgagacccgcgtcaaagttttgaagtggttactaaggcaatctcgcaagttacttttgtggtgcataataacgatagtacaacctcgtcactagtttatttaactgaatttttagcgaagcctgaactcgctcctgcttacgctgtagacgctaaatttggtcaagctgaccgggatgtctatctggctgcacaacaaacgattcctaatagcagcaacttggaaaccgagataagttttaatttggcccaggtgcacgacggtgagcagtatgtaccagaacgtgtggtagtcactaattttaatggtgaggacgtaaccaaatactttaccagtcaaattgaggaccaaaaagttcagattaaaaccaaaggatcttctgctgatcaaataagtgatacggcattaaattataaagtatatttgaaatggcagggaaaagaaaagccagttgatcctaaaaaagtgattgatggtaaattaacgcttccatttgacgtaaccaccaccataaatggtcaatccgtcggtaaaagcggagcagtaacggcggttaattacattggtaaagtaacgaccatgtttttaaacgaagatgatgaaaaaatccacgacgcccaagtaaaaagcgggatcttgacgaccaattttgatttggctggcaactatccggaaattaaaggatattttccacttaaaaatgatcctaagaaggataagggaatttttctgcctagcgcccaaacaatcgttcaccgataccgaaagggccaagagcttaaatttaaactaaaggatgccggcacagaacttcatatttctcgtttcactaacaaaggtagacttgcattctcctttacgcacgaagacagccagccggtaaagttaatcgccagttatgatggagaaaaacgagtgctaaaggattatgttaacgtcgcctcctcagttaaggatgaagtcgagtggcaatgccccaaaaactggatagataaaaaagtgagtttttacattgaagatgaccatcaccaatcatcaaacaaggaagaccgggtagttagattagaatccggtccgcaactaaccttaccatatgaaattaactttggtactcacgaaattcccggagaaaagagtaccgttccgctagccaccaaagcaattttacgaattaaggatcgacgtaaaattgaccaaggtcgctggactttaaaggttcgcgaacgtcatccccttactaatcaagatggccaagtgctttctcggcggcttctttatcagggtacgccaattaacaaagatgaacagattatttatcaaactactggagacgccaccttagatctaagcaaactcctcaaattacaacttaaccctgcggatcaaatcggtgactatcaagggggactcgggtggaccatcgaggatgcgcctaattaagaagtcgatcatcttaacctcgtgaatttcaagcaggggttaagacccctaagtattattaaccggaaaatgtcttatataaatattaccaactgttagactgggaactcgccatttgcgggttcctttttaaattccctatcctttaatatggaaaattcgtaaaaagaagagaatcataaaaccgttttgcacttaaagtaggggtaacggaaatgtcaatacgcatgatattttaggagggcattaaaatgaaaaaaatcactttagcggcggccatgttaattacgctgtcatcgttaggaattgcgggcggtgccaaggcagcaatagtcacggggcctactgatgcaaacattacggttagtgaaggtaactctgcaattgaattaagcggcgttaaggatattgcttttgattttaataacatcactaaggaaaccagaacttttaaagagaccgagccgattaacgccgacgtcattaataaaactttcggcgaaaaagagtatacactatctgtcgaaaagaacttcgtttccgcggggttggatgctcaacttgttggaagtaaaaaaattggtcaagcgttgaacgacaccgtcaatggtgaccttgtagttaatttggatgctaccaaatataccgttcctggaaaggatcaaagtaatacggtaaaggtagtggtaacggaagcaccagtagaagatccaattgagtagcgaataaatgaaaacgttatcaaaagtaaaaacacacccttttattagggtgtgtttaataatgttaattttattgttggaaatcggtatagctggtctttcggtacatgctgctcaacggaacggttccgctcttaaagtaaccgttcaagctggagagcgatctacttccccaaccgacatccgattttcaccgaaagtaaataaggaatactcgttcatggttaccgttaataacacgagtagtaaagaaatcaacgtagccgtttttccgagtgtcgggattgctactagcggcggaataacttacgtaaaatccacgaaaaatctgttaaatgacaaatatgctttaccaaaatatacgaagataaccccaattggcgataaattaagaaacggtgctttaaaattgcaggctaagcagagtaaaaggcttcgggtggttattaacgtaacacaagaccttcaaggagaacttttaggcggcattaactttgcccaaactattggaaaaagagtgaatcggcagctgattaacgtcgttaaggtttaccaaaaagtggttgtggtccgcttaagaatgcgggatttggttaagcgaaagggactgacctacgcaaactttaaatttgccaatgctaaaggtgccgcgttgctcagttatgatgtattaaataataacccgctgattgcctatgctgaaagtggttcttatcaagtgctaaatcctaagggaagggtgatcgctaagggtaatttggagaaaaataaggttgttttgaccccagttactagaactcagctaaacgtcccccttcttgatggtgccaaattgattccaggaaactataaatttttggtaactagtaacggcaaacaccgggtgtataaattcacctacactaaaaagcaattaaataattttgttaaaaagaacggtaaaccgacacacgtaatgataaagacgagccacgcgggaatgattattttcggagtagctgttttggcaacgttaatcctagtaataacggggttctatgtgagaaagaaaaggacttgacgttttctaaaacgaagaagaccagtggagggcgactaatcgctgatatcggcacatcagtgagtagtcgcctgatttttaaatagcaataaaaaaattaagggtgatttgattatcgaaattgctcaattacatttttagtgtcctaaaaatataaatattgctgaatttaggtagctaaatggactatatttaaacgggtacgtgattgtatgaatacaacaacaggtattgggttgagctaaaatttttgttaaaaggagcttggtttatggatctatggcgatcatttttgtcttcaaaacaggtaagaaagattagacttcttgaacagattatttctaagtcagcggtttctcccgatgatttagcaactaacctcgcaacaactaaccgattaataaaggatctgattgaggaattgaatcttgaacagcaacaattctacaatagttcccaaaagtattatctgtttgaaaaccggatgatcaagttatcgaagcaagtccgggtacggacatacgtcgaattttacctgcatttaaaatcgcaatacgttaaccaaagcgcagtttttaaatttttacggttttttttaaccaaccgaaaagcaggaataataaaattatcccaccattttaactatagccaatcttattgttataaattaattaacaaggctaacagcttattacaacgtttgaattttaagtgtcagatcaataaaaggctaaattatttgttggttgaaggcgacgaaaatcaaatccggatgttaacctatcttttgaaaattaccgcgaaccaaattgataagacgatgacaaccacagttgctgtttcaaccaatcaagcgtggtcgcttagccatcagctaaaaatgcagactttattaaatgtttttgataacgctaacaaaatggggaagcttgctcaaaaagcgtctcgtgaggaattggaggttatgactgctgtttataaagaattacacctaggttttagtaatcactttaattacataagtaaaaatgcttttccaaccgaaaaaatgtttttttacttggcgacaatgtattatttaccggaaagcttaacggctgacttgatgagaaaagtcggtgaacacctgggagaataccgcaataaccagatcatcgttaaagcaaaccagctcttaggtaaactagtagaaaaatataccattcctaaaaaataccatcagcttttcttatttcacattacttatcggttcctcattacgaagcagctgtcgttagaagtactgtttttagcaactaactcaatcagcgatattaacgcaaacgttcggcaaattagcagagacgttcaaatgacttacaaaaatgagctatcggtaggggcacttgaagtttttgggtttcaaattgcagaactactatattcgtacatgagtcatctagtagctgaaccagtgaaaattgccatttattcttcatatagtgccaactacctaatggttttaaaaaacattctgcacggaatctataaaaagaagtccgttttaattgtggaaaaaatagaagacgcagaaattgtaattgccgacagtgcggttaatgtaaatgatcaccaagtccttttttatttcgaagacgtgcaccggattgagacgtggaagaagttagcgatttatattcaaacggtcttgattaagcgaaggacacaattaaatatttaactggttaaaagcggatgttttccgaaagcgccaggactagactcgtccggatttaaaatgtgacggttagcaaaaatgaaaactaaacgtaaccaaatatggatgctgaacgatgagttttctagtacaattaaagcacgcttaaacggaaaatggaggggttttgatggaccaagaacgaattttaattttagtgaagccagacggggttagtttaggacacattggtgaagtgattacccgcctggaacggaaaggctacgaaattgatgcgctcaaagttacccgggctactgatagccaattacagcagcattacgctaaattagttgataaaccattctttaaggaaattgaaacatacatgttggaaggcaaaatcgtggccatgattgctagtggtactcgcgtgattgaagttttccatcggatggcgggggctaccaatccgtccgaagctgccttcggaacgattcggggagatcttggtcgggaatggccagacggactacttcgaaacgttgtgcacagctctgatagcgttgaaagtgccgaacgagaaattaaaatttggttccccgaattaagttaatttggttatccaattaaggcatgtttataagtatttatgaatgaaaaatctagctaactagtggaattatttccggctggttaactagattttttgatttaacttacaaaattggtgaactataatttaatttaatgtaaacacacgacctacgtgcaatatttttatagtcccttggtgaaaatacaaaccacctttttacaacataataatataaaaatctgctatcagtaatagataagtctattaatagcagattttgtaggattaaattattattaataagtaaaccgtagcattgaagttaattaaatattaggattttttatcaagttaaacgcacttagtactttgaagtttcatcatcagtgattaagatacgttgtgcaattccctcactcattaccatgtctgttagcatattaccacgtagcgcacccagagcagcgctagtcttgaacttactgtgtacaattcctagacgacgaggtgtagtcaaaatttcatcaattgttattccagtagtcttgtcatttgtttgcgttaaaaagtttccgttaatatcataaggacgagcatatagcattccagcgatgtcttcggcattcacatacggtaaaatttcatttctggctgatttccaagtactaatcgaattaaaggagctaattgttcctaaaccgcagaataaaaagtccattcttctagctgcagccaaagttgcccggattgcgggttcctcaggtaaatgttctctaattgtatcattcacaatatacaaaggaagcggcaaagtaaggtacttagcctcgtaatgtgaagcggcacgttctaccatccttctagatccagcttcagagttgtatttcatattttcaccaatgaattgggtgaaagttaaatcatcacgcagagtatttttgaaatgttcaataaccgaatagaccgtactaccccaagtcattccgactatatgacttttctcaattaatatttgaatcctttccgccgcacattccaagacattattgtagtcttcatctccattgtcgctttctttaactaccgcaacaaaaggtatattaaaacgtttttttagttcttcttctagctgatagtttctttcaataggagcgttaattttgatgcttacaatcccagatgtacgagcttcatctaacgctttagtaattaagtagcggctctcatcgtatttttttgacagttctgtaattgaaagatttgacaaataatagtcgtgagcgatttgagttaatctttttctattagagtaactttttggcattactttatctccttaggttttatgtctatgtacagtaaaagtatagcattttttatgctttcttttaaaaaatcaaaaaccttttacacgttttttgcatattttttaaatgttttttaaaaattcaaaaaataatataatattttaaaaaatttaaaaaagtgatattctgtaagtgaaaataaaataaaaagggtgggacttatggataagcaagaaattattgaattacataagaaacaaaccggtgttttagaagttacggctgaattgccagttagaaattcaaatgagcttggtaaggcatatacgccaggagttgctgaattatctagaattatttatgacgatccaaaacaaaaagatgagttgactatcagtgggaaacttgttgcagtggtgacagatggttcagctgttttagggttaggagatatcgggccatcagctggtttgccagttgtagaagggaaagctcttttatataaagagttatcaggtgttaatgctatcccattagcgctaagccaaagttccgttcctgaatttgtgaaaacggttaaaaatattagtaagagttttgcaggaattcatttagaggatattaaagcgccacgttgttttgaaattgaagaacaattaagccagcaactagatattccagtctatcatgacgaccaagaagggacggcgattgttgttttagctggtttgattaatgctgctaaagttgttaacaaggagcttacagacttaaaaattgttattaatggagcaggagcttcggggttagctacagctaagttacttgccactgcgggtcttaaacatgttacattggttgatcaaaaaggcgttattcgggataaacgaactagcttaaaccagtatcagttagatgttgctaagcattttgaagaagttaaacaagggacagatttagcagatgcactagtaaaccaagatgttttcattggtttatcagttggagacattgttaataagcagatgattaaatcaatggctgacaaaccaattatttttgctttggcgaatcccagaccagaagtagatccaaaagttgctagagaggctggtgcagcagtaattgctactggtagttcaacatatccaaatcaagttaataatattttagtttttccagggctttttaaggggttgttagaagaaaagatcaaacattttaaacctcaaatggaaatgcaaattgcagaagctttagcgaatattattagtaatccaactgctgaaaacattgttccaggtgtatttgataaagcagtagttgaaaccgttgtcacagctgttaaaaatagcaaataattccaaaaattggaggcctattatggaagaaaaaatgagttcacaaggcatgttaaaaaaattcttttcgttgcaaattggaattattccaatgccgctttatattttgctaattgtagcttatgtgttattaacatggggtaaccagatgccagacgatatgctgggcgcaattggaattatgactcttttctcatttattttggaagagattggaaaacacattccaatcttaaagtcattgggtggtaaggttttggttgttacctttttaccatcatacttagtatatgaaaactggctacctaaaagcacagttcatgtagttacagattttatgaacaataataatttcttggcattctttattgcactattgattgttggtagtatcagtgccatgaatcgaaagaccttaataaaagcaagcactagaattatcgttgtgttattgatttgtgagttagttggccctctgcttggaatcgcggtggggagcttgttaggcttatctatttggaaaagttatttttacgtagttgccccaattatggctggcggggttggtgaaggagctttacctctatctttaggatatgcagctattatttctatggcacaacctaaaatttttgcgatgattttgccttgtgttatgctaggaagtttagtagcagttattttgtctggtattttgaaaaaaatgggagatattcaccctgaatggactggaaatggacgtctagtcgaagctgatgacggccaatccgatttaggcaacttgacccaaaaatctagcggtgcagatattgaaaagatgttagtttcaggaattttagctatttcactttatttattaggggtatgggttaatagtgtgattcatttgccagctccaattgttttattgattgtagtgatgattgctaaaatgttagggtggattcctgaaagtttgcaagaaggcgggaagtctctttatagtttaacagttaaaggaattacacctccacttttgttcggagttggtattgcaatgactccctgggaatcattagttacggtattcaccaatattcctatgttaattactattgtagttacagttactgggattgtttgtgccgcatttttcagcgccaaaatgttaggtatgtatccagtcgataccgccattgcagtttcatgttgtagtggtcagggtggtactggcgcgcttgctattctagcagctggcgatcgaatggaactaatgccattcgctcaagttgctgttcgtttaggtggagcaattacagttacattatcgattttcttgatgcgtttatttgtttaaaggagctacgaaatggcttatgaggggaaagtaaagcgaattaatttgcaagatgctagtaatcgaaaaaaatgggaaaatttgttatcggagtttgatattacaattcctgataaacaaactttacttcaaatatcatgttttggtatctttgaaaagcaacgattaattgctacgggctctttccacaacaatgttttaaagtacattgctgtagatcctacttgtcaggatggaaaattatttaatttaattttgtcaacgctaattaatgaattggcgcaacgccaaatatttcacgtgtttgtttttacgaaagcgatttatcaaaatggctttgaacatgttggctttaaaactttagcaaaaactgatacggctgttttgctagaaacaggggattatagtgtgcatgattttatcaagacacttcctacaatagaaaaccaatctgacaagcaagtcagtgcgattgtcatgaatgctaacccatttactttaggacatcgttatttggttgaaacagcggctgcccaaagtgatttggtgtatgtttttgtagtcaaacaagacgcatcgctatttaccacaaaaacgcgttttgaactagtttgccaagggttggcagacttaagtaatgttattgttaggttaggagatgaatacatggttagttatatgacttttccatcgtacttcattactggtagtgataatgtcatcaagtatcaaactgctatggatgctcaattatttaagacacagattgccaaaccacttaatatcaaaacacgatatttaggttcagaaccattttcgaaaactacaagtatctacaataaagctttatcagaagttttacctcctgaagttaaagttaagattattccacgaaagcaaattgatggcaatgcaatttcagctacacaggtgcgacgcgcaattaaaaataatgcaattgaacagattaaagattatttaccggccactacttacgaatatattattaatcacttaaatgatttacaaaaactaattaaggaaggttttaaaattgatggaaattaaatcaaccgctattgcgggaacactagaatcgtctgacattcaaattacaatttcaaaaaatgataatggaattgaaattgatttagactccgatgtatcaaaaatatttgggaaacaaattaaaaaggtgataactagtagtttgaattcgttaggaattgaaaatgctaaggttaaagctgttgatcaaggtgctttagattgtgtaattaaggctcggacgtttgccgcagcccaaagagcaactggtacagctgaagaaccagtttgggaggtattctaatgcaagatgaacgattacgtagaacaatgatgtttgttccaggaaataatccagctatggttaaggatgctggaatttatggagcagattcaatcatgtttgacctagaagatgctgtttcgatggcagaaaaagatgcagcccgtttcttggttgcagaagctataaaaacgcaagattatggtgatgccgaattggtcgtccgtgttaatggccaagacacccctttttaccgtaatgatgttttagcgatggtgaaggctggtatcgaagttattcgtttgccaaaagctgaatcagctgacatgattaaaaaactagaacaagatgttttagaagctgagaagaaatttaatcgtgaaattggaagtactcatctcatggctgctattgaatcagctaaaggagttttgaacgctcccgaaattgcgagtgcatcggaacgtatgattggaattgcaatttcggccgaagattatactaccgatatgaagacccaccgttatccggatggagcagagcttgagtttgctcgcaatatggttctacatgctgcgcgtgctgctggtattgctgcatttgatactgtattctctaacatggatgatacagaaggattttatcgtgaaacacgttatatccatcagcttggattcgatgggaaatcattagttaatccgcgacaaattccaatggttaatgaagtttatgcacctactaaaccagaaatcgaaaaagctaaagatgttatctttgccattgaagaggctcgggctaagggatcaggagtgatttcaataaatggtcaaatggttgataggccagttgttttgagagctcaacgggttatgaaattagctaaagcgtctggattaattgatgaggagggcaattaccttggagaatagagtacaacgtaaagtttcagaagataccttaaataagtataattatcgtccatttaaaacaactgaaattggacatccagacattcaacgtgttgcgcctaaggtgcatgtcactacgggtgacaacaaagtggttgaatcattaagggacgtggttaaaaagactgttcatgatggtatgacaatttcatttcaccatcattttagaaacggggatttcgtttttaaccaagttatggagattattttagatgaaggtattaaagacctaaccctagctccctcttcattaactggtgttatgaatgacgctgtaatcgaagctattaaggccggaacgattacgcatattactagttctggaatgcgggggtctctaggagaatttgtttctcatggcggattaaaaaatcctgttatctttagatcacatggtaatcgtgcacgtgcgattgagcatggtgacattaaaattgatgtggcatttttaggcgtccctaatgctgataggttaggaaatgctaatggaatgaaaggtgatgcagtatttggttcactaggttatgctttgatggacgctcaatatgcagacaaagttgtgttagttacggataatattgttgattatccaaatacaccagcttcaattaagcaaactcaagtagactatgtggttaaggtaaaccaagttggtgatcctgacaagattggatccgatgctactagatttactaaggatcctaaggaattgaagatcgctaaaacagttaatgatgtaattgttaattcaaattatttcaaagagggattttcatttcaaactggttcaggcggagcagctctagcagttactcgctatctaagaaaagcaatgatagataatcaaattacagcttcctttgcattaggcgggattactaaaccaacgactgacttattgaaagaaggtttagtcaagaaagtaatggacgttcaggactttgataagggtgctgctgatgcaatgcaatctgaagaaaaccaacaagaaattgatgcttcgtggtatgccgatcctgataacaagggtgctatggttgaccaacttgacgttgctatcttaagtgcgttagaaattgataccaacttcaatgttaacgttatgagtggttcagacggagttatccgaggagcaattggcgggcatcaagatgctggaacagcgaagctaacaattatttcagctccattggtccgtggtcgaattgcaactgttgtgccacaagtaaccacagttgtaactccaggcgattcaatagatgtattagtaactgaatatggaattgcaattaatcccaagcggaaagatttaataggacaattaagtaatattcctggggtaccagtatattcaattgaagaacttcaaaagatggctgaacataaagttggtacaccagaacctcttgaattcaccgatcgtacagtagctcttattgaataccgtgatggtactttaattgatacaattaaagaagttaaagattaaagtatgataaattagaggctgaataagatggaactgtttaataaaggtgaagtacaatcgattgaagatatcttaaatgatcgtgatgaacgtgtttacgttcaaaatcaacttggccgaaagtacgttgataattctatagtgattattaaactaaatattcctggacctattaaaaataattccaacttgcataaagtgtttgtgagcggggttaatcgcttcttaaaccgggttgataatactaaaataattttaaattggaataaacctgctggtaacacttgttttatcatctcagaattatcagcaaatgatgttaaagaaagagcaattgattttgaaaataatgacgatattggtcgcttcttcgatattgatgtgattgctggtggacaaaacaaatcagtttcgcggacagacttgggtttagaaccacgaaagtgttttgtttgtgggaatttagccaaaaattgtgctcgctcacgcaagcattccgtcaatgaattgcaacaatttatacaacaaaaagtaaccaactttgaggaaaattatggcggaaagtgaaagtgttgtaagcgaaattgctaacgatgcagttaaggcgctgctatatgaagtaagtgtaaatcctaaaccggggcttgtggatccagtgtcgtcaggaccgcatcctgatatggatgtatttacatttatagatagttccatgagtctagaaaattattttttaaaggccgctgacctaggatatagttatcaaggacaactatcagaaatgtttttggaattacgcgaatatggcaaaatagctgaaaaaaaaatgtttgaagcaacttcacaagttaacacgcataagggtgcgatcttttctcttgggatcatgacttgtgcgatggcttattcaaaacaacagaatatggctgtacaagatgtaataaagcagatgttattaggattaacaaatcacgactttactaatttagctaaaaaaaatccagaaaatttaaccgctggtgaaatacaatatttaaggtttggttataagggtatccgcggtgaagcagaagatggctttccgaaagtttttgacgtcggatttccgttcctatgtagagcaacggggacaaagaaccaaaaactgattgatacgttgctaaaattaatttctattaatgaagattcgaatttggtaaagcgtgctgataatgatttaaatattatcaattgggcacgtacagaagctattgacgtattaaatagtggtggtagtaaaactaaattagggatgcaaaagttatacaaaatgaatcagaaatttttagatcataatcttagtttaggtggcactgctgatcttttgattttgactatttttataggattaagaaataaaactttgtaaataaattttctatagatttttatgtacaattttattgtgattgtaagtttattttatatagacaatataatgaccacacctaagataggtgtggtcatttttttaagaaaagtaatttactgtttaaaatgactttttcgatagtcaatatagtttcctaaacaaaattctttgtaaatcaacactaatgaatcgaaggtaaaattatggaaagccaaccccagccatcaactagcttcttcatgatcaatgattactgctgtagttacgtccccaattacgttggccacggtgcgaaacatgcctacaaaccagtctatactagcgaatagcgcgatactttccgctggcaaatggagggtggttaccgcaatggtcagcgccatgattccgccaccgggtaccgtaatcgttcccacgcataggagtactgccaaaagaataaattcggctaatttaggggtagtgagggggaggtggtagatttgggcaatggcggtgcaaactaaagcgagatacattgctagaccgttactatttaaaaccatccctaacggtaaaactaattcgctgactgatttactgacgccaagccggtgctgaacatccatcaactcaaccggaagggtaactgctgaagaagtagtggtaaacgccacgagcagtatgcgggtgagccccttgaacaatttagcaagcgggatttgcgtgcgcaaaatggtgagtaacgttaagaatactaaaaatacaacgacaccgctcccatataaaaacaaaaagtaaagcagcggtaatagtagagtgattccgtgaatggcagtagttttaaccatcagacaagcaattcctaatggggcaattcgcataatcaaggtgatcaattggataattaaatcatttagttgggtaaccaaggtaagcaattggtcataatggtgctggcgattgctatagcttagcagggcacccagaaaaattgcaaaaataataatttggccaacgtttccctgggcaaaagcgctaaaaatattttgcggaactaaattaagtagagttttttgccaatttacgggcgatgtagactgaactgcgggtagggaactatccgcaggcaatttggcatgcaccaagaaacctagaccgattccgattatcccggcaaagaaggtggtcgtcgagaaccaaaataatatttttgcaccgacttttttaaggttagcagcgacaaggtgaccaagtgcgttaaccacgctgcagaagaccaaggggacgatcgtcatttggaggagatttaagaaaagctcaccaccaatatttaagaaggacagttggcgaccaaaacttaaccccaaaaggcttcccactagcgtacccataaagattaacaaggtgaatgacggagcaaattttcgagttagtaaacgttgtgccaaatgaccaccgccttttaattaatttaaatacgcttgctgatataaactctcggttagtacatgaaacccagcttcgagatcagcttggtcagtacattcggtaaaagtgtgactaatgccagctttactgggaacgaaaatcatggcggttggtacagatgaacccatgatttgactatcgtgccccgctccagaatctagaatcatcgtggaataatttaaatggtgggcaacggtttgatttaagcgtagtaagttggaagctaatttaacgggtttggttttcgatgagtaatcaatttttagtttgatttcggaatctgttcgctgggcggccgccttatgaagaagtcggtcaaagtattttaagcgctcttcgttgggatgacggaagtctacgctgaactgcacttcttcaggaattacgttggcaacgttaggaaaggttacgaaatggccgatcgtaaagcgaaagtccgggcctaatttagtggcaaattgattaaactggttaattaactcaagagcagcttgaaaagcatcgtgccgaaatttgggaggggtagttcccgcgtggttagcctgtccaattaatgtaaatagcaaccgccgctggcctacaatccggttaactaatccgatttgacggtgagtggcttctaaaatgggaccttgctcaatgtgcaattcggtgaaggtagctggaagggcaggttgttgatggttaacttgcggtaatgctagtaaactttgaacggcattttgccgcgcctcgttaaaatcaatgccgttagcatcgaccaaattatttaagcgtgccttttggacgtagtaccttgagccgctaaaagtggttggaaaccgactcccttcctcttcgctaaatgaaatcgcgcgtaaagaaagctggggctgtccgtagcgttgtttaagcttgattaaggcatttattccggctaaaacgccatatagcccatcaaaaatccccccatctttgaccgtgtcaatgtgcgaacccgtcgccactacctttgcgtcgtcttttccaactaaatcagcatagacgttaccatagtcatcaacactgacggttaatccgcccgccagagcccattggatgagctgttgctgggcggttgtccatgctggactatagactaatcgattttgcttaggaaaagtgggtgaagcgtgggcgattaattgcaattggtcatttaaatcagggatgtctttcattgcttactaattccttgcaacggggaagaagcaacggctttatggttaaccactcgacctaatcctgccaagtaggctttccgaccggcttcgattcccatccgaaatgcttctgccattaatggaatatcttctgcggtagcaattgcggtattggccattaccgcatccgcacccatttccattgcttccgcagcctgactaggactgccaatgccagcatccacaatgatggggagttcgatttcatcgattaaaatttggattaagtttttattggctaatcctaaatttgagccaatcggggaagctagcggcatgacggtggccgctcccgcatccaccagttgttttgcggtgtttaagtcaggaagcatgtatggaagaacaatgaacccttctttagcaagaattttagttgcctttaccgtttcttggttgtcaggcagcagatattttttatcaggaattacttctaatttaatgaaattgctaccgctaagttcccgagctaagtgggcaattcgaacggcttcttctgcattagtcgacccggaggtgtttggcaaaatggttatgtgttcgggcagataatttaggatgtcttccgtagtctccgtggttcgccgaagggccatggtaataatttccgcgtgggcgttctttacggccgccttgattaagttataattatattttcctgaacctaaaataaaacgtgagttaaactgctggtccttgatggttaacagatcgttattaaatgtcattggtttagttcctttcttaatttaatcggcttggttacccaagattaagcgaacaatttggttggcctggtgcccggctgccaccatgacacgcggcgccattaacccttcttgcccactagagactccatcgccggcgacgtaaacgtgttggttaatttgcttagttttaatctggtttgcgggatgaattccggccattccactagccatcactaacggcttttgaggaaataggcgactgcattcacgtaaaagcaaggctttagctgccgggtcgtcaaaagcttcgcaaattacgtcggcatccgcaaataagtccgcaacgttagctgcattaaccgtcacttgtaaaggcgtcacggaaatgaaggggttgaattcctcaatattttgcttaagggcgactactttagccattccaatctggtttaatttatactgttggcgatttaagttacttaattccacttgatcaaaatcaaccaaggttagatgaccaattccgatccgtgctaaggcaattgcaatgttagagcccaaaccaccagcacccgcgatggtaacttttgacgagcttaaaggtagcgcagaatgagctacgtttcgactagtcatctgagtttgcaggtcggtaatggaatgtccataaagttggagttgtttttctttaaaattactcatttaacctcctcccacgaatgcaattatttctaaatggtctgctggttgaataatggtagtgttcatttgttggctggtaataatttcgccgttcaattcaaccgcgagattgtcaattttagtgtatttagtcttcaagaaggctaataaattttgagcgtccgctgcttgattttcttctccgttaacgattgccatgcaaaaaccccctttcttatggatacaaccaaagaaagggggtacgcaattatgggtggcgtaattcaccaaaagtgagttacagaattatgcgattgcggtattcggtcttccttcggtagtacgaactacatcaggttcaatgggtatgatctcagccaaaaatggcaccccagacgaactttaaagttttgatttatgtggtaaaattattaccacatatattgtaaacgctatcataaagaaagtcaaaactaaattgaggtggatcaaatgttagaaaagccattactttacctcgtcacggaccggttagggctaaatcaacaacaatttttagaaaggattgagttggcttgccaaggaggggttgatttactccagctacgggaaaaagaaatcagcagtgctgaatactataaattggcgggtcatgtaaaaatgattaccgaccgttaccaagtcccgttaataatcgatgaccaggtagcgattgcgcaagctgtcgatgctgcgggtgttcatcttggacaagctgatttaccagtggcggtagcacggcgaatcttagggcccagcaagattattggagcgactactaaaacagttgcgcaagcacaacgcgcggttgaagaaggggctaactatttgggagtgggagcaatttttcccactacaacccacgttaaaaccgtgcacactagtgttgcaatgctaaaacgaattaagcaggaagcaaaaataacggtttttgcaattggcggcctaaatgcggaaaatctgtccgttttgcggaatacgaacgtcgacggagttgcagtagtttcggcaatcatgaaggctacgcaaccgcagcaaacagctcagcaattaaaatctacggttatagatgttcttagttaagctgggaattgctttgatggctagtgattttttctggacccgattaacggaggaaataataatggaaaaactttatcgcgtgttaagctatggcaatcaatatttaaaaattgacgttggcaaaccaactttctttgctcatggtgtggaagtaaaagctaaggttaataaggaaactggtgaagtgactctttttatttctcaggaggatttaaaaaaattagggtgagcattgaaaaagtgagcgtgaggaaatggtctttaaaaagtgggcaatcaaattagaatatttattactgttagcggttttgggagtcattttttgttaaagctagggtaagcctgctttttttactggcgacatttttaatatttgacgtgggggctttaggcaacctgatttccccaaaggtgggtaattatttatataatctagcccatacatttacgttgccactgattttatcatgcagctacttggctggagaaaatgtcttaggaaaaatgacgttaccaattatactagtatggttaattcacattacaattgatcgattattgggttggaaactaatgccgcgataataaaaaggaaacttcaaaattaaagttatcccactttaattttgaagttttttaaatagattgaaataaaagcgcccttaaattgcgggacctagtacacccagatcattttattactttaagacctcgatagagcacgcttgttgaaggcggtgctaataatcggggcggaatgctaacaacaagttcgtgatttttactgaggaaagttgcatattgagtggggagggtcaaaaatggttggtcaaagaattcgaaaagaacgcgagaaaaggggatggagccaaaatgatttagcgaagttattgcaagttagtcggcaaaccatttcgaagtgggaaacggaaagtgcttatcctgacgtagaacggttaatgcaacttagcgacttgtttgaaattagtttagatgcgttaatccgggatcgggaagtccctgccaaaaaattacgggttcaaagagcccggacggggatgactttttgggattttttaagtaaacgttggtgtctaatttttgtttttacatggtgtttagcgtggttgcttcccatagttattcgggcatttaagtaaatggaggtcgtaaaatgacaaattacttggtagaaactcagcaattaaccaagtcttttaagggacggacggtactatcaaaaatagatttggcaatcccccaaggaaaaatatacggcttattaggaattaacggagcgggaaagtccaccttaatgaaaataattacgggaatcattatcaaatatcaagggaaagttttttatcatggccaccagtgggagcgcaatgacttgcgttcgattggctcattaattgaagaaccagcggcttaccaaaatttaacggctgttcaaaatatgcaaattgtcgctttggaagaacagctaaatttttctacgattgagcgcgtattaaaccagtttggaattgctaacactgggagtcgtaaggtggaagatttttcaatgggaatgaaacaacgcttaggaattgcaatggcaatgttaaaagatccagaacttttaattttggatgaaccttttaacggactcgacccgtacggcattaaagaattgaaaaattatttaaggaaacttgctaggcaggggaagaccattatgatttctagccacatactacccgagttgcaggattttgctgagtacgttggtatcattcacgatggtaaattagtgtaccaaggccaagtttcggaggaacaggatattagtcaaatattttttgctgaaacgaaccagaaaggttagggtaatgctgaatacatttaagtgtgaactacttaaaacaaggtcaagtagtttgttgcatacgacggtggggatgccaatgttatttatgattttaacggtcatggcaatattgtcctcaaaaagtaaaactggtgaaattgacggtttgagttttatccagactgatatatataacctgtgggctacggctttgttgcccattatggtggtaatattggttagcctcgaccaattccagggaagacaggctcatgaactgcagcgttattatgccaacgactggtcaattaataagctttacttagcaaaattaattaagttctgggcactaattttactggcccagttagaagtttgcttggtgacgatgcttagtaatttattaacgactgggaacgtaactcaaatagggactttactaggagtttccatgctcatttggttaggagcgttaccgttaatatcggtaaatacatttctattgcattatgccacccccgttatagctagtattttaaacgtgggattagttattatgagcgtactcctgcaaaatgttttttcgccgtttttcgcgctcaacccatggaattatagtctccgagcgattgctttattacgtattaaccccaataataccatcctagccaaaaacagttggatggcacatgacttaagttttatttggtatattatcgttgcagttttaggatggttattgattgactatctattcattactttgattggcaagcaaaggtggcaaaagagatggaattgtcgttattcaagcttaaataccaaccactattaatgctcataccgttattttttgtctgctatacggcttattttattaaatttaagatcatgtactttccgcaaaaagcagatttttggtttaaaagtagcgaattacttttaaacgcgttaattccctttctaattagcttaatcacggcgattcaatttagttttgaagaacagcgacgtaatttaaatcccgtgctaagtcttccaaaacgcaatacatgggtttctaacgtagctatcttaacggcgatggtttatcttgaaggggcattagtttttggtgttggaatggcttggtttggcaagtttgattattgggataatattgaaatttggttgaacttatatgggcagcctttaatttggataccgattttcacctggattggcatagctttcaattatcgaactggattaattgttggcgcggtcctgatcccctttatgttaaacgttgccagtcaatcgcaaggctccggctggcgttgcttaccatggttttataattttactgtggaaaaaagccctggtccttcaataatgccagcagtcttatccgtagcaggaataacccttttggaacagctggtgttaaattactacgtgaatcatttttgggagaggtgatgagatgcataaccggatggttggaagcattgggggctggttatcaatggcactaatattctgcttactaggcgtccaaactaattcagtcaacgcaatgctgtttgtaatggtacttttagtccctagcttgttgtatcttccaactataattaatagtccgacaagccctccgttatttatcaaggctaatctggtaatgagtgatgttatatatattcttggattaattgcgggttgcgtaaacgtaattcaacatgggaactatttaaattggggacaaattgtatttagcgttactggattaggatgtagtgggatagtttggttagcagttagaaaatgatttagcaatagtaaagagtcttagctgtgagttggtgtgaatcgcgtttctgcatgatgaaaagggtaagaggacttatttaaataagcggtgaactaggggagttggatggctaagtataagagattggcgatagttattatttgcgtcccagaagtatccacgataaaatgaaagcgttcacatatataatgctttaacattaagaaagaagggatcaatatgggacaaaaagatttattaacgttggccgtaattttagggagcttagggccgttggttaacagcgggcacgtattcgctgatgcaaagtcgtcggcagtcgggacggaaaaacttttactggtggctgcgcaaaaaatgcaagttgctagcggacaaaaaaataggtgggtagtaccttaagattagtgatgcaacttttttgatgattagttactaaataataatttaaagagacctatggatgtatactttattagttgagttagtggtgaatgtttttttctccagactcagtttactcagtttctggaccttatttttaagcacttattccaaaattattttcaccatactttatattggacctcctcgagcagcggttagtgctgattggggaggtttttcgtataattcggattattaatgatgaaatatctattttttataagttataaacgaactataaaataaaattaaataaaaatagttcgtaaaacgtgttgattaaagttaactaagttggtacactaaacgtgaaaactaacctagtttttccgtttgaaaggagctgttatgaaaaaagttgcggtagtaatgggatcaatttccgattggccaacgatgaaggaaacggcggcgatgcttgataagtttgaggtggcttatgagcgacacgtaatttcagcgcatcggatgcctagtgaacttcaaaaatttggcaagcaagcccaaaaggatggttatggggtaataattgcgggagctggtggagctgcgcatttaccaggaatgttagcggctaacaccattttgccggtggtgggcgtcccgattgaaagtcatgcgttgcacggcttggactctttattgtcaattgtgcagatgcccagcggagtaccggtagcaaccacggcgattggagaggccggggctaaaaatgcagctttactggcaatcgaaattttagcggttaccgagtcgcggcttgctaaaaaaatgattgaatttcggcaagaacaaacacaggaggtccagaatagtgaaaagcagtggtgaagcgggtgtatacctaccgccagcaacgattggaattattggaggcggccaattaggacagatgatcgcgctggctgccaaggcaatggggtataaggtgggtattttagatccgacccctaactgtccggctggtcaggttagtgattttcaaatcgtggccgcttataacgaccagcaagccctattaaagatggccgaacgtagcgacgttttaacttatgaatttgaaaatgtcgatttagctagcttagaggctgcacaaaagttagcggctcttccgcaagggactaatttactatacgtaactagtgatcgtcttcgcgaaaaacattttcttgctagccacgacctcccggtaacgccttatcaacccgtcagcaatccaaccgagctaaatgacgcgattactaagctagggtacccttgcattttaaaatcttgtgagggcggttatgacggacatggtcagcaagatattaattcggaggccgatttgccagcgggacggagtttagtatcccaaacaccgtgcattttggaaaagcgtcagaaattcagcaaagaattatcggtaatggtgacgcgaagtcgggatggccaggtgcgatgttttccagtagcggaaaatatccatcacaaccatattctccatcaaagcattgtcccagcacgggtaacggaagaggttcagcaaaaagcacaaaaaattgctcggcaaattgcgcaaggtttatgtttacgaggggtattggggattgaattcttcatgttagctgatgaccgtttgttagtgaatgaattagcaccccgtccccataattcgggacattactcaattgaagcctgtaacatttcacaatttgaagcccacgttcgcagtatctgtggacttgaaataccgaaaattacgcaacacgcccccgcagtgatggtcaatttactcgggcaacatttaacattagcccgcaaaaagctaacgcaacggccgaattggcattttcatgattacggcaaagcggaaagtcgggtgaaccggaagatggggcacattaccttgttaggcgaactacaaccaagcttagattcaattcaagcggaaaagatttgggagattagcaatgaagaaaacgacgttaattaaagagggtaaagctaaacgattgtataatacggatgaggcagacgtggtgtgggttgagtacctggatcaggcaacggcgttaaatggtaaacgaaaagaccaagttattggtaagggagctttgaataatcaaatcgattgcatcctttttaaaatgctggatgcaaaagggattcatacggactttattaaaaaaatttccaataccgaacaattaaattacaaagtagacgttattccactagaggtagtcgtacgtaatgcagcagcgggcagttttcagcgaaaatttgcggtgccgtatttacgagagttcgaccagccgattgtggaatttttttataaatccgacgaattggatgatccattcatcaacactaatcaagccgttgctctgaaaattattagttacgcagaaggtgaaatccttgaaaacttagcgctccaaattaaccggttgttaaaggaacggtttcggcaagctcgcttgcaactggtggactttaaggttgaatttggcaaaaccgcagatggaaaaattatgcttgcggacgaaatttcacctgattcctgccggttggtagacctaaccactaagacttccttagataaggacgttttccgcaaaaaaacgggtgatctggtgatggtttatcaagaggtactccggcgtttaataaattcacgggaggaagcgcatgtacaaagttaaagtttacgtaacttataaagaatctattttggatcctcagggagccgccattaaaaaagcgcttcatcatttgaattaccaagaggtccaaaaagtgacggtgggaaaatatttcgaaatccaggtggccgatggcggacaaaacgttaacgaacaagtccaaaaaatgtgtgatgaattattagccaacgttaacatggaaacttaccggtttgagattcaagacgttcaggagggcgaaaaatgatatatagcatccttcgttttccgggctctaattgtgactgggatatgtattacgttttacgagacgtccttaaggtcaccccgcgttttgtggattatcgcgagactgctttaccagctgaaaccggcgccgtcttaattccgggaggcttttcgtacggtgattacctccggagcggcgcaattgctcgtttttcgcccatcatgtccgcggtgaaggaatttgcggaggctggaaatccagtgatcggagtctgcaatggatttcaaattttaaccgaagccgggttattacccggagcattgcggcctaacgagagcttgaattttatttgccgcccccagaaattggttgttgaaaattgccaaacgccgtttacccgccaatttagtttaaagcaaaccgtaacgttccctattgctcacggtgaaggaaactattattgcgatgaaacaactttacaagatttaaaggaacacaaccaaattgttctgcgctacgtaaacaaccctaacggcagtactgataacattgccggaattactaaccaagggggcaacgtccttgggctgatgccccatccggaacgagctagtgaagcagttttaggcgggaccgatggaaaaatattgttccaaagtttagttgctagtatcacgcagcacgtttaataaggggagattttgcgatgacgacggaattaacaccgaccgaaattcgggatcaaaaattatatgttcagtggggactaagcgaagacgaatttaaccagatcaggaacacgttgggtcgactccctaacttcactgaaacaggattatttgctgccatgtggagcgagcattgtgcgtataaaaactctaagccacttttaaaacaacttcccacaacgggtcaacagatattacagggaccgggagaaggtgctggcattgtcgatattggcgacgggcaggcggtagtttttaaagccgaaagtcataatcatcctacggcagtggaaccttatcaaggtgcggcaaccggcgtgggcggcattattcgagacattttttccatgggcgcccgaccaatcgcgttaatggatagtctacattttggtgaagtgactgacgcccggacaaaatacttagtggaccaaaccgtagcgggaattggcgactacggtaattgcatggggatccccacggttggcggagaaacgacttttgatgcgatttaccagaataacccggtgatgaacgccatgtgcgtgggcttgctgaacgtcgctgaccaacagcggggagctgccgctggggtcggcaattcaatctattatgtgggcgctaaaactggtcgagatgggattcagggcgctatttttgcttccactgaatttaatgatgcacagactacacaacggtcggcggtccaggttggggatccgtttgccgaaaaacagttaatggaagcttgcttagaattaattcatgaccatgccgaatggttggtagggattcaagatatgggggcggcgggcttagtttcctcatcaacagaaatgggggccaaagcgggatttgggatgcgcttggatcttgacttggttcctcaacgggaagcagacatgattccctacgaattgatgctttctgaatcccaagaacggatgctgctctgcgttaagcaagggcacgaacgtgaagtagaggaaatttttgcaaaatatgacagcaccgctgtaaaaattggggaggtcaccgaagatcagcgatatcaattggtttttaaaggggccaccgtagccgatgtcccaattcatgcgttagttgatgaagcaccgacttatcatcgaccaagccaaaaaccgcaacgtgtcaagggcgatggaaagcaatttcaaccgcaaattaaggatttgacggcaacttttaatgccatgttgcgtcaagccacgattgctaataaagaagcaatctttgaacgctacgatgcacaggtacaaactaacacgatttcaaccgtccaaagtgacgctgcagtagttcgaatccgcgggacccaaaaagcactcgcaatgactaccgacgcgaatccccgttacttatacttggatccttaccttggcggacaaattgccgttagcgaagccgcccgcaacgtggtggcaacgggaggaaagcctttagcaattaccgattgtctgaattttgggagcccagaagatccagaatgttactacgaattagcccaagccattaatggaatggccgcggcctgcgatgtttttgatactcccgtgatttcgggcaacgtttcactgtacaacgaatttaatcggcaatcaatttaccctacgcccatggtgggcatggtcggaataattgaagatccagcttggataaccaccttagattttaaacaaacgggtgatttgatttatgttttaggcgaaactacggatgccttaaacggtagtgaactccaaaaaatgcaattaggtcacgtggaaggtaaactgttcgactttgatttgcaatacgaaattgaccaacaacgcttagtaagcgacctaattcatgaaggacttttggctagtgcgcacgatttggcagaaggtggattagcgatcgcccttgcagaaagtgccttcgcaggagaaattgggtttaacgtgcaaactgacttagcggccgccgaattatttgctgaaaaccaatcgcgattcctcgtaaccgttacgccagcaaatcgggcgcattttgaagctaaaactgctggcaaagcaacgctattagggcgcgtagggggtgatcggcttaaaatcttaaccactgatgacatgttggacgttgatttaacggcggccgaaactagttggaaggaagcactcgcatggcaactgaattaaagggactcaatgaagaatgcggtatttttggagtttggcaagatccagatgcggctcaacgaacgtatatcggattacacagcttacagcatcgcgggcaagagggggcaggcatcgtaacccgtactcccacgggaaaatttgccatccacaaaggcctaggtcttttagcggacgtattcagtaacccggatgacttaacgaacttaattgggcgcagtgcaattggccatgtccgttatggtacggctggaagccgcggggttgaaaatgttcagccgctgctttttcaatatctacaaggggacgtggcgatggcccataacggaaatttaacaaatgcaattacgctgcgccaccagttagaagagcagggcgcaatttttcaatccaattcggataccgaagttctaatgcacctaattcagcaccaaaagcaggcgagttttagtgaaaaattaaaggctagtttgcgacaaattaagggtgggttcgcgtacctaattcttacggaaaatgctttatacgcagcactggaccccaatggtttccgacctttggtgattggacaattagctaatggcgcattcgtgatcgcaagtgaaacttgtgcgttaacggcggtgggtgccgagtttgttcgggacgtagaacctggcgaactagtccaaattgacgaccagggagttaaaattagccattttacgaccgagactcagctagcaatttgttcgatggaatttatttatttcgcccgtccagattcgaacctttacggggtgaatgtccatctcgcgcgacaacgaatgggtaagcgattagcccaagaaaatccgttagatgtggacattgtcgttggggtacccaattcctcgctatcagcagcggcaggagtggcggagcagttgggagtcccaaatgaaatgggcctgattaaaaatcagtacagcagccgcacgtttattcaacccacccttaagttacgtgaacagggggttgagatgaagttgacagtgttatccgcggtagttgcggggaaaaaggtagccctcgttgacgactcgcttgttcgggggaccaccagcaagtacattataaaaatgttgaaaaaagcgggggctaaagcggtgcatttgatgatcagttcaccaccgttgaaatacccttgcttttacggaattgatatcgaacatactcgtgaattaatggcggcaaacctcacggtaaaggaaatgcgcgttgcaatcggggcggactcgttgcactttttgagcttgcccggtttgattgaagccatcggtttgcaccaagatgtccctaatgatggactttgcgtagcgtactttgatggaaaatatcctacgccgctttacgattacgcggccggttttgaagttcctaaaaccgcaaaagacactacgttatcggcaacgggagtcgcaaaggagaaataataatgaccaaaaatgcttatgaacaagcgggagtaaacattgctgcgggcgaagaaattattgaaggcttaaagcaagcaattggtgaacaaggtccccacattctaaatgggattggcaattttgccggatgttaccaactttccgaagatcaattagacgatccagttttagtggcgggggctgacggagtgggaactaaagtgctgttagctgcccaaactggaaaagtcgaatcgttagggcaagatttggtagcaatgtgcgttaacgatttgttggcacagggcgcattaccgctattctttttagattatttggcgttttcacatttagaaagcgaccaaacagatgcaattttaaaagggattttgaaagcttgccaggcccaatccatcccgttattaggcggagagacggccgagatgccaggactttatcaagaccagcattttgatttagccggctttgcggttggtttaggtgctaaaagagatctcctcagttcagccatggtaagtgaaggggattatttgattggtttaccttcgactggattacacagtaacggttactcattggtgcgtaaaatcctctttacggatcaccattaccaatttgacgactatttgccagggattgcccgtccattaatcgaagaacttttggaaccgacccggttatacggcaacgcgatccgacctctattacaaaaaaggttattaaacgggatcgcccacattacgggtggcggactactagaaaacgtaccgcggatgttacaacctaaccaacaggctgaaataaaattggttagttggcctaaaccagcgatttttaaggttctcactaagcttggaaaactttcacaaaccgaccgttaccaaactttcaatatgggaattggcatggtgttaaccgtgagtcctcagcaatatcagcaagtaagggacgaactcgaccgccaaaaagaaccgtattttaagattggccaagtgaagaggcgcccagaaaatgcaccagccgtcgtacttttaggagctgattaatgattaagatcgcaatatttgcgtcggggaccggcaccaattttgttgcacttgcccgtcacatcgaagaaactaacgtaccaattcgcattgcatgtttagtctgtgatcaaccagatgcaccagtagttgaaaaagcggtcagattggggattccagtttggacccaccgtttgggcgaatttgccgacaaaacggcttacgaacaagcaattctgctcgagttgcaaaaatacgatttaaaactaattgtattagccggttacatgaaaattattacggaagtgctactagaagcctacccgcaggccattattaatattcatcccgcattgttgcctgcctttccgggacgacacggcattgaagacgctttggcatacggtgtaaaagttaccggggtcaccgtgcactggattgacgatggaattgatactggccccatcattgcgcagcgggcggttcctattttgcccaatgatgatgtggcaaaattagcgcaaagaattcaccaagtcgagcatgaattatattttgttagcctatgcgaagttctaaaacaacgaaaattgattaaataagggagcgtgctcatgaaaactgcattattaagcgtgtcggataaaactggaattgttgaatttgccaagggcttagcggctcaagaatatagaatagtctctactggcgggactaagaaggttcttgaagaagcggggctaacggtgacaggagtagaagaattaaccggttttccagaaatgctgggtggtcgggtaaagacgttacatcccgtaattcacggcggactattggctcgacgcgacttaccgaaccacttgcaagcgttaaaagaacagcaaattggtctgattgacttagtctgtgtgaacctctacccattcaaaagcaccattatgcaagacggaattactgaagcagaagcaattgaacaaattgacattggcggacctagcatgttgcgttccgcggctaaaaattttgcgtcggtttgggcggtggcggatcctgcagattatcaagaggttttagaccagctggcgcaaccggacgacgcaattgtttttcggcgggcgctagctttgaaagttttccagcatacggccgcgtatgacacgttaattgcccaatatctgggacgtgcggatgaaaaatttcctacccaactcacgctgacctataccaagaaacaagcaatgcgctacggtgaaaatagtcaccaaaaagccgctttctacgaaaatgccttacccgtgccgttctcgattggccaagctaagcaattacatggaaaggaactttcgtataacaatattaaagatgctgacgcggctttgaaaatgagtgccgagtttgagcagcctgcggtgattgccgttaagcatatgaatccttgcggaattggactaggcaagtcgattgaggaagcgtgggaccgggcgtacgctgctgacccaatttctatttttggcgggattattgtattaaatcgtccagttgatttggcgactgcccagaaaatgcaccagctctttttggaaattataattgctcctagttttgaaaaggaagcttttgcagtgttggcgcagaagaaaaatctacgaataatgacggttgattttagtaaaaaacaagcgtctaaggaactcgaaacagtctccgtaatgggagggcttttagtacaagagcctgatgaagtcgctgaaagccaggctgatttcaaggtggtttctaagcgccaaccgacagaggccgaactaagagccatggtttttggtcaaacggtggttaaacacgttaagagtaatgcaatcgtggttgctacggaaaatcagactttaggaatcggagcagggcaaatgaatcggattggatcggttgaaattgccattgaacaggcagaaaaagctgctggatttaaaaatgcaattatggcgtccgacgcctttttcccaatggatgattgcgtcgagtttgcagctaaacacgggattaaggccatcgtcgaacctggtggtagcattaaagatcaagcgtcgattgataaagcaaacgagttaggtatcacgttagtcttcagcggtcggcgtcattttagacattagggggcttaattcgtggcaaaagtactagttattgggcaaggagcccgtgaacacgcaattggccgccagttattattaagtgagcaggttgaagaagtttattgcgcgcccggaaatctcggtatgttgcgaagcggaattaagaccgttcccatcaaggaattaaactttgaaatgttggttgagtttgcccgcaagcaagcggttagtctaacggttgtcggcccggaaatgccgctgcaacaggggattgtggattattttaaagcggcagggttaaccatttttggtccgactcaagtggcggcaaaattagagagctcgaagcaatttgccaaaaaggttatgcaggaggcgggagtaccaaccgcgcgctacgccagctttcaagacgaaagctctgcaatccaggcgttatccaagacaacttatccattagtaattaaagctgacggattagccgccgggaagggggttgcgattgctaaaaatcaaagtgatgccgtagcaataattcatcaattgctaggcgagcaccaatttaataccacgtcgatcgttatcgaggaatacttggaaggacaagagttctcgctaatggcatttgttaacgtcgaccaaattatcccaatgccgctttcccaggatcataaggcagcttatgatggcgaccgcgggcctaacacgggtggaatgggcgcatatagtccgttacctcaattttcaacagagctggggaagcggtgtgtagatgcggttgtccgtccggtcatgcacgctttacgtcaacgggatattagtttttgtggggttttgtatgccggtttgattatgactaaaacggggcccaaggtaattgaattcaacgtccgctttggagaccccgaaacggaagttgtattaccacagctgcaaagtgatttttacgagcttattctggggttacttgatcagcaaccgccccaagtaaaatggcaaaataacgatatttatttaggagtggttgtgagttcagaaaattacccacaatcttcggctgcagggattagattatccagctttaatagcgttccagcagaccttaccatcaattatgctggcgtggcacaaggttcgaagggcgaattggttagtaatggtggccggatcctttgtgcaacgaccaaagctagtaatattacgcaagcgcgaacaattttatattcgtggttaaatcagaacaagataaagggattgcgctatcgaaaggatattggtgagaaaagaaagtagtgtaactagatagttagtaagagtgagaaaaaacgatataatatacagatggtttgctttttatgtagcactaattttctattttgggatatttgtatagagagacttaaaaagtgccctttatcttttgtaaataaacggttggttattagaaatgatagtgcgattaaggaaacctctttgtaccagcttgcttagaaggttgttacctggttatttgaaataatatagcatagcaaatatcgatttattataaagaacggtgcaattttattgcggagcttttttgcgaaaagtcacattaattaaattttattagcaacgttatgatttgtagattacctagctgatgattctacaactagtatcattaaattagcgatatttttgtttttaggttttatactaattgccaatacttacactatacagatacatgaaggtaaaaggttgattgctaagttatcgttaatttttgtattaactttttgcttgtattgactgatgaaaagctactttccttgccaatcaatacttagggcgtctagtagcatttatatttacttttattagtattgatataacgtttacttttatttttagctatccattttctttgttatcgaattattcaagtaaagtaaaggtggattatgtatttacactaagcgttggtataaagtcagatgaagttaaagaccaagttaaatagtgcgttttaagttctaatatattcagaagcaaaatgaaaatacaaaattatcgctatttgggacagggtgaagacggattgttatcgaaaaacctttaaataacgaataaatttacttagatcttgaaaaatgtagttctagaaactagatagtggattataaatagcatcaaccaatttataattgtgcagtccaaaaggtgatgacaacgtttagagagaaattataatgtgtggctacctaaactatacgctcacttaaaggttgggtacagcaataagagagaggggtatttcttgtaaaagagttggtaaaaaagttttctaaaggcatcattgaaacacatgcatgagtaaataacattttgtagtggaaatttgttttcttacactgtttcgagctttttttaataaaatttttactgagtcaaagagaggttaatgtttaaagggagccatttcgtttggtaataacgaaatggcttttagttttgaaagagtgactcaataaaagcaattaagctacatataaaatatatataaatctttttgtattaaccagtgagcaattactaacataagagttattcaattttgataaatatcacaagtagtgaatgaaaaatgttcactttatagagttattaatgtaatatacacatgtaagcgctatagttttaggggggatgtatacgatgagaccagtagacttaaggacattgacttcactcgattctctaagtgaagagacaattgaggattataaagattatttagatattgattttagaaatgcagaaattaggtgtgtaaaaccattagttgagcaattagataaaaatttagatttatctaatttttatgtaggatataaaataccacaaataaataaagaatttgatttattaaggtttagctctgaaacaattataaatgttgaattaaaaagtaggaataaaagcagttacgatattgaacagcaactcaaaaaaaatgaatattatttaaaaggagtggatggatatcataaaattatacttttcacatatatggttgaagggaataaactttataggtataaagatggaaagttgtctatacaaaaagttacggacttacaaaatgttttaaaagaaaatataggcaccaccgttgacattgatgaaaaatttaagccgagtaaatatttaatctcaccttttaacgatagtgttagattctgtaaagcaaattattttttgacaaaatcacaattagatggtaaaagaaaaattttagagggaaatcaaaagttttctttaattaagggtcatgcaggcacgggtaaaaccctattactttatgatatcgcacacaactacatgaacgaaggaaaaaaagtattgatttatcattgtgggatgctgaacgacggccaaagatatttaaataaagagggttggaatatacaaccggtcaaagactataataaaaacattttaaaagaatttgatataatcatttttgacgaaatacaaaggatacgaaatattaaaaatgtttataatgaattaagcgagactgagcacataaaaataattatgtgtggagatcctaatcagtggctgcatgatattgaaagtaaagaagcggtatttgaatttttagaaaaccaccccaatgttttgatggtaaaactaaaggataaaatacgaaataacaaatcaattgctactttcattaaacaattatttaatcgtagagacacttcctctaaagataagattgtccaaagtaatatattccttaaatactacgataatgaacaagatgcacataagtgtattgatagcctcgataatcaaggctggaaaataacatgttttactccgtcgctttataacagcgaatatattgataaatttataaataaaaagtatcttaattcccatcaactcataggacaagaatttgatagggtagcagtctgcattgggaaaaattttaggtacgagaatgggaggcttcagtctgccccaacgtactacaattcgactaaaatgctgtttgaaaatttaactaggagtaaagaacaaatttgtttggttattgtagagaatcctgatgttttgcgcaattgcttagaaattctaaacatgaacagcacttctttgtaagtgaagttatatatcatatgtagttagaataactaacttaatgtaataattctcaaaaggtctatgtttacggttcatctatatataataattgataaattagctaatatgtattctattaagctgtagtaatcaaatggctaactgataagaggcggggccaataaatattagattgtctttttaagcggtgttttgtctatattcaattgacgagacatcgcttagttttattgtatttttaacggggctttttatttttaaaaactcaatatagacgtttactcacctactaacaccgatagccccaaattaacgctaagttaaacttgaaatttttagtaattggcctagcgtaaaacggaagaaagaactacaatggattaaaatagtaaatggggttaattattagatagtgtgtgtggggacggtgatgaaaaagaatgtgtagattacctaaaattagcaataaagagattgtttaaatcaaactaaattcgtatgaaatatttttttaactattttgtgactataaatttaaaattggtcatacgtttttaaatctaggagggctaagtgatgacaagaggtttttcaactgcggaaaaagcccaaattaaggctaacttatatgcagcatgtgaaaaaagttgggtgaacgttggttatcgaaagactaatgttgatgcactttgtaataaagttgggatttcaaaaggggcgttttatattttctttaatagtaaggaggaactttttgcggatgtaatggaccgagtgcaaaatcggatgattaatcgcatgaatgatgcaatcgccgattctccagataaaaggggatttatcgaaggatttaaacggttatacgaagaatacgataggggaaattggattgaaaccctagctagtgaggactttaaagcattgttgaaccgcttgccgaaggaaagattagctgcgcataatgctgactacacattagaggaattaggcgttgcaattaagaaaagtaatctagtttgtaagcaaccaatggaaaaagtaatgggtattttatccgcattattagcactatctgcggagaaagacgcaattgcttatgatcatgaagaagtatttgattatatgttggaacatcttgttgattcgctatttgagtgactagcattatggacgatcagaactgaaaagattggtaatgttacccagttttaaaattgttggagatgaaccaatttgtttgatgaaaggatgtttaaaaatgaaaacgattacattgatttcagcattatcatcggtaacaatttcttgttggttagcaaaaaagatgtataagaatcagcaatttcagggtgtgaactctgcaaaaatgcactaccactacgacatatcggccgtccacaaaattaatttgtattttgaaaggggaacgggaactattgaacagactgcgggggaacagcttaaaattgagtattatttcgcaaatgccgcacaagaaaattcatttgtgtatacggagaatgcggagtttggtcagctagatttacaactaaaaaggaaaaatccgttagctccactaaatttttttgatggaatttttgttaaggtgggggttccagcggcttacaagggtcaaataaatgttaaaacgattaccggatctctgcgagccgagaacttaagtttagaaaaggtttcattaaaatctgctacgggtgacatagcggtgcatacgctgcaaagcaatcaggtactaataaaaacaaccacagggtcaatttcaattgatgagttggttaatatcggtcattccgcaaattcggcaacgtttattagcactaccggagcgattacccttatgcataataataagctctttactaaagaaatcgttaagaccacgactggcaacgttcatttaggtattgatcaaaaattaagcgattatctaattacctacgaaggaacgagaaaaaaagattctgaactagttggaaatccggttaacaagatcgtggtgaaaaccatggcgggtaacgtaagtaaattttaaaggcgcatagtcgaaatggggatcaagaggtgaaattatttggactgccgatctcgttttttggttcaaatgtgagttctaaaactattcaaacgggcaaccttatttttattgtttgggggatttgttgtattttaataggtatagttgtcctgctgggtaaccaaaagaagcgcagtaaagtccaacatatcgtagcccttggtttattaagcgttggcattttggtggtaatcaataatttattacaataccttttttgaaagtaaactgcggtgtaactatttaacgttccgtttttaatgagtatgacatttaaaattaaaagccagttaataagcgtgtggccttgggatgacttatggctgcaatgtgcagaaaagttaacggcgagaaagattttagcagatttgttcaagtctttttagaggtaagaacctccactagttgatataataacgtgtagtcagtagcaatttaccaaaagttttaatggttgcttcgtatttattaaataattcgcggaggttgcaatgcttacttacctttttttatttcttactattttagtttctagcatttacctatataaagatcggcgtaattttattgcaggaatcttttttgcgggaagctgtattaatttaactttactagcgactttaggaattgccgcttatctagctggggattctaggattggaatcattagtcttgcggtgtttttactattagggattatcgtggttccgttactggtcggttttagtttaattattaatacctacgtcatgcaaacgcgcgaaggcaaaagtttgacggctaaattgtcgctaatttttggagttaacctattacttgtattgggtgcgggtgcggctattttacttgccaaccagtacttggggcggttaacaggcatcttgttcgtttttataggaatcgacgtaacttttacgtttatctttagttgttatttgttctattcttttctgtatcaaataattcctataagagaaaaagtcgattatattattacgttaggcgctggaataaggtcagaaaccgtaactccgctcttaaaagggcgactagacaaagcgttagaatacttttggaaacaggatggaaaccctaagtttgtagttagtggcgggcagggacctgatgaacccgtttcagaagcctatgccatggcgaaataccttaaaagtcagcatgttcccgaagataaaatcattttagaagaccaatccaccactacattacaaaatatgaaattttcaaagcaaaagattgaaaaggattggaaaaagtcaggaatgcctaaggttatttttgctactaacaactatcatgtattgcgcagtgcaatttatgctcgtaaggcgggattaaatgcaaacggtgtgggttcaccaacttcattttactttttaccgagcgcgctaattcgtgaatatatcgctttgttagtgatttataagaaaacaaccattgcgattgtgttagtatggattttacttggactcttgttagcctttttttagaatgggagaatagtttatgcgtaaacgagttatagctagcggtatcattgttgcaatatttttattcattttcgggggtgcttatttctggtataagtccaactacggtaccgaaaattattacactcaaatcactaatcagggaaccaaaattgttgaaaaagatgactcgggcagccaagtcgtggattacatgtatcatcaaccaatctatgatcaaaatggccaaaaagtaatggctaagtttagaggcgggctagaacggcccttaaaactacatgcatatttaaaggttggatataacaccaagcggcaccaagtgatttcttgggaaaaggttgctaaaaaggatgtccctaaagcagctttaaaacagctgcatgagtaagttgctaaaaatattcaataactaaaaggaaatcatttcgtctagtggcgagtggtttccttttttatttccgaaccaaatttttaatggctatcgattgtaaaagttagtggcaggctggagatatttctagatttgccaatgggtttcgacttgctgtacggaagtgaaatttaaggatccaaaatgtttaaatttagatatcaaggcgcaatatttaatccttacggaaaacttttaaagccgggaaatcccgctaatatggtatttcacacccataaatattatacagggtaatcgagttagcactttacttaacagagtgctaagaagggtgtatactatagttgtaggtgaaaagagtgcttctaattaatattgcaacacgatttttacttcatttaattaacggaggtgttgttacatggccaatttttacggaaatgatccttttttcaacaatgatatggatgatatttttaatcaagtattcaaacggatgggaaatcctaactcggattccgctcgttacttggtcaatgggcagtcgttaacaccagatgagtttgctcaatatcgagcaactggcaaactaccagaaaatgcaaaaacaatcgaagtatccaaggacggacaacaggcccttaaaaagggtgggattttggagaagttaggaactaacttgactgaacaagcccgcgatggtctgctagatccagttattggacgtgaaaatgaaattcaagaaacggcggaaattttgagccggagaacaaagaataaccctattttagttggggacgccggagtcggtaaaactgcaattgtcgaaggtttagcacaagcaattgtaaatggtaacgttccggaagctattcaaggcaaagaaatttattcaatcgatttatcctctctagaagcaggaacccaataccgggggtcgtttgaagaaaacatcaaagacttagtcaaagaagttaaggcagctggaaatattatcctattctttgacgaaattcaccaaattattggcgcgggttcaaccggcggcgaagatggtggcaaagggatggcagatattattaagccagcattgtcccgtggtgaattaaccgtcattggggcaactacccaagacgaataccgtaatacaattttgaagaacgcagcgctagctcggcggtttaacgacgtagtggtcaatgagccaagcgcggaagacacgtttaaaattttgcaaggtgttaaggacttgtacgaaaaacatcatcacgtaaaactccccgatgatgttttgaaggcagcggtggattattcggttcagtacattccgcaaagaactctaccagataaggcgattgacttaatcgatatgaccgccgcccacttggcagctcgtcagcctgaaagtgatcaagcaactctaaacgagaagctcaataagcttgaaaaagaaaaggaacaggctgttaaagaagaagatttcaaacgtgccgctgacttaaagcagcggattgaagagaccaacaagcaaattaagaatgcagataaaaaagaagaagtcgtcgcaacggtggacgacgttgctcaatcggtagaacggttaaccggaattccagtttctgacatgggtgctaacgatattgaacggctaaaagacttagatagtcgtttgaagagcaaggtcatcggtcaggacgaagcggtagacatggttgctcgggcaattcggcggaaccgggctggattctctgaaggtgaacaaccaattggcagcttcctatttgtcggcccgaccggggttggtaaaactgaattagctaaacagttggctttggatatgtttggcaataagaatgcgattattcggttggacatgagtgaatattcggaccggacggcggtttctaaattaattggtacgtcagctggttatgtaggatacgatgataactcaaataccctaaccgaacgtgtacggcggaacccatactcaattgtgttattagatgaaattgaaaaagcggatccccaagtcctaacacttttacttcaagtaatggacgacggacgcttaacggacggtcaaggaaacgtaatcaacttcaagaacacaattattattgcaacatcaaacgctggattcggtaacgaaaaattaaccggtgacgatgctaaggaccaatccctaatggatcgacttgcaccgttcttccggcctgaattcttaaaccggttcaacggcatcgtagaattctcacacttaactaagaaagacttaagtcaaatcgttgatctaatgattgcggatgttcaaaaaacattggcgaagaaagatttgactttggaagtaactaaaccagccaaggattggttaatggaacaaggttacgatgaagcaatgggcgctcgtccactaagaagagtgatcgaacaacaaattcgggacaaggttactgatttctatcttgatcatttagatgtgaagaacttgaaagctgatttggttgatgatcaaatcgtcatcgaagctaaatagtttgattttagcgttttgcacattcaaaagtcacgctattagtaagtagtggctattaaggaaatcatttcgtttaacgacgaagtggtttccttttttgttttaaaaaattcaaggaggggcaattttagatgctaaccaatgagattagggctggctaatcatttagctgcgcgtgttagtagttaggtgaaatggtaaagctaagaaactttaaagaatattcagaatgcattttaagaggtgatcgagtgctatcctttaggtgaaatcaaaagttgaaagtttattagtagatttgaaatgtaagtttcgcgaaatgcaggatgacgatggtccccattttacctaaaaaagttttgaattcaatcggatgcattaagttaattaaaatgcgtgaaagttaatgttacttcctgcattttacataaagtagaacctttcaatccttatcgatcgagtggttggatgccgtggacagccgtatttttgaaagcgatttctataaaggaagatctaaggaatgaaaggcaacgattgcgatttagttatttatcaatggttggaacaaatgccataaacaatggcatccagggagggattacgtttggaagatttaatcttagaaactcgtcatttatccaaaaaattcaaaaatgaaatagctgataatgatatctcactgcacattaaaaggaatacggtatatggtctgataggacctaacggagcgggtaaatctacgttattaaaaatgattgttcagctactagcgcctaccgaagggaatattatctttgatggacatccgatatctagaaaagatctagataacatcggtgcgctgattgaagggcccgctttatataataatttaactgccgaggaaaatttattagtccacgctaaattattgaacatacctgttagcagaattagtgaagtcttagaaatagttgatctaaaaaagactggcaaaaagacggcgggtaagttctcaatgggaatgaaacagcgattaggaattgcactggctttgctgaataatccgaaattgcttattttagacgaaccaaccaacgggttagaccctttcggggttaaagaactgcgagacttaatcgcaggtttccctaaacaagggattacggtgattctttctagccatattttatctgaagtagctcaagtaatcgaccgaattggcatcattaataggggggaattgttgtttgaaggcgtaccagatcaaaaagaaagcttggaagatttctttactaagattgtgttaactaagggtgaacgttatgaatagtattgcggtcgaaatattaaagtataggcggacttttctgaaaaagatgtttttcctaatcccaattctgccattgatcctaacagtaatgattgccataatatcggctaacacgaaagaggcaatcgcggcacataataacacctttacttgggataagctattcggacttatttttaattggtggccggcagtatttttgccaatcagtattgcattattagcaatgatgattattaatacagaaaatgaggggaggaattttgaagcgcaattaattcataatattgttcctcaaaaattatggattaataagattattgttttcgcaatttatatgataattcctaacctttgtttggcgattggtcttacgataattggaataatgtttgtgggcgttcccattccaattgtggatttagtccgggatgatttgttttgttgggtatgtttacttcccttgttaccgttgcatctaatattagattacttatgggggcacttattgaatttttctgtagctattatgggtgcttttagcgggatgtattttgcagccagaagtttttggctttttgacccttggacctggggtattcgagtattgagtcccttgattggagtacatccgaacggaacaaaactgatggctggagatgcacttctaaatacttcagtggtcccggttggtgtttcactagcggtaggattatttgtagtgcttacttttggaagtgccgcgatttttaaaaaggagagtatcctcaaatgaatttcattagtgcagagtggcttaaaattaaaaggactggcatttggtggatggttatcgcatttccgattttgcttgctttttttacgttactttatatttggacgcataaagggattgtacaaataaatcttattaacacatggttcaatatatggctatctttgattatgccgttatttataggtgttttggtaggactagatatccataaagaagctgaaataaaacaattttccgctttattcgctgaccaaatttccaggaagaaaatctttttaacgaagtatatctttttatgtttatgctttttagttagtattctgttatctacgggggtcttttggttaggtacttttgggctagcaaatgcgattccattaagaatattacttatgggagtggctcttggagtgattggaactctgccggtggttgccttacaaatctggataagttttagatgggatttaggaatttcaattagcgtgagcattttcggctttttattatcaacccttattggaacaaccaatcttggtgagaaaatttggtatttaattccttggacgtatgcttatcggttgtctgagattacaaatgtatttgtggttaatttggtagacaaaaattttaggaaccaggttatcggtttagcagaacaaacaggggtaattggaatagtagcaagcctagtcactagcctattatttttggcgggtgggattagttggtttaagcggtgggaaacgtgatttttacttataccttgttaagataatgaaaagactagtggtacagtaatactgctagtttttaatttacttaaaatgttaattaaatttgacatatacgaacgtaaattcttgtgattggctttatgcagggtttgataatatggttgattatgtctcatggaaataataagtaaacatattaaatttaataacaggtaagtttagaaaataagccagaaatttgctaatagcaagaggcttggtaattagaaagagtagaattggtatattcaatggatgttaaagactttaaaaaatttattggtataaattggtataaaactgaattgcaggaaatatgtaagaaaataagattgcaggcttgtggggctaagcacaaattgactacgtacgtagaaaaattttcgaatgacgaaaaagtatgtaatataaagcctactagaaaaaataatagacgtgatgtttgtctctaaaagataacacctgaaactaaaattttaaggttaggcttcaatttaaataatcaagtacgagaattttttcgctcttattaatagatgcaaatgtcttctttaaaaaatcaatggacataaagatgcgggaaataggaactgatcgtaatgtaaatgcgactgttcaagacttgatacatgcatatgaagagtgtgatataaatatttttaaaaacaaagaagaaaaaacatatcagtggaataattttgtaaaagaatttaggaacgatagactatcgaaaaaaattcagaccatcaatgaaggtcgcatccattttatggaaaaaggttagagattcagagcaataaaaaattatagccggaacgttatatacaaatatgaaaaagatttgtatacatacttaaaagaataaatagatatcatttatctgaagaaactacatggctttttaaaataaactttattaacgggcttagtacttctttttagcagcggtatgtcctaacattgcatctactcaatttgaatattatactttaaccaaaaatggtagcaaccattcggcaaaataccgaacatttgctacctaaaaaataatatatagttttgtttaaaatttaaggatgattttaaattttaaataagattttataaagggaactttttgctttttattgtaactttattttttatagctgtgaaatattaaaatactgaagctccggaaacttacttttgaaattgttaaaaaatgtagcgtgttctttggtgttaatatagattgctaatcctttctttgctctagtgataccaacatagaagagataagacataacgtcagtacgtaagtttaacgcactgtcttcagaatgattaaaattaatattgtcccaatttttattaggaaaccggccccaatcaatatttagaatgacattttgaaattcaagccctttagcagcataaatagttatactcttcttgttaatttcttgaagggattggtaaaaatatttaatttgctttaattctaccaatgagaacccattaagccaattatttaatggtgcaaattcggaactaagcgccagtccaagagaggtaaaattctctaaattagctttatttgactgtatttgtttacaaacaatattgtgtatttctgtaagtgaaacatttaagaggctagctatatcgaatacttgaagtagtccttgagcagactcatagttacttccataaaaaatattactgtattgaaggagtgctttaatataaccgttaagtttatcagaatttaaaacttcaggccaagtcaaagacctagtacttggcacgcactttttgagttttttcgtaatcgtattgaatcctgcgatgcttgttcgaagaccatttgttagtgacaacactataggtttttcaaaatgaatgaattgttgaattttattaatggtatttggttctagttgattatccccataaaatacgaaaacttcgttttcttgttttaatttggcctgctgttgaacattatcaaatgggaaacgtactttattgaaaaatgaaactaaatttttttgtgacctataattatattctaattcaaatttagttacggtgtatttttttgatacatctgccatgtttattgagtctgcgttcaaataaattgcttggtagggatcaccgtataatcctattacaatcttgcttgataaatggttaaacagacaatttaaaaatttgccgtttgtatcttgatactcatcaattaaaatataatcaaaagatcctgcaattatcgatgaaaaggatttgatatgagagatagaaaagataaacatgttaattacatcatcatgtgataaccataaatcaccgttttttttaaattgtggaatgccaatttcaccatatttaatctggtgtacatcggataatgttacgcccggagtatcagatatgccttgaggtataaaaccaggtcttattttagcaaattcaaggatacgtttagaaattggtttaataactttccaacaaaacgaatgaattgtggacagtgtgacatcgatattcccaagccgggattttaattcattaacggcaacgttcgaaaaactaattactgcaacttttttattttgactacacaatttaataatatcatttgttaattgaaatgtttttccagacccagctgctcctcgaacttctactatcccatcagttaactgtgaaagactatttttcattttttaccaaccattctagtcctgaagatatatattcaggaactgtaaattgaggtgatgcaattaaatcaagtccatctagcgcaaagtctgctttccttttttttagcaaatatttatctactaaatttaaaagcgaaggattattttgtatgtttttcgaagcgtcggattttaaaaatccagcggcagaatataaattaaaattttgagtacttgcggaaacaatagcactctctaaagttctaggccagaatttatagttactgttataaccttgagtagtaaccataaaattatcatcatgatctattcgtgtgtcttcaggaacaagactagcagtagcataaatttttgtctctttgttcctaaatttgtttgtcaagttaatatctgtgaccttagtctcttcaggatgtttattgagatattttagatttgaattggttgttgtaatttcttcgagtttttgtggttcacccgttagtgcgttcattttaaaatctatatctgtgatgagtaaaattttttgataatcaaggtcagatattgctggcgcaagtattgggaatgaagttcccacaggaatgaatgcaattttctctgatagtaatttgggtgcacattttcgaatcattgcagtgatagtaagtcgttctgcatcgccttcatatgcaataattttatctgcaaatagaagttctgcattatagtttaggatcaattttttgagtttatctcttgatttaccattaccaactttgttccaattaataaatcgagtgtttttactactttttcttccaatgacaatttgaaagcccatctcgaaagcagatacggcaatttcaggcgagtgagatataaggactagctgaaatgggatgccaagtgattccgcttgttttgcaacaaattctcgtatttgctggacaaaaatgtgttggagttgaggatgtgtaaaagcttctggttcttcaattgcgaagtaaacaggattgtgtaattttaaagcgtccatttgtgcaaataaggcactaattcgcgcgataatattataaatgttttgatatccaagtccttgtgactttaagggtagttcgaatccttctagcttttcaaatgtttgtgcaattctgatgctagggttattcatccactcatcaatagttaaaattgcttttagcggattatcagggtcttttggataggcaaaagatttgagttcttcttgaaatgtatccatttttggtgctaccgtattatctacatctgtttgcatagacttgaataatttttgtacttctatatcctctcctatcatgtcagaaatttttgttgaaaattgctttgctgttgcgtcagtattactattttttccatccacaacatatcgaaatgccattatggggtaaagtaataattctccaggtcgcacagattctaaattatatacggggagaggcaataatttattcaaatgtgctgaagcaggcaaatatgatgctgtattatttaaaaaatcttgaactgacccgatttttacatttctgacaaataattcaagaagatcagatacctgttcacatttttttagtcgaggataattatcaactggtatggcatatgtaagctcaattactgtttctccagaatcagatatttcacttaaaagtgaccaatattcagattcaagttcatcccagtcatatgtaattcttaagcatatgcaatcatcatttgacaattgctcaggattattctttaaattcataatatgaatcaataaatcaatattaatatctgaaatgtccaaattattattaaattttgaaaaagcatctaatatgctagatttaccgatgttatttttgccaaccagaatagtttctttgtctagatgtatggtactgtgtttaattgcacgaaaattttttatttctattttggatatctgtaattttttcatatttcctccgtatcacgtatataatccaacgccgttcacagtgtataatacaatgttttttggaatataaaaagaaaaaaattaaagttgaaccaaaatagtatttaatactggcgcataaaaaaatcgaaagatgtatgaggctgttttttaccataatcgtcaaacaactatttttattgtgctattactgtgtaattcaattatgatatgacttagttcaatataaataatataatttgggaaaacaattaatactaactttaactaattactatttctcctgaatagccactcgtaaaatagttttgcgcttagcttcctcaacccggcggaaatcgctcatatagatttccgtatgttctttttcactacgttgataaccagcttcatcaataaattgctctaatttttgaaaactttcgggttcagtatcaaatgagccaacgtgtacgatttgggcgaccagttgtgctggacgatgctcgaaataaatttgatcaaacagggaagcatcaatcttaggtttagcacgttctagagcttctttggcaatctcgtcagttacaaaacttggttgtttaatgctgataatgtatttaaagtgttcttttttcattaccggagcatttaaatattggtcttgaattccccagtatccttggagtgggtacaccgtatatagcttaaagttagggatatcccagcctttcttttgactcatccgaatagcataagaaacaggatacagggattgaacccttttctgaaaatcaggtaaattaggatcaccttcgccagcaatactaaaataattttgttcgggaatggttaatatttgaggctttttcctaagggaaaagcctttttcttccttccgccattcaattttttcactactcataaaaattctccattcacttaaatgatatagcatattttagataaatccgttcgttgccaataaccatcgttgacggactttcgcgtgatgtatgcgcatttatacgctacttttcttataaattctgattctaatgtgattttagcatattttagtttatcgaatatggaggatttttgggtaaaatgctttagaaattgggcaaagcggagaacgcattttataaaaaaacgtaatgattttgcctgatgtataaatagtatatgtaaagaaatataacaagtgataacattaatgcttaagaataaacgagagaacgagttttgaaagcgctcagatactcttgatgaagagcgtcaataaattttttgcatagtaacgagcagttgtgccgtttcttttaaataaaatggcatttagtaagatacatggggtgaacaaggattggatgaaatttatatagttgcagccaaacggacggcgattggcaaactaggtggaagtctaaaagaatttacagccgctgaattaggcggatttgcaataaaggcggcaatggaacaagctaatttagagaataattacgttgatcaagtacttatggggaatgtgattcaagcaggtaatggtcaaaacccagcaaggcaagcagcggtatccgcaggcattaattattctgtgccggccattactgttaatgatgtgtgtgggtctggtctatctagtatcaatttagcggcaagccttatcgcttcgaaacaagcaaaaattgtaattgctggaggaatggaaagcatgtcggcagcgcctttaatttcgcgtaaatcgagatttgggcagcgacttggtaatcaagttttagaagatgcaattctaagtgatgcgctaactgacgcctggggtcactatcatatgggaattaccgctgagaatgttgcctcgaaataccatgttagcagacgtgaaatggatgagtttgctttagctagccaccaaaaagcagttaatgcgcaaaataacggtcgctttgataaagaaattacaccaataaccgtaaatcaagcggatggcaaatatttatttaacaaagatgaggctccacgaaaggacacaaccattgaaaaattgggaaatttaaaaccggcgtttaagctagatggggaggttactgccggcaattcttctgggattaacgatggggctgcagcgctaatccttgcttctaaggaagcagttatcgcacacggattaaagcccttagcaaggtgggtgaactgttcggtggtgggtttagaacctgacctaatggggatgggtccgtattatgccgttaacgaagtattaaaaaatgcaggattagcgaaagaagacgttgatttgtatgagctcaacgaagcttttgcagcgcaatcgattgcatgtattagaaaattaaagttaaaaacagagaacgtgaatattaatggtggtgcgattgctttgggacacccagtaggcgcttcgggagcaagaatattagtgagtttgatatacgagttacacgatcaaaaattaaagaggggccttgctagcctttgcgttggtggcggtatgggcgtaggtacaataattgaagctgtttgattattaaaatgggcagcttttttattaggaaatttgttggctacttctatgatttttaaaggatgagttttatgggccattaaactcgtttagatatgaccgtaaacgcgaattgattaatgatgtttttataataaagatagcaatcaaggtccttttcttccttaagaattcataggacaaaatctataataatagattaaatagctatgatagggtgtaattaatttattggtagcggattgtgtatatttttatgtgactacgttaaaatttattgtgaacgctgtatatgtctgtgtcgtttcggtgaaagaaatttaaaaataagttgactctcaacaggtctttagacatatttttatgttttgtcgtttagattcttggaattgtgtaaggagaaagctgatggaacgggttaagttttatagtaataatgatttatcgttgtatttctacatggatagaatgaagaatgtaatggaaaatattcagtcgattaaccaccctaatttcctggatatattggaattttacaatataaagaaatttttaaaaaatggtatatatccaaaaggttttccagaaggaaaaataaaaaaaatacaaggttgcttgaataaaaaaataaatatatttttttattcaataactaaagaagagattttttcttgtctagaatatttcttttcaacttcgtcaaaagtatgtgaagaagcaccaaagtctctgtataaaaaggacaacattgacgaatttagaaacaccctatttagagatgatttccttaagtgttttgaagatttcaatttagataaaaaaattagcgaaaacgatttagaaaatgcagttaatagcctttcaatacctgtctggtactttttaaaatctgattttttctcaattaaatatcctaatttgataaagaatttgttcttaagtgatatcaaaaactttgaattatttttaaataactttctcgaagatagaggcaattatgttcttcctgcaaatattagcaaggatgaactttataagttttgtgaaagttacataaaagagtcctcaaatttaaattttctcgagttaattgcccaaggaaataaagatattagaagattaacaattgatcccaaattaaaattaaaagcacaaagaaaaattaaacagcttgagaatgatttttttaataatcaaaatagcgtttttacacagagtattgcagtttatacagaaagagaagcttattccaaagcctccaaagatgaactaaaaatatttatcgatccagaatatattacagagcatccttcgcccatgtcactacttaactatttaatgtatatggattatttttttaatggaaactggattctgaacatgtgtagctttcctaatttagaaagctcgactctaacaagatacttttccggtcccaaaacaaaacgaaattacgaaaccagtttttatttccataataaaaactcgttaatattgtatgcttttaaagtttttcaaaacgttttaagtaagaaccttggattaaggattgaagatctacttgtttatttttttgaagactactgtaaaaataattttgaaatagaatggttaccaatacattttgctggtaaaaaagaaaagataaatatccaaacgaaaaatttatttaccgtggaggaacagataagaaagcagtggaatttgttaattagcgagggagagatagataaagagctattcatgttggaatctacgcccagaataagtaacctaaaaaggttgttgcataagaaatatgtttacttgaatgagaaaaatgaaaatgtaaacagaattacacatttgcttttttcggatcaatcagaacttacaattataaaaaatacaaaggcagacctgtatgaagaaaacttcgtacagctttttgcgaaacacaaagttaagttttcatattttgaaaaataccagcaaaaagatattaattttttaattaaaaataatattattatgaggactaaagatgatgttatttgtgcaaataaaaaacaaatattaaggatagcaattttatctaagctttttgattacggtgtcattcattattacaatgggataattaaaatatatagaaaagtcgatttaaaacgacaacaacatgaaatagatgaaatgttaaaagaaggacttttagcttataaaaatacgcttttttcaaaaccagagtcagattatttaaattatatactaaatgattccgagtttgataatgcactaggtataagaaacaagtatttacatgggtctatttttgaagataatatccaagatatgatgtacggtttaattattttggccatttacgttattaaaattaacgaagagttaatccttagagaacattacgaaaatgttgagaaaaattatcagtagtatatatttaataaaactatttagttacgaaaagtttggtgtggtaaattgatgatttaacctaaaagtttcacaaaattaaacttacaaattaacagcttctatttgacaaatctccaatgagttatactatatgtttatgactatgaaacaagaagatattaaaagagctgagatctttaaagttctatcagatcctaatcgattaagcatgatacgaacactttataaaagtaaacgagaaatgacttgtggagaggtaggtaagaaattagaagttagcaagtcaacagtttcgtatcattttaaaattttaagatcagttggactaactaatactcgaaaggaagcgcagagcaaatatctatctttaaaatttgagacatttgataagtatttgcctggatttttggattcactttagcggaatcctttttattttaattcgttgtttcatggttatagaacaactgtacaaggagatggagtattgatacaagtaaaaaaaacaagattagggttaattatgttggctatctttatttctacgtttatgacatctgttgaaacaaccattatcacaacatctttgccaacaataattagtgaactaaggggcctatcagttcaaagctgggtatttgcagcttacctattaacaacagctttgtcgacgcccgtttatggaaaaattgctgatagggttggtcgtaaggtagtgtacatacttggtataactttattcacgatcggatcaatgctgtgtggcttttcaccaaatatatatacgttaataatatttagagcgatccaaggcttaggtgctggggcagttatgccaattacgtttactatcattgctgatttatttagttatgaaaaacgtgccaatatgttggctctaaataatacagcttggggaatttcagcattattaggaccaattttaggtggatttattgtcgaccgtttaaactggcattgggtattttttattaacgttccctttggaattttagtgcttattgttatcacatttggatatcatgaagcaaaacgtaaccaattaaaacagccgattgatttcaaaggaatcataacattatctctgctgttatttttagcattaatgatctttcaggggatgggcaacccaagaattaattggtacttaaccggtttagaaattgttttgttggcaattttggcgaccttttttattcaagtcgaacatcatgctgaagacccggtcatacctttaaaattgtttactaaccatctttttacaattcaaattttaacagccttattactcagtggaattcaaattggattccaaacgtattttccaatatggcttcaatcgatttataaagttagtgcatctgtagcagggctggcagttacgcctagcccagttttatggttaatagcttctttctttgttggaagtttagttaaaaggtatgctcctaagaaaattgttattccaattgttactattcaaatgctattttatgttccacttgcttttgccagtgttagcttccctaaatttctgttttatataattgctgggattaccgggatagctttaggaatcgtaattacgatgaacaccttgatttctcaaagggtggtacctgaaagtaatttagggacagcttcttcgatgttgacattgggaagaactttgggccaaacagttgtaaccggaatttttgggctaatttttaatttggccgtgaatattcaggttaaaaatcatagttcaatcagtttgggacaagtaaatatgtatgtaagtagtggatctggtggaaaagcgcaagctgctagtaaaattttaaatcaagtagttttgaatgggatgcacgcagtatttattgcggtactcataatattcataattacaattgtcttgaatattagcgataaaaataacggaagaattagatagggcaaatttatgcaatatatagaaattttttgatacaaatattaaacttgctaaattcaataggggtaggaaatcattaacaaattccgtttaagctctaacttatctaatgttaagtacttaataattttatttaagcaaatacatttaatgcattaaagtatagtttttgtaaaattattgtctttttgtttgtaagcggtttacaaaaagagttacactatagctgtaatattatgaatagggggatattatagatggataaagcaaaagttattattgttggggcatcacatggcggtcatgaatcggcaattgagctgttggataaatacgataacgtcgatgttacgatttatgaaatgggcgatttcgtatcgttcatgtcctgtgggatgcaactttacttagaagaccaagttacggatgttaatgacgtaaggaacttccgaccagaagacatcacttccaaaggcggaaagatttttaataatcatcaagttacggcaattgatgttgaccaaaagcaggtaaccgttaaggatttaaaagaaggtacagaagaacaagttgcttacgataaattgattcttagttcaggagtgacgcctaagaatttgccagtcccgggaactgaccttgaaaatgtatatctaatgcgtggctatgattgggctacaaagattaaggccgcgttaactgatgatagcattaaaaatgttgcggtggttggttcaggatacatcgggattgaagcagcggaggtatttgctaagaagggtaaacacgtcactttatttgattttatcgatcgtcccctcggcaattatctcaaccatgaaatgactgaaattatcgataaaacgttgactgacaacggcgtccaagtagaaatgagccagagcattaccgcatttaagggcgacggaaaagttgccagtgtggaaactaagaaaggcagttatcctgcagaccttgtaattcaagctgccggggtacaacctaatacagaatggctcaagggcgtagtagaactgacagatcgcggtttcatcaatgtggatggctacttgagaaccaacgtgcccgacatatttgcagtcggagatgccatcttaccactatctatcccggctggaaaaccatctccaattgctttagctacaactgcccggcgtgaagcccaatacgttgtaaatcatattttcgagaagaaaccaactcaaatctttaaaggcgtagttggctcatcagcattgcatgtatttgacgaacactttgcttctacgggtgtaaatgaatttactgcagaacgttctaacgttgaaattgttaattcacactatgtcgatcacattcgtccggcatacgttcctgagtcagagggaaatgttcgcgtggatgtcgatatcacatttgacccccatactcacatcgttttaggcggcgcagttctttcagcatgtgatttaactgctcaaggtaatgttttggctttagcggtagaacaccggctgacagttgaagacttagccgaagctgacttcttcttccaacctggttacgaccggcaatggagtttaattaatttggctgcgcaacatgctttaggttatgcacgcttctaaagtaaattaatcggtttatacgtagtatgaagtgtccgagaaagttagattattgatctagctttcttggacattttttatttttgaaaagctataatattttttgtttacagatggaagatagttcaaacttatttagaaacagattatcttgtttaaaaattttagtttaagcaagtttaagcgacaaatctttctcaaagtagtacttttagttaggtaatatttttctaagatacgaagcattacattcatgataaaagcgcttgcaaacgcatgaagaaagattacaattaaagcggaaaagtaggaacggtttttaattcaagaatgtactatataagtatgggtaggataaatgacaaattttaaaattcagaattcagtgaatatttgaacctaatagaagtttcaataacaattgttaaaaggggctttgtgaattaagaaatgttgggacagttagcatgtatgaagtaaagagagtgattcatcatgaaattaaaaaaggcaaacctaacgaaacaaactaaaaggctgtatattatttggataattgttaactcattaatgttagtaatgactacgtttacgccacttaaggaaagcgcaggttttatagttgggtcatttttcataatgttcttcttttccatttacgtattttgtatggcaatgaaggatgaatttggtgataaaaaccgtttgggatagaaaaaatcaatttttacgagttaaagagaacgagtttggttctctttttgtttgtcctagtgtatgtatggatcttcatgaatagatttgatgcacaaaaaaacagaaaccaaattttcgaggaattgatttctgttttttattttattaagggctagtaaaaattagttaactgctaattaaatattgaacatcgtgtaaacagcttcttttcgacttacttaatttgcccaatgctcgttattagaaacgatacggatactcaagatgtggtagcaaacagctttgaagatggtaaaattgatttggcgattactagattttgaatttgcccaatttcaattaatacatccccaatgggtattcggatttgaaaatttgaataaattaggtaacataagtacttgatgctaaaaaaattatcatcaatccgatgactcatggatccattaaagagttagtttattttttagataaatttgcccaattttcaaagatattgaatgaaaattagggttcagtaccttgatataaaaggggttagaaaatatacctattatacagtggccgtattaatgtttttaagcgtggtaaaagtagctgatataataacgttttactaatttaagcaatgctaatcagcaagtttaagtggattagcttaattttaaacaaacaaggtgtctaaagccttgatataaaaggagttagagaatatgcctattatacaatggtatccgggccacatggccaaagccattcggcaagttgaagaaaaattaaagctcgttgacgttgttttcgaactggtcgatgcgcggatcccagtttcgtcacgcaatccaatgattgagtcggttattaaagataagccgcatttattaattttaaccaaggcggacttggccgatcctcaagagacccaacggtggttggagtacttccgcaaaaatggcgaccatgccgtggcgttgaactctaaagagccttcaacggaaaaaatcatcttaaaacatacccgcgcaattctagcagataagcttgaaaactgggaaagtcgaggaattaagaaaactgagattaaatcgatgtgtatcggaattcctaatgtaggaaaatcgaccttactaaatcatctggttaacaaaaaagttgccattactggggaccgtcctggcgttactaaaaaacaacaatggcttaaatcacggcaaggtttgtacctattagatacccccggaattttatggccgaagtttgaagaccagtcggttggcagtaagctagcatttactggggcaattaaggacaacctctacgccaatgatgatgtggcattatttggcttgcagatttttagtgacaaataccgtaacggtttaatggagcggtatcatttaacggatgaagactttgatcagcctttgccagaacttttactgttaatcacccagaagttaggaatgcgagacgactatgatcgtgctagccaacgaatcttgttggatgctcggaagggtaaattaggccgttttaacttagattttgtagaggagcttaacgaccgtggcgacgattaaagaaattaaggaacgcttagtaaccgttcaagacgttaatgatccttactttttggctctagctgacgatagccgtgccggagtgcaaaaactattacggcaaaaggaaaaggcgctccaaaaagtggctgaacaacgcctcgcctttcaaaagcggttttccttggaaaatgagttatggcagtccggcaaacagtttgtggctgggattgatgaagtaggccgcggatgtttagctggaccagtggtgacggcagcagtggtcttagacgaccgttttgatttagtagaagttaacgactccaaacagttgtccttaaagcttagggaatctctgtacgcccaaattctatctgaagcagttagcgttggtatcggggtgcgttctaaccagcaaattgatcaaatgggaattttgaacgccaccaaagcggcgatgaacgacgcgattagccatttaaacgtaacgccggaacacttgttaattgatgcagttcaggttcctacaagcatccctaagacggtgatgtataaaggggatgctaagagtattagcattgcggcagcttcaattgtggccaaagtctaccgggaccacctcatgcgctcgtacaataaaatttatcccggctatggcttcgaccaaaacgtgggttacggcactaagcagcacctggaagggttaaaggagttgggagttactccgctacatcggttgacttttgaaccggttccggaatttgttcgacaataaaatattatttactaaaatcacgtattgtacattcgaggtgaaagaatggaacttcgtgattttttaattcgcattaaaatcggcacaacttttggcattaaaaagcaatctcaaatttatcaagcggtccgcgaccagccagagccatcgttatctgaatgggtacacacaagctcgttaattgccgacgaacagcgaagtgatttagttaactatttgcatagttcggaattaaagcgtaagattcatgaaaatgagcaaaacgggggaatcctaacgattgcggatccaacatatcccgacattttacgtgagatttattgtccgcccaccgtattgttttaccggggccggctagatttactccaagaaccgcgaatggttgcgattgtgggtgctcgaaacatgacccgttacggaatggcgacggttaaaaaactggttcctggtctgcttgagcaccagttagttaccgttagcggtttggcgcgcggcgttgatgcaatgactcaccaagctaccgtggacggagccgggaaaacaattgcggtaattggtaacggcttagacgttacttatcctaaacaaaacgcgattttacaagaccaggtccaacaaaccgggctgctgctcagtgagtatgctcagggagcgcgcccgctacgtcatcactttgtggaacgcaatcggattattgctggcttagctcaggccacttgtattatcgaagcgaaacaaaaatcaggcagtttaattactgccagcctagctttaggggaaaatcgcaacgttttagcggtgcccgggagtatttttagcgaaaatagtaggggaaccaacgagctaattgctgcgggagcacgcccgttaatctctttaaatgacgttcttgaagaggttggtttacaaagataaatatacattttaaaaaagtcgtgctaagatgtaaacttgattagcaccgttataacagtggctatcagagactacgtcaatcgcttagggtggtacccgctatttgacaatttagattctaatgcaataacatggtgactataaattctaatttaaggcaaaggagcaacaaatgccgactactaaaaaaaacttggtgatcgtagaatcaccttctaaggcaaaaaccattgaaaaatacttgggtcgctcttataaagtcgtggctagtttaggccacatccgagatctaccgaaaagtaaaatgggagtcgatattgaaaacgactacgaaccccactacatttcgatccgcggtaagggcgacaccattaaaaatttacgtaaagaagccaaaaaggctaaaaaagtttaccttgcttctgacccggaccgggaaggagaagcaattgcgtggcacctttcctacctattaggactagatccgaaagataagaatcgggtggtatttaacgaaattactaaagacgcggttaaaaacgcctttaaaacccctcgcagcattgacactaccttggttgatgcccaacaagcgcgccggattttagaccggttagtggggtattcaatttcaccattgctctggcaaaaagttaaaaagggcctcagtgctggtcgggttcaatccattgcgttaagcttaatcattaaacgtgaaaaggaaatcgacgcctttaaacccgaagaatattggtcaattgattctgaatttaaaaagggccgttcaaagtttaaggctagtttttatggtatgcaccataaaaagatgaagttaccaaataatgaaaaggttcaagaagtcctaaagaacattgaccctaaaggcgactttgacattacggaagttaaacggcgtgaacggaagcggtacccagcagcggcgtttaccacgagttctatgcaacaagaggctaataaaacccttaattttcggactcgtaaaaccatgatgactgctcaacagctttatgaaggaattaacattggtaaagaaggaacggttgggttgatcacctatatgcggacggactcgacccgaatttcagaagttgctaagcacgaaacttccttatttattcatgatcaatacggtgcagaatacgcggctactaagccacggaaggggaagatgccagaaggggcgcaagacgcccacgaagcgatccgtccttcttcggttaagcggacgccggaacaaattaaagagtaccttaataacgaccaatttaagctttataaactaatttgggcccggtttgttgcaagtcaaatgacgcccgaagtttccgatacgatgaccgttacaattgaacaaaacgacgtccagtaccgggcaaacggttcgaagaccaagtttgaagggttcacaaaggtgtataaaactaataaggacaaggataacgtgctgccaaaccttgccgaaggcgatcaagttaagctggttaataataatccaaaccaacattttactcagccaccagcccgctatactgaagccgccttgatcaaggctttggaagaaaacggcgtcggtcgtccatctacctatgcaccaaccctggatacgattcaacgtcgctactacgttaagttagtctcccggcgtttcgaaccaacggagctaggagaaatcgtcaacgaaatcatttacgacttcttcccggacatcgttaacattgattttaccgctggcttagaaaaagaccttgattccattgaagagggtaaggaaaattggattaaggtagttgatcggtattacaagccgtttgctaaagaattggaaaaagcccaggggcaaattgaaaagattcaaattaaagacgaaccggccggctttaactgtgagatctgtggggcaccaatggtagttaaaatgggccgctacggtaaattctttgcttgtagccggttccctgactgtcgtaacacccaggcaattgttaaggaaattggggtaacctgtccacaatgccataaaggacagattatcgaacgcaaatccaagcgtggacgcgtattttacggttgctcgcgttacccagattgtgaatttgtctcttgggacaagccaattgcgcgggagtgtcccgtatgtcacagcttcttaattgaaaagaaaattaagggcggtaaacaaatcgtttgtccaaatcatgactacgaggaagaacctcaaaaatagcttaaaaaacaataaataaattgagtttccctccacaatttgctacagtgtcaattgttggaggtttttttatggactggatagagcaatttaaaaggtatttaaccgtggagcggcagtattctgataaaacggttacagcttatctggaagacttgcaagaatttcaaaagtttcttcagactaccggaaataaaccggagcttttagcagtggaccgttttgacgcgaacgtcttcatgagttacctctttgaccaaaatttaaaaagaacctcaatctcacgaaaagtctcgtctttacgtgctttttatcgttttttgataaaaaatgacgtgattgccaaaaacccttttgaatttgtgcaattaaaaaagcacgctgaccaccttccgcgttttttctatgaaaaagagatgaaccagctttttgatacggtttatcaagatcaaggcccgttacatttacgtaacgctgctttgttagaggtactttacggaaccgggatgcgggttagtgaatgtactaatttacgctggacggatattgacttttctatgcagaccatcctaattttaggaaagggaaataaggaacgttacgtgcccttcggtcgttatgctaagcatgcattagaggattaccgccaaaacgagtggtccggtctattggaaaagtatcaccaaactcatcaatacgtgttcgttaaccattatggacagccgattaccgtggctggagtggaatatgttttaaaccaaattatcaagaacagtagtttgaatggaaaaattcatccacatatgctccgccatagttttgcgaccgctatgttaaacaatggtgcagatttacgaaccgttcaggaactactagggcacgctagcctctcaacaacccaaatttatacgcacgttacaaaagaaaaattacaagagagctatcggaagtttttcccgcgctcgactaagtcttaatcttaatgaaggagaacattatgccagtaaaatttgacgcaacaaccataattgccattaatcacaatggagaaaacgccatggccggggatggtcaggttaccatgggtgaaaaattcatcatgaagggcactgcacgaaaagttcgcagaatttacgatggaaaagtcatcgtgggctttgcaggtagtgtagccgatgctttcaacctggaagaaaaatttgaaaagaaattatccgaatatagcggtaatttacaacgcgcttccgtcgaactggccaaaatttggcggggcgaccaacagttacaaaagctggaagccatgttgatcgtaatggatcaaaaggaaatgtacctggtttctggaagtggggaagtaatcgctccggacgatggaattttagccattggttcaggcggaaactttgctttagcagctgctaaggctttaaaacaacacgccaaggatatgaccgctaaagaaattgctaaaaccgcaatcaacgttgccggagatattgatattttcactaaccacaacgtaatcgccttagatttcaaggaggacaagtaagcaatgttaaaagagaacctaaccccgcaagaaattgttaatcaattagacgaatttgtaattggtcaaaaatcagctaagcgtgccgttgcggttgctttacggaatcgttaccggcgactccagctttctgccgacatgcaagaagacatcacccccaagaacctactaatgattggaccaaccggggtcggcaaaactgaaattgcccggcggttggccaaaatcgttaacgctccctttgtgaaggtcgaagcaactaagtttaccgaagttggttacgtcggacgggacgttgagtcgatggtgcgtgacttagttgaaaacgccgtgcatctagaagaagaacgagctttcaaagatgttcggatggaagctgctaagaatgcggatcaccgcatcgtcgaattacttgtaccggttccagaagatcctaaacaaaattcagcggtagacttccaaaacatgatgaacatgtttacgcaaatgcaacagggaaagacaccaactgattttcaaccaagtggccaaaatgtgccggatgacatcaaggaaaagcggatggacacggcaagcaagttagctaagggactccttgaaaacgagatggtcaccattgaaatggacgaccctaagcaaaataataataacaacatgatgaatcaaatgggcatcgaccttaacgaatcgttgagcgggctcttaccaaagaagaaaattagtcgaacggtacccgtgcgggaagctcgtgaaattttaattaaagaagagtccgacaaattagttaaccatggcgatctatatcataatgcaatccaacgggcggaaaataccgggatcatcttcattgacgaaattgataagattaccggttcaggacaaaacacttctagcgacgtgtcccgtcaaggggtgcaacgagacattttaccaattgtagaagggtctcaagttaacactaagtatggtttggtagacaccagccacatcctcttcatcggttcgggggcgtttcacgaaagcaagcctagcgatttaattgctgaattgcaggggcgtttcccaattcgggttgaactaaacgacctttctaaggacgactttgtcaagatccttaccgaaccaaagaatgcattggttaagcaatatattgccctaattggcacggataacgtgaaagttaccttcactatcgaagcaattgaacgaattgctgaaattgctgaacaagttaaccatgaaacggaaaacattggtgcgcggcgtttgcatactattctagaaaaactattggaagacatcctctttgaaggaccatcgatggaaatgggcgaagtaaccattaccgaaaaatacgttgatagtaagattggtagcatcgcaggtaacaaagacttgagcgagtttatcttgtaggaggcaatttttatggcggcagttttaaaaaataaatttttaacggtcacaattgatgaattaggtgcggagctaaccagcgttaagtctaacgacgaccaaattgagtacgtttggcaagccgatccccaaatctgggggagacatgctcccgttctctttccgttcgtgggtcgcttaaaagacgatcaatttaaggttaacggcatgcgttatccaatggggcaacacggttttgctcgcgacatgcgctttacggtgatttcagcaagtgacgaacaagtggtaatggaattaaagagtaccgcggaaacgcgcgaaaaattcccgtttgattttgatttacggttgcattttgaactacacgaccacgaactaaccgaatgttacgaagttcataatccggctgaaaaggccgacctctggtttgcaatcggcggtcacccgggatttaaccttaacctaggtgacccaaggatcgggatggcggaaagtcaaatgcggattgctcctaaaaaagttttcaagcaaattccgttacaagcaccttacacagatccaaaacatttgcaggatcttgatgctacgcagccaattgcgttaagtcacgagctcttcgctgaagatgcattaattcttgaccttcaacgaaagtcaacgaccgtaatgctagaaaatagtgttaatgaccatggggtcgcccttacagtggaagatgcgccttatctgggaatttggtccccatatcctgctgaaggagacttcgtttgtttggaaccttggtgggggattgcggataccgtagactttaatggcgaattgagtgaaaaattaggaatgaaccaattagccactggagagacgtttaaccaaagcttcacaatttcattcttctaaaaaacaaaacccctgaaactaagataagtttcaagggtttttagtttatcctttatgtttgaggcggtaatagatcccaaagggaaccaggttctcatttccgctcaagattcgactgatgttcgaacgatgacgataaataataaaactagttagcccaatggccactactgaaagcacccaatcatggtagaaaaacgaaataataacgagtaagactgccgaaacgatgctcgaaaaactaaccatgctggaaatgtagatgaaaccaacaaatagacagcaagcaatgatgaagtagctggggttgtacgctaacagcattcccgcactagtggctaccgctttaccaccacgaaattcgtcaaaaacggaaaaggtgtgccctaaaatggccgctaagccaataatgagggggttaaccgtggtaacatgaaaaacgatgggttgcaacgtagctaaagttccttttaaaaggtccattaacaaaactagtaatccaggtttaacgccgagaacccgaaacgtattggttgtcccggtgtttccgctaccttctttatgtaaatctttgttaaaatgtttggcgaccaacactcccgagggaatcgagcccaataagtaggcaatcaccaacatgattaaaatctttaacatgggacttcctcttttctaattaataatttaagtttcaataaattttagcacggtttttaacagtgataaaatttcagtcacaatgcagtattataacatttatcgaaatgttttcatcagattaaaaataagttatgataatagtactgaccttaaaggagtaacgtgaatggcaaaaacaggtaaaacaacatatgatgattcttccatccaggtgcttgaagggcttgaagccgttcgaaaacgccccggaatgtacatcggatccactgatggacgcggattacatcatctcgtttatgaaattgttgataatgcagtcgatgaagcgttagctgggtacggaaaagaaattaatgtcacaatccgcccagataacagtattacggtcgtggaccacggacgcggaatgccagttggaatgcataagtctggcaaaccgactgccgaagtaatctttaccgttttacacgccggaggaaaattcggccaaggcggttataagacttcgggaggattgcacggagtgggggcaagcgtggtaaacgcattgtctgaaaaactaacggtggaaatcgttcgggacaaaatgaaatacgaagaaaacttcgtgaatggcggacatccggtcggaacgctaaaaaaagtgggaaaaaccaaagaatctaacgggacgacggtaactttcaaaccggatccgacgatttttaccacgacggtttttaactttaataccttagcggttcgactacgtgaatctgccttcttactaaagggggttaagattacccttactgatgaacgtgcgggacatgaacaagctgaagagtatctttatgaagaagggattaaggagttcgtagaataccttaacgaagataaggatactctgggaaacatcatgtacttcgacggttctaaacacggcattgaagttgaaattgctggacaatataacgatggttactccgaaaccgtgttgtcattcgttaataacgtccgaactaaggatggtgggactcacgaagcagggatgcgttcgggatggaccaaggccttcaacgaatttgctcgaaaagttggacttttaaaggaaaaagataaaaacttggaaggctctgatgttcgagaaggtttgtcggcagtaatttcaattcgggttcctgaagaattacttgaatttgaaggtcaaaccaaagaaaaattgggaactcctgaagctcgtccaattgttgaagccgtggttagtgaacaactgggcttcttcttgatggaaaatggggaatttgctcaacaactagttcgtaaagcaatcaatgctcgcgatgcgcgagtggctgcgcgaaaagcacgggacgaatcccgtaccggcaaacgtcgcaaaaagcaagatcggattttatctggtaaactgactcctgctcaatccaaaaacgctaagaaaaatgagttgttccttgtcgagggggattctgcgggaggtagtgctaagcaaggccgtaaccgtaaattccaagcaatcctgccgcttcgtggtaaggttttgaacacggaaaaagctaagctacaagacatcgtaaaaaacgaagaaatcaacacgatcatttacaccattggcgctggagtaggccccgagtttaaggttgaagatagcaattatgacaaagtcattatcatgactgatgcggataccgatggagcccatatccagacactattgttgacgttcttttataaatatatgcgtccaatgatcgatgctggtaaaatttacatcgctttgccacccctttataagctacaaaagggcgctaataaaaagaccaagattgaatacgcgtggaccgatgaagagcttgaggaagttagcaaaaaaatgggccgcggtttttccttgcaacggtttaagggacttggtgaaatgaacgccgatcagctatgggaaaccaccatgaatccggatacccggaccttagtgcgggttcgaattgacgatgataccttagctgagcgccgggtaaccactttaatgggggataaggttgaaccacgtcggaagtggattgaaagcaacgtttccttcaccctcgaagaggatggtagcttgcttgataacgaagctgttaaagctgaacatgaatctaagccaactacccctaaaggaaaagaaaacgaaacgtttgaagaattaaaattagatttagaaaataactagagtaaaaggggaatccgaatggctgataatcaatcaaaaattcaagaattagcacttgaagatattatgggcgaccgttttggacggtattctaaatatatcatccaagaacgtgcgttacctgacgttcgcgatggcttaaagcccgtgcaacgacgcatcctctttgcaatgaataaagatggtaatactcatgataaagcctttcgtaaatcggctaaatcagtcggtaacgtaatgggtaattttcatccgcatggtgatagttccatctatgaagctttagtccgcatgagtcaaaactggaaactgcgagtgccgttaattgaaatgcatggtaacaatggttcgattgacaatgatccgccggccgcaatgcggtataccgaggcgcggttgagccaggcagccgaagaaatgctgcaagatatcgacaaagaaacggtcgacatggtgctaaacttcgatgatacggagtacgaacccaccgttctaccggctcgtttcccgaacctcttggtgaatggagcaacgggaatctctgctggttacgcgacggaaattcctccacacaacattggggaagtaattgacgccgttttatataccatcaaacatccggatccttcgttagaaaaattgatggaatttgttaaaggtcccgattttcccactggggggattgtccagggacgtgacggcttaaaacaagcttataagaccggtcgcggccgggtggtcgtccgttctcggacagccattgagcaattgcgcggtagcaaacagcaaattcgaatcacggaaattccttacgaagttaataaagcgcaactagttaaaaaaattgatgaaattcgggtaatgaaaaagattgatgggattgctgaagtacgtgacgaatccgaccgtgaaggtttatcaatcgcaattgaattaaagaaggacgttgatgcccaaggggtgctcaactatctattaaagaacaccgacttacaggtttcttataatttcaacatggtcgcaatcaataagttacgtcccgaacgaatggggcttaagcccatcattcaagcttacgtggacttccaaaaagaagtaatcactaagcgaacgcaatttaatttgcaaaaggcagaggcccgtttacacattgttgacggcttgattaaggccctttcaattctggatcaagtaatcaaaactatccggggtagtaaggataaaaaggatgctaagcacaacttggtggaacggtttgactttagtgaaaagcaagccgaatcaatcgtttccttgcaactttatcgtttgactaataccgacgtaacggagctaaagacggaagctcagcaattaaacgaatcaattgccgagtttaaccaaattcttaacgatccagctaagttatcacgggtattatcagcagaattgcggaaggttaaaaagcaatatgccacaccgcgcttatcagaaattcaggacgaaattgaagaaattaagattgatcgcacggttaccgtaccggaagaacaagtgatggtgttagttagccaagccggttatctaaaacgcagcagcttgcgttcttataaagcgtctgcggatgaagatggccttaaagatggcgaccaacccgttttcaaacataaattgagcaccttagatcatctgttgatgtttactaataaaggcaatttgatttaccggccggtatatgaaattaccgaagcgcgttggaaagatactggggaacatgtttcacagacaattgggctagctgacgatgaaattatcttaaaggcctatgatgtcaaaaactttaaacaaccaattaacttcttaatcgcgacggacgatggatacattaagcaaactgctttgcaagatttgaaaccagggcgaacctatcgtaaaaaagccattacctacgctaagctgaaaaagcaaggtgctaaggtagttaacgttgtgcaagtagatcctaaaactgctccagcaaccattctattagcgagtgaacatggttatggtttacgctacgacttagttgaaattccaaccgtaggaccccgggctgccggcgttaaatcaatggacttgagggatgatcaggtagctaactttgtgctagttaacgatgaagaccagattggcttaataactaaccgcggttccttcaagcggatgaaggttagtgaaattagcgtaacgagtcgagctcggcgcggagtacaaattttgcgtgaacttaagaaagaacctcaccgggtggttgatgttacggtagttaacgaacaccaagcctttgaagttctaacttcccgcggcttagttcatgacattctgccgatggaacatccgttaaatgaacgttattccaacggtagttttgtgatcgatattgactccgagggtaatccgctttcaatgcgcttgaaaacattggatccagcagtcaacgaagcgaaataaagcgattaccccttgctctttacagggagtaatattaaacttaattataatgattattagacgattaagcttaatgaaactcgaggtgtacgaacatgcggactaaacaagaaaagatcttttcttcaaaagcgttgacatattttttgcaactttcagatacgatgaactatacgcaagctgcacaaattctagggattacgcaacctgcgcttacccagcaaattaaaaagctagagcacaccattggagcgccgctattttattcggtagggaaaaaattgcggttgaccgatgccggatacacaatgttaagtgctagtcatgaaattaaccgtgtcttgaataatgcaactgacgaaattcaacagtcgtcaaatgcaagtcaaggtgaaatttcaattggaattttatcctcgattgagacccaaattttcgaagattttattgcgcactattaccaaaaggaacccggaattaaaatcattgtccacatgctgactagaaaagaaatttgggaaaatctagaaaataataaagtggatctagcaattatgtatttgccagatgacagtattaaaaactggaaaccataccagtcccgcaaaatcacgagtgaaagcttagtttttattcatcatgatgaaaaaatcgctcgccaaaagcggatcaagttgcaaaaaacaatcaactataattgggtaacttaccctgaagaattctatttagatggggtaatcaaagaggcttataaaaatgccttagttaaccgcccgcatagtgtcgcttgctttaccactcccgaccagattcggcattttgtgaacgcgaccgacgtggtaaccgcgttgccagaatcatacgtaatggctcacccacgtaaaaagggagtctttacggctaagttggatccggtaatttcgtttgatttagactttgtctttagaagagataaagatagcattccgagaattgaaagctttttgaatgaatttgaggcatacttagccaaaaaagggtatactgaaagattagaagagataactaataatagattaaaggagcattcagataatgactaaacaacttatttttggacattctaaccctgatacagatgccattgttgcggcaaaggcatttgcatattaccaaactcaaatgggcgtaaaggacgttgaagccgttgcattaggtaaccctaatccagaaacggaatacgttttaaatcactttaacgaaccagctcctcgggtagttgagaccgtggctaacgaagtggactctgtaatgttagtagaccacaatgaaaagcaacaaagtgcacaagatgtagaccaagttacggtaacggccgtagttgatcaccaccggattgctaactttgaaactgctcaaccactattctaccgtgctgaaccagtaggctgcacaagcaccatcttaaccaagatgtttaaagaagcagggattgaaattccagctaagattgctgggctaatgctttcagcaattatttccgatacgcttttacttaagtcaccaaccactacggatgacgaccgtaaggctgtagaaactttagctaagattgctgacgttaacgttgaagaatacggtttggcgatgctaaaagcaggcactgatttatcaagcaagagtgaacttgaactggttgatggcgacgcaaagagcttcgacatgggcggtaagaaagttcgcattggccaagtaaacaccgttgatttggacgacgtgttcgctcgtgaagatgccttagttaagacaatggaagacgaaaaccaaaagaacggttacgacatgttcttactattggcaactaacattttgacaagcgattcgcgtctattagtagttggcgaacctaaggaaatggttgaaaaggcctttgacgttaagttaagtgaccataacactgccgaccttcctggggttgtatcccggaagaagcaagtggtaccaccactcatgaaggcttttgaataatcatcaataaaaatcttattgaacaggctcggaaatctaattttccggcctgttttttaatatctggttatgattatgcgataaaatcttgctagcacgcttttacgcctagaaaagtgggcttactttggataagcgacggttttagttataataaaggtgttgttattcgaaaggagatccataagcagtaatggaaaatcaagcagtcttaccaacccaaattaacgtacgtggagggcgtgtccataatttaaaaaatattgacgtggacattcctttacaccaatttgtcgcaatttcgggcctttcgggatccgggaagagctcgttagccatgggaatcctttatgaggaaggctctcggcgatatttggaagccctgtcgacctacacaagaagacggattaaactaggctcacaggcggacgttactagcgtagaacatattccatccgctttggcgcttcggcaacgaccgagcgttccgtccgaaagggccacggttgggacgatgagcgaaaccttaaatgtaattcggttaattttttctcgtttaggttcgcctgtttgccccaatggtcaccgagtaaagcccagcttagcgattgctcaaacaatgagtgaaagtggcgatgcaatgggtagaatcacctgtcccgtttgtggagtcgccttttacgttcctagtgcggagcaattttccttcaatagtgacggagcttgcgagcgttgccaggggactggaaaagtccggcaactggacgaagataaattaatcggtgatcctaaccttagtgttgctgatggtgcagtcgcgtcctggcaccttccaggaagaaactttatgcccaaggttgccgaacaggccggcgtccgaattaacgtgccttacaaagaattgactgctaaagaaaaggactttatcttaaacggtccccagaaaaaataccggatggactttcgttcgggaaccggccgggttttccatgattttaacgctttatacgaaaatgcgcaccaggccgtgctcgaatcagctaaaacgagcaaaagcgaacgggcgcaggctcggataagtcaattttttaactattcgacttgtcccgtctgtcacggaagccggttgaaaccggaattaatgcagcagacgaccggcggaaaaaacattgccgaagtttctgaccttgccttaggcgacttaaattcctggatggaaaaggtcctcgcagaacttcccgcgtatatgcaaaagatggcggatagtttgtttgccgaatttagccataacttacgtcctttactcgatctaggtttagattatctaaccctttcaagaaacggtaatagtctttcgacaggggagctacaacgaatccaattagcacgaactttacgtacaaagactacgggagtcttatacgtgttggatgaaccttccattggtttgcatcccgataacgttagtggtttgctaaaagtttttcgggaattggttgatcaaggaaattcattggtggtcgttgaccataatttagccgttatccgcgctgctgatcaaattattgaaattggccccggttctggtcaggaaggcggctatattttgaatcaaggcactccagcagaattggccgaagatcccgattccttgattggcccttacttgaagggaacggcaatgattcacgtccggaaaatcaataatcagggccctgctaaattaatcgattttaccgttaaagactactacaatttacaaaatgtgcgggctaaaatccccgtcaaccggcttaccacggttaccggattttccggcgcagggaagaccagcttaatcctagatagtttagtcccagcaattaccgcgcaatctcaaaaacgtagtctccctaaacaagtaacgcagctaaaaactccgttaaaaaagatagtcagcgtcaacgccgaaccaattggcaaaagtgttcgatcaacggttgccacgtatactaatatcatgaacaatttacgtaaactatatgctagccaacctgcagccaaaaaacgaaagtacacggcaagctacttctcctacaataacaagcagggcgcctgcccgacttgcggtgggacgggaagcattactttagacattcagtttttaccagacatgcaacaagtctgcccaacttgtcatggagaacggtacaatcctgaaattcagcaaattaaatggcacgatttgtcgattgtggacgttttaaacttagacgtaaaatcagcgattgccgtctttaaggacgaacccaagattcaacaagacttgcaaaacttaatggaagtcgggttgggatacttacatttgggtgaaaacactcctagcttatcgggcggggaagcgcaacgcttaaaactagtgaagcatcttaatcagcaacaagtcaacaccctatttgtttttgacgaaccaaccattggattacatcctttagacgtccgcgtacttctacaagtcatgcaacgtttgctggatcgacaggcaaccattattgtgattacccacgatctcgatttaatggtaaatgcggattacttaattgatttaggccctactggtggtcaaaacggtggcaagcttgttgcaaccggtcagcctggtgaattaattaaagaccctcaaagtctcaccacccaatatttggcaaattattggcgccgttttaagaacacagcaaaagattaataattattatgtggttcttcgctaccaaagctcactgaagggtgaggatctggtaacggagagcctttttatatatttgctaagttaagcgtttacttttgaaaaggaggttattttactttgtgattagctgtataatgttatgtgaattgattgacaagaaaggagtatttcatgcatttattaccatggtgggcagcgctagtggggttagccgttgccattatccttattctcaagaaattaaaccccgtttattcgttaatgttgggggcaattttaggttgtttgctaggtggagcagggcttagccaaaccattaacgtcctcattcaaggttcgcaaagcgttatgggaactgtgttacgggtaattgcagccggaatgcttgccggggtgatgatggaatccggcgcagcggatgtgatcgctaagaccattgttaacaaactgggggatcagttagcgctatttagtttagcattagcgacaatggtaattacgggagtgggagtctttattccagttgccgtcttaatcgttgcgccgattgcgcttgaagttggccaacgtatgcatatttcaaaattggcgctcttagttgccctttccggaggcggcaaagccggaaacattatttcaccaaatcccaattcgattgctgcagcaaaagggtttggcgttaatctaagtcagatcatgattgcagactttattcccagcgtcgttggtttaattgtggcagttttagtggcttcctttttgaaacatcgcgggagtgcggtcttagatacggatattgcaaatttaactaagcctaagcaacctacggagttgccatcattggccacagccttggtaaccccgattttagcgattgttttgttgctactaaatccgttaagttcacttttacatattcacggtttaactaatttaaatttggatgccacctacgtgcttccctttgctgccgtagttgggacgttagcaatgcgaaagggacggcaattaaaggcttacgctcaatctggaattgcccgaatgaccgacgtagtcatgattttaatcggggcaggaatgattggcgcgttaattaccacgtctagtttgccaaataaaattattgaattaatcaaaatcagccacgtttctggaattttcttggcgccgttagctggaattttaatggcggcagcaactgcttcaacgtcgacgggggttatcttagccacaggctcctttagtaaggccatcttaggttttggggtaagtccgttaggcgctgctgcgatggtacatactggggcgacggtaattgatcacttgccacacgggaattactttcacgttacggccaatgccatgcatatggaaattaaggaacgttctcgttcaattatctatgaaaccttggtcggattgtcaatgaccatcgttgcaaccttaatgtatggattcttttaataaaggagtagaataatgaaatttgtgattgcaccagattcatttaaaaatggaatgacggctaaacaagccgctaacgccattaaaacgggacttaaaagaattttcccggaagcgacttatacactcgttcccatggcagacggtggtgaaggaaccgtacaatctttagttgacgctactaagggacggctgttgactgctgaagttaccggtccacttggtaagcccgtaaacgccacttatggaattttaggtgaccagcataccggcgtgattgaaatgtcgcaagccagtggaatccaatacgttactaaaaccactcggaacccattaaaaacaactactttcgggacgggcgaactgattttaaaggcacttgatcaaggagttgatcggttaatcattggcatcggtggcagtgccactaacgatggtggtgccggaatggcccaagctcttggagcagagttgctagacgatggtggtcaagctattcaactaggcgggggcaatttaaatcaacttaagcaaattaaggttaaccaaatcgatcctcgaatcaaaaaaacgaaaattatcatcgcctcagacgttactaatcccttaattggtaaacaaggcgcatcggcggtttttggtccccaaaagggcgcaactcccgagatggttcaacttctggatcaaaaccttactcattatgcaaaagtcttacagcgcgatttagggcttgatttagctaatcgccctggtgcgggtgcggcaggcggtttaggtgccgggctagtagcatttactaacgcaaccatgaaaaaagggatcaacatcgtaatcgaatacagcggattaaaaaataaggcgcaaaatgcggactacgtatttaccggagaagggggaatcgattttcaaactaagtatggcaaaactccctatggggtggcattaaccactaaggcagttgctccagatgcgccggtgattgtaattgctggtaacgtcggcaagggaattgatgaattatacgcagacaactcaattgacgcaatttttacaagtgtatccggagttaagtcgctacgcgaagctttggcaactggtcctcatgatgttgcccaagttgcggagaatatcgctcggttaatcaagaaaggaattggttcggtcaaataagaccccttttatcccataatttacgggcaagccaattatttgcttttgaaaatattcagcttataatgtagccacaatgatcgaagatctaattctattttaatcttccaattgtatatttagggggttaattaaacaaaattacccataaatatgtatttatattcattttagtggttaggagtgctgcaaatggagaacaaaaaactttctaaagccgagctaaaagaaaagcttagtcctgaagaatatgcggtgacgcaagaagcggctacagaacgtccctttagcgggaaatatgataacttctatgaaaaaggagtttacgttgacgtagtcagtggggaaccattatttagctctaccgctaaatatgacgctcactgtggatggccagcctttagccaaccaattgaccctcagttagtttccgaacaccgggaccaatcctggggaatggaacgtgtggaagtgcgcagcaaacaagctgactcccatttaggacacgtgtttttggatggtccacaagaagctggaggcgtgcgttattgtattaattcggcagcgctgaagttcatcccgtacgatgaattggaagagcatcacctcggctatttgaaaaaaatctttgataaagaagggtaacttatgacatcaacagctatttttgcgggcggatgtttctggtgtatggtcgaaccatttgaaacgcagcctggaatcttaaacgtcgtttctggttatactgggggacatgtaccaaatcccacttatgaacaggtagcttcgcacaccaccggccatactgaagcggtccagatcacttttgatcctgaaactatttcttatcgggagttagtagaaatatattggcaacaaacggaccctacagacgcgatggggcaatttcaagaccgaggggacagctatcgaccggtaatttacgttaacagcgaagaacagcgccagattgcgttggcttcccgtaaagcactcgcggaatcaggtagatttgacgaaccgatcgtcactaccattgaggatgcccaaccgttttatccggcggaagaagaacaccagcaattttataaaaagaatccgcggagataccaaattgaagaggctggtgggcgaagtcaatttaaacaaacccattggcaataaaaatgggcaacaaaaaaatcgtaagtttcaagcaaatgcttgaacttacgatttttatttattaaatattcttattcttttcacgtctaaccaagaatgcccaagcaattagaccgaagaataacggtcctgccaccgtccacaatccggtaaacaagtctccggaaatgaacggtgaaattgcggtaaagacaattccgacgccgacggtaattaacactaccgtaacgatggttagcatccaaggccgactgcggtaaacttcaaatggccgatcaaggtcttttttagccttgaagaatggaaatgctcctactaagaagatgtatggcaaagtagttgaaacgttactcatggaagtcaacacgttgtagaagaaagtggcttctttgtgagtaattgaagctaaaatagaaattccagcgataaatacgctaactacgattgcttgtaaccacattgagttagcaggcatgccgtttttgtttagttcggtcattttctttggccacaattctttaggtgaacctaagatgaatgattttaatggtgagtaacttaaaacgaagaaggaaccaacgtaagctaacagcattcctaaaccagagaatcttgagaaggccgttcctaacgcaactgcagctgaactactcaagcccattgctttacctaattctaatcctaagttctgcatcattacgtacgtgatattacctaagttagctttttgttccaaaattacggtgtgccagtttgctgaaactccccagaggaagatcgcaaatgagtaacctaccgcgattacgatcccaccgatcataacccctttagggaaggtcttttcaggcttatctaaactatcagtgattccccccatggattccaaaccaccgtaagcgaagatcgcgtaaattacgaaggaaatcatcgcgatggggttttggaattgggcacttggcgaagttgcaaaatcacttaaatgattgattggttgagccaagtgaccgtggttagcgattaaaatgaacacactagctaatagtaagattacgttcattgccattacggctaaaccacctaatgaggaaacctttgccaaagtattaattcctcgagaagcggcccaagttacaaatactacccatagaatggcgagtaatccaatcgtcatggttgaattcattccaaatagtgaccagctaccagtagtatcgtgaccagaaatgatggttgccaaggtaatccaaatcttttgtgcgatcattaccatccaaatgatccatgaagctaaccacataaatgtggcgatgaaggcccatttttcaccgatggattgttccaaccaggagtaaaggccccccttagcttccttaaaggttgccccgtattccgcaaacattaagccagcgggaataaagaataaaattgcacctaaaatgtaccaaaaaattgctccgtaacccatttgctggaaagcagtaggggtattaccaaaaccaaagatggtggtaaatatcatcaaaactaaagcgccgagcgatagttttttcttttgttcacccatattgaatatcttctcctaacttttccttttatgaataaaaataaattaaatatgagtataattgtagcagaaaaaaaagtcaatagaatgtatgtaattaaattttaatcttttatgaactgaaatctaatttttgggataatttttttaattcgaacgattaaattcccctttaattctccgagttgacatattttgtggctcccaaaaaggattttacgacttaatcataaaagagacctcgcgtttagcattaattcaatttttaaattaacctatcaacgggccgttaccaaggcttccactgtttaacatatttttttactgatgcagcatagtttttagggaatatttttaatggtattattataactattaactaggattggatgtgagtttcgttgggaaagattagaattaacaacatgcagttttatacttacaacggtgttttaccggaagaaaagaagctagggcaaaaaatcgaaattgatgccgagctaacttatccaattgaagaacgagttaaacatgacgatttaaccgaaacggttagttattcggccgtttataaaacggtcgaagaatttgttttaactcataactatgacttgatcgaaagcgttgctaatcacctattagaattgattttacgtgagtatccaagtcttcaagccgtgcggttgaaaattagaaaatacagcgtcccgattaacggacattttgataacgtagaaatagaagtgagtggtcaacagaatggttaatacggcttatttaagcattggcagtaatataggggatcgtaaaaagaatttagaattagcaattgagaagttaaatcaggtggctcaggttagccgactttcccatatttatgaaactgaaccggtgggtggcgtcaaacaggatgattttcttaacatggcgattcaagttaagacttcgaagagtgcttatgagctattagatgatttgcacgcgattgagaaagctttaaaacgtaaacgaatcatccactggggtccgaggacgattgatttagacatcttattttttaataacgatcatgtgtcttctccggaattaacgattccccatccggagattccaaatcggcgttttgttttaattccgatgttggaagtcagtcaggacgatcctaaacttcatcaagcaatccaagctttacttgatgcaacttcggacaaaaatatggtcagaatatatgattcaggaagtgaaaacattgaacctacccaaaattgaaaaagcagtcagtgatttattagaaggaattggggaagatccccaacgagaaggtttggtggaaacgcctaaaagagtggcgaaagcttatgcagaactttttgcgggactaaaccaccaggcgaccgattttaccgattataagatctttcacgtagacgaagagcctgaaatggttttagttcaaaagattccgttttattcggtatgcgagcaccatctattaccattttttggtaacgtcaacgtcgcttacgtccctaaggatggcaaagtcattgggattagcaaaattccccggttggttgactttgttgttaaacggcccggaatgcaagaaaaagtaactacccaaattagcaccgaattagctaacatcttagatcctcaaggggtcgcagttaccgtgtcagcacggcatttatgtatggaaatgcgtggcattaaccaatcaaacttgtttacctatacttcaaaaatgaccggggtttttaaaacggatcaagctttaagggctaactttttccagcaggtcggacaacaaaatgcctaaaacaacttacgaagaattaattcgaaaattaaaccataacatgctggttagccaccaagatcgcattccattactaaaaacagtcctcgcagccttaggacatcctgatttaaattatcgaatcatccacttagcggggaccaacgggaagggttctacaggcgctatgcttgcaaaaagtctcgaaaacgcgggctatcgggtgggccatttttccagcccggcaatgattgaccagcgcgaacaaattcaaattaacggctcgatgattgaaaaagaagcttttgtggctttatacgaaaaaatcacgcaaaaacttccctcagctatcgcaccggcaagtatttcaatctttgaatggtttacgttgattatgttggaatattttgctgaaaatggtgtggagtgggcaattatcgaagcaggactcggtggcgaaaatgacgcaaccaacattattgaacatcccgcagcggtcgttttcacccacattgattacgaccacgtacaaattttaggcgataccttagaacaaattgcgcaaaataaggcgggaattatcaaaaaagatgcaaccgtctttatcgctcccaaacaaacgcagcaggtgcggacaatccttgaaaaaaaggcggttcaaaaacgtgccacttcggtaattcaagcagttccgggaacaattcaagtgataaagcgctcgataactgggttcaaagttagtctgcatgccaagaccactaacattgcagcaacgacgtttaaattgctgggcgattaccaaattgataatttaacgaccgtggtaacagtttacgaatggctgtttaatcagcaagtgattaatgattggcaaccactaatcgaaatgatgcagcatattcagattccgggtagatttcaagttttgcaacgggatccgttggttattttagacggggctcataacgtggacggtactcaagccctgcttaagggattgtccaatttgaacgccaatcacaaattattttttattttaggcttcttaaaagacaaagattactcaggaatgttgcacttgtatgctaaagcggccgatcggatttttgcggttcaaccagacaatccatcccgagcactacgtccgacaacgattcagaccatgttagacaataaagtcgtgggtagttatcgtgacctatataccgctttgcaacaggctttaacattagctgatgcagatacgacaattgtagttaccggttcattttatttgatcaaggagctggaggtaccgaatgtttccaatgccaactaactttataattgcttccaataatagaaataaaactagggaactgattcagatttttgaatggtttgggcagcaggcaatttcgtaccagtctttgctagggcgagttgattttcctaaggaaggtaccataagttattccgaaaatgcgcttaccaaggccaactggattgctcaaaaacttccgggaaagtggatcgtggctgacgatactgggatgatgttagaagcgtgcccccaaagtttaggaatcactacttcgcgagatttacacatggaccaaactacggattcggcgttgaaccaagaaattttaaagatggttgccaatcaaagtagggaagtaaccatgcagtctactttggtggcggtaaaccaacctcacgtccttaaggcaaccggtaaatttgttggtcaaattagtgccgaaccccgcggaaacaatgggaaaagttttgatttaatattggaagttccggaaaaaaacgctacgctagcggaactgcctaacgacgaaaaaataccgctattgcatcggacaaaggcggttcagaatttattggacagctactttatataaaggaatcagttatgaaaatctacgaacagcatttacaatttagcagtcaattggaaaataaaatatgggatgacctgcttaaccggcagcattatttagcgttaaaggtaattgctgatgacgctgcgaagttaaggttgttagccaaactattagaccagatggatttaattcatacagtggaggggctaagagtagacctacttttaccacgggttaacttagccctttttaaggaaaaattgacggaaatttttaatgacccgagtttagaccaacaaatgaacgatctaaatcaaaagtaccgggtgctgtggcaagctggtcgctttgaatttaaccttactgaacgtcccgtaatctatgggatcttaaatgttactcccgattctttttacgatggcggctggtatcaaagtgaaaccgcaatcttaaaacgggtgtctgaaatggttgacgctggagtagacgttatcgaagttggtggccaaactactcggccaggctttgtagaaattcccccggaggaagagctcaaacgagttactcaggtactcgacctaattcaaaagaactttagtcaagtggcagtagcgattgatacttataaatacgcggtaatggaacgggtgatcgattatatcgatatcattaatgacgtcaacgcctttaccgatgaccaacgaaagctggcactgatgcgtaattctaatattggactgctaacgatgcacagcgcgcgtaataaagattacgataaccttacggcagaaatgaaggcgttctttgaagaaaatattgccacgctagttcaaaacggaattaatattaatcgaattgcgttagatcaggggattggttacgcgaaaaaagcggatggctaccaagactacgcgatgatgaacaatatcgaccagtttaattacctaaaccggcccatgatgattgccatttcgagaaaagggtttggggctaaattattcgggttaccaaaagaagaccggctcccggtaacgctggtggctgaggcatatatgtatctgcatggtggccggattttacgagtccacgacattgccgaaacggttcaactagctaaaatgttggacgtcatccaaaatgggtattggtttggtagttagctttaaccacactaaatgatgagtaattggataaaaatcttaaaaagctatttcagtgagggtgagacaaaagttagtttgtttcgcgctcttttttatttaataaagttgggaagatttaaaaagcggaaggaaatgtgatcagccggaacaaaatgatataatcggatacgtaattaagtaggggatctgcaacccccgaaaaattgccgccgtttgagtttttatatggcacccctcaaaaaatccagaggcgtggaggtgtcagatatgaataacttgaaagggattgttaatggcgtgggcgcttgctttctacgcggtatgccggggcattttgcttctggctaaagcttacgagataataaaaaaagctaatcacattaagtaattagctcgcacattaaaacccatcggcgtggcaagggaggcaccccttgtcttttctattataatatcatcaatcaaattaaaatcaagcaaaggaagcgtgagttaaatgccaagtatcattaccggagctttaatatttttagggctatcttatttagtattttttggcgctcaggtgtaccatcgggttaaaactggacattgggagaaataaaaatacaaagtttgtttagttgtatttgactaaacttttattaaagagtaaactctgtttcgaaaactgaatagatttcttcggggcagggtgtaattcccgaccgacggtgacaactcagtgttgaagtccgtgacccgctttttttgcggttgacctagtgcaagtctaggaccgacagtatagtctggatgggagaagaaaaaacgcgaaaatttcgtactctttttgtatgctttttggcatactctcgtatgaaatctttttggctatcaaaaatccgccccacactttatagtgcggggctttttatatggggtgattttgattactaaacaagattttatggatttagcttttaaattagctttgaaaggaaagggcaaaacgtggaccaacccattagttggggctgttatcgttaagaacggtgaaattttagctacgggatatcatcatcaattcggtaaagagcacgcggagattgatgcgttaaaccggttagaaaacatcaacgcagcctttggcgccacaatgtatgtgagtatggaaccgtgcagccactttggcaaaacccctccttgtgcgactaggctagttgaggttggtattaaaaaagttgtcattggccagctggatcctaatccattagtgtcaggtaagggagtttcgattttaaaaaatgcggggattgaagtaacaaatttaaatttgaaattaccagaaaatttaaaatataacttttactataaccgtggccggccgtacattaccgttaaatatgctatgacattagatggaaaaattaatcgccaatctaatctgagaagctttatcactgggaatgaagttttcgcggatagtcaacagttacgccttacaaatcaagctattttggtgggcgaaaatacagcattgactgataatccatcgctgtctgttagaaatataaatacgccttaccaaccttggcgagtcgttgtagctaataatgccgaccagctgccaaacaatttaaaaatatttcaagatcatttaaaaacaattgtactttcccggacggttacaaagaagagatggcctaaaggaattaacatcgttatcgattctaaatggaatcctaaaaaaattgcagaatatttagctaaaattggggtccagagtcttttaatcgaaggtggtagtcacttacatgctgaatttatagctagcaatcttgttgacgaaattattgtttatgtagcgcccaaaatctttggcggtcaaggattaccagctgttcagggaaaagctgcacaatcatcgaattttcagttagtcagccgagaattcattgggttagatacgaagtttaagttaaggagaatgtaaatgtttacagggattattaatgattatggggcggttgctcaaattgatcgacatcaaaactcttctaaaataaaaattactacttcattagtaaaagagattaatagcaaaatcggagatagtatcgcggtaaacggagtatgtttaacaatcacaagaatttttacggacggatttcaagtagatgttatgcccgagactactaaaagaaccgcatttaacaggtttagagttggcacaaaagtaaatcttgaacctgcgcttttgccaactgatcgaatagatggtcattttgttttaggacatgtggacactacggctactttgattaaaaagaccgtcgacgacaacgccatagattttgaattcactatcggtaatgatttcaaacaatacatcgtggaaaagggatcgattgctctagatggcgtcagcttaactattgtaaaagttattgaaaaccattttatcgttagcttgataccgcacacaattaaaaaaactacttttaaaaacttaaagattggaaatcaagtaaatgtcgagactgatattttaggcaagtatattcttagcaaaaagagggattttaatgattaaaaaagacgtacttacgcgagtagaagaagctcttcaggttttaaaaaaagggcaattaattatcgttgctgatgatgttgaacgtgaaggagaaggtgatatggtggggctagctgaacatgttacccctgaaaacgtaaattccatgatttctcatgcacgcgggttattatgcgttccaatgagtttagatttagctaaaaaattaggcctccattcgatgactgacgactcaacggatgcgttcggtactgcttttactgttagtactgatgctaaaagtaccacaactggcatttcagcgtatgatcgcgctaaaactattaaacaattagttgatccactatcaaagtatgatgatttttatcatccaggccatatattcccgctaattgctaaaaagggtggtgtgttagaacgaccaggacacactgaagccgctgttgatttagctaaacttgctaatagcactccagccgcttatatcatggaaatcttgaaaaaaaacggtaagatggccagaaaaaaagatctcaagtcactagcagaagggttgcagatgcctttaattacggtaaaagaaatcaagtactaccgattattaaaagatcagcaactcgttaaaagcgtcgcaaaagttaatttgccaactaaatatggaaattttaatttagaagcatttgaaaccccaaatagccaagagcctactttattaatatctaaaggccagctaaaacacgcggattcgctactattacggttgcattcggaatgccttaccggggatgtttttggttcattacgatgtgactgcggagatcagttaatagctagtttacagcaaattgaaaaaaagggctcaggagctgttttatatttgcgtcaggaaggccgtggaattgggttaaccaataaattaaaggcttatatgttacaagaagccggactagacactgtagatgctaatttaaagctgggatttcaagctgatgaacgaaaatatgacattgctgcagctatcttgaaacaaaaggggatttctaaagttgagttgttaactaataatcccgataaaattacccaattaactaaatatggaattcatatagagaagaggattccgcttgaaatgaatcctaatgataataatttgagttatttaaaaacaaaaaaacaaaaaatgcatcatttgcttacggaggtttgatagtatgagagaagcttacggaaaacttaatggtaaaggtaaaaaaattggtattgttgttgctaagtttaatgagttagtaactagaaaattattagatggagctaaacaaggtttagaacagctgggagtggaagctaataatataatagtttattgggttccaggagcctttgaaatcccacgggtagtcaagctattaagtaattcgggtaaagtagacggcataatttcattaggtgctgtaattcgcggtgaaacttctcattatgattacgtatgtaacgaagtttcgagtggaattagtcaggtaagcttaaataacaaagttccagtaatgtttgggatactaacgactgatagtatgaatcaagccttggatagggcaggaggcaaatcgggtaataaaggaattgaatgtgctagtggtgtcatagaaatgattaatttagaaaatgaattaaaattaaataaataacctattgttataaggtaataatcaaaaacagccctgataaccatctttggttaccagggctgtttttatatctaatcaagtattttttctaaaaacgcagtgtgttcttctggagatgcagtttccacgtttccaaaatgcagccagttaactttatcaggcgtaatcccaacggatcctaaggtgccattaataaacagtccttgaattggatcaccgctagcttttaaaatttccttagtcatggaagccgtggtaatgacggttactttcttaatattggttaagagtcccgtccaggtgccttgctcgtcgacttggtaagcaaattttttcaacatcactttgtcaaagaagccctttaaaattcctggcaagtagaaccaccaaattggaaagatgaagaccaaatctgaagaatctttgatcattttttgatactctttaacctttagataaggagtatctccagcattgaacatgctcagttcttcagcggaaaaagtagggttgaattgatccttatacaaatcgattacttggtaatcctcatgtttttggtcaaatttctttttcacattttcaagaattgcgtgattaaaactgccttcccagggatgtacgtaaatgatagttttcatgaaatgtcgccttcctttttatttatatcctaagtgtatcccttgaaagcgctttattcaatagagggtattgtttttattttatgttttaaatgtcaactaggcattcatttgtataaagcttagaattcaaaaatcatctaccgtatttagtctaatataaaaagaccatccccgaacaatatccaaaattataagccgtaaaaaaggtaacttaggagcacgcaaggtacttactaattaatccatttgcttaataatttgtatatcctcagttgatggtctttcattaaccaaatcaatagctaatcattattatttttaaacgaattaggctttactgattattaaacctaagccaataaaccagggtcatgatcccaactactataaaaatataaattggtaaaatgccgacccagccggtgtggaacacgctaattagataggttagaaaactaatcactaggtaataagcaaagctaaaaattccactagccaccccaataattttttcataacctactaaagcaaggtttaaggaaagggggagtacagtatataaacctaagaaaacaataaaggtaccagcaataaatccgattactgaatcttgtaaaaccgttagaaacataaatagtccgccaaataaagaaaaaatcaaacctaatttaataatcttagtgggcgaccagattaagactaacttgttaaccattatggcaccaatgatgctggacagggcaattataatacctatgattccatattggactggtgagaaacgaaaatgatcaataaaaataaacggagcttccgcgtagaaactaaataaaattccgttaattccgctgatcaataaaccataggccaatacattacgatctgtaaaaagacgccgaactaccgcaatcaaagaaattttgggccctttaacaccgattgccggattggtttctggcaaccgcgccccggtataaattatcaatgaaactgcaatagcaattagcacaccaaaaacgctgcggtagccaaagtaagtttgggcgtatccaccaagcaggggaccaatcgcaggggagagggctagggccgcacctacgttagcgaaaaccttagctcccttacttcctgagaaactttctcgcatgattgtctgggtcactaccgatcccacgctagctccaaaagattggatcaatctaaagaaaattatcgctagaaaattaggcgcaaaaaatagtccgacgttgccgacaaggtagactaataagccttctaacattgcaggtttgcggcccttggtatccgaacgcttaccccaaaataatacccccaccgcaaaagcaataaagtaagtgctcattactaactgaccagtccgatctgctacatttaaattagcgctcaaggcagggagaacgggagtgaagatggattcactaatttgtgggaagcccactaatgcgataataatcattaaagatggaacttgtttttggacgtttttcatttttatacttcctttatttattattttttaagaaaaacgtcctaatttaattactgtcacacatgcgataaagtctttatattcgattatttaaaccttctttctacacttatcttcccattttgcatatctttactagggtaacaattaattattttacatgcaacagtcgcccattaccgtgagcgaacctcttgaagaataactttataaatactaaaaagcataatcaaaaaagtgtttttttagtcactctttttatataatttagtcgggatttaacagggaaggtccctttcccaaaattattactattaaccgtcaagaaaaaatataaataattagttaagtgtttggtttgcgttagttttatttgtaaatataaagtatgatgaaaccataacagggtactctgttttaattgaatacatttgttaggtgaggctcctatacaaacataggctgctgcccaaaaatgtcgagagacactaatgggtagaacaggaattgtcgaattcaaggcttttcttaaggtagctaaaattggaaaatttttacgttgtatagtgctaaagctcaacgaatagatcagcgtttacttactataaactaaatgcggctttttgctgagcttcggggcaaaaagtcgttttttatttgccctgaagtctccacctcaacaacttttataggtttttaaggagggagaaaaatgagaaatgtaggtaagaccaatttaaaaccaaattacgaaaaatttgctaaggcaagtattcgtgagttatttaaagactttaatatcacgacgacgggccttaagcaaacccaggttcaaaaaatgcgcaatcgatttggccctaataaactaacggataatgcgaaaaaatcaattatccgtacaatcttaggagcctacattacgccgtttacaattgttttaatttgcattggcttagtgtcctttattaccgatgtagttttagctccacctggggaacgtaactatctggggagcggaataatttttggaatggtaattataagcggaacaatgacccttatacagtcgttacggtctacaaaagccgtagaacaattaaaaaccatgattaaatccgtcaccacagtcaaaagggcgagcggaatccaaaaaattccagtagatcacgtggtttgcggggatatcgtacaactttctgtcggagacatggtgcctgctgatatgcgattaattaagtcgaaagatttattggtttctgaagcatcactcaccggcgaaagctatccagtggaaaagaaccatttgcaatctaagaaaaacgttaaaagcgaaacggactacgaaaacttagtatttatgggaagttacgtcactaacgggcaagctgaaggtgtagtaatagcgactggaaaccaaactttattcggtggaattgcccattcggcatcaattacgccgaccgaaactaactttgatctaggaattcgaaaaacttcgtacctttttataaaattcaccgtaataatgactaccgttattttcctaattaacggtttaaccaaaggagattggctagaagcgttgctatttggtctttcagtagcggtcgggctcacccccgaaatgctaccgatgatcgttactaccaatttggttaagggagcaactaaaatggccaagggtggaacgatcattaaaaatttaaaagcaattcaaaatttaggggcgattgacgttttatgcacggataagacgggtacgttaacccaaaatcaattttccttaaaccattatttaaattggaaggggacgacggacgaagagactttaaaatgggcgtatttaaacagtcgttaccaaactggttttaataatccgttggatcaggccgttatcgacgcagctaaaccggaagttaaagctcaagcagctaattaccaaaaggttgatgaaattcctttcgactttgagcgtcggcgaatgaccgttattcttaaagatcaatcccagcgccattacgagctaattaccaaaggtgcggtagaagagatgcttgaaatcactaatacggtttactctacaggtagcttggtcccgctaacaatagaaatcaagcacgaaattttaaggcaagttagccagttaaaccaagctggtttacgggtggtggcagttgctcataagcgtttagcaaccacaccgaacacttgttccgttaaagatgaaaccaatctcagctttatcggaattctatcgttcttagattctcctaaaccgactgctaagcaagccctatcagccttgaagtcaaaggggattaccatcaaagttttgacgggggataatgcaattgtgactaaatcaatctgtcaacaagtcggcttaagggtaactggcatagtaagcggtgaaaatattgatcacttaaccgaccaggaactaggtccggtagtcacccaaaataatgtttttataaaactaaccccgcaaaacaagcggagaatcataaaggcgttaagaaaaaataaacacaccgtgggctttttaggcgatggaattaatgacgttccagcaattaaagcggcggatgttggaatatccgtcaattcggctgtagacgtagtaaaagaatctgctgacgtaattttaacggcaagcgacttagttattttgaagcatggaatattaattggccgagaagtatttggcaacatcatgaagtatattaaagcaaccgcaagttctaattttggaaatatgttttccgtattaattgcaagcatcttcctgccatttttgccaatgctaccccttcaaattcttttattaaactttatttatgacctttcttgtatgtcaattccttgggatacgatggacaaagactatttagaaaggcctaaaaaatggcgagttaacagtattggcaaatttatggtttggtttggtccgactagctccatctttgacatcaccacctatctactaatgtttttcgttatctgtcccgcgattgcgggcggtgattttatacatttgacccatccaaatcaaatgtatttcatcgcgcttttccaaagcggctggtttatcgagtcgctctggtcccaaaccatggttttacacgcgctaagaaccgccaaaattccgtttattcaaagcagtgcctcagccgtcctaacgataaccacgagtttgagtattgtcatcggcaccgttattccatttactccgattggcaaaagtttaggcttgaccgctgtaccagacagctattggatttggttagtaataacaatctttagctatcttgcgcttgctacagtcgttaaatcaacctatattcgtcgttacaagggcttcatttaacaaattttagcccgtcaaaatatgaattctgggataatgctgaataaaatcgattgtataggaattttaaatataacgtaggtaagtttgtatttatagctggttttaataggttttctaagattggagggattatattatgaaagcgaaaaaagtaattggttatgtagcaacaacggtgttggtgctttcggtgattggagtgctagtttttaagttttacgaatataaagcgtttaagacgataaaaactagtacttcttcggtatctaataaaattaatcagcaaaagccgttctcggttctactattaggcgttgatacgggatctgacggccggattgatagaggattatccgattcaatgatggttgcaacgctaaacccacgcactaagcagacgctgctttattcggtcccacgggactctttggccgaaattaagaccaaccatgctaaaaaagacgttcagaaaatcaacgctgcttatgagattggtaaagcaccagttgctaagaaaactgtgagcgcttttttaggtatgccacttgattacagtgtaaccattgatatgggcgctttaaaagagttagttgattttgtgggcggggtgaccgtcaaaactgacattgtggttagctttgacggtcaaacaatcccaaagggtacccatcatctgaatggtgaaaaagctttagcttacaccaggatgcgttatcaggatccgcgtggggactacggacgacaattacgacaacaagaagttttaatgcagatcgtccacaaattgcagtctccacaatatatgtttaggataccaactttgatgaacaaattaggctcgcatattagtaccgacttaactacgcagcaaatcgaaaaattaattagccattatcatcaatgtactaagcacgtcgtgacaaaacaactcgttggccgagaagcttggatcaacggaagttcttatcaagtaattgatactgctaatttgcaaaacgcgtcagaccagttgcgcaaaaatcttggattaacgtctaagaaattgcacaatacagaaactaagctcaacgaattgaacactgatttctttagcaatcctaacagcaccacgtataatactgcgggactagacacgacttactatacagataacacttattagcaggcatcgtactaaccaaatagtttaagcgtagtagcagctcaaaaaatccatgattattacaagaagagtatttatttgtactttattaaattttgtagtaatcatggattttttagattacttataaaatcagaccattattaaagttttacattactttcaataatatatattatgtaaactaggaaaagaaaactaattcagtagcaattcatctgcactttaatggtccccactcttcctttcaccaggattcgtagaaatttgacatgtcccaaatcagataatgttgcattctttatttgtaccaagttatatcaggctaagctgtttacaacagttaagctggcagttaacgttctgctatgtagtttcttatgctatacaatcatttttttcgccatatataaaaaaacacgcacttacaacgttgaatttaattcgctgacaaagtacgtgtttttatttaattaggataactttagataattgcaagtactgctaaatatacgcacgtggcaatcaataaaacgaccatcaatttagccatccatttccaccaaacggtaatgttaacatgcgcaattcctaacgcaccgaccacgatcccagaggttggcgtaattaagtttacccagcctgaagcagcttgaaatgcagttactacggtgctttctgcaacgtgagcaaagttcgccattggacctaagattcccattgttgccgatgctaatccagaagtagatgggattaggaacgacattggaatgtagaacaagtacgtcaagataatgaaaacagtctttggtaacgacttgagccccatttcaccccagtgaagaacggtatctgtaattgcagcatcattcataattacttggattccccgagcaacggcgacaatgattgctacgcttaatagctcgctcattccattcataaaggcttcaataaattcactttccttcatgtgggttacaaacataatcacaaccgacattacgatgaaaagcatggtaatttcattaaagtaccagctaccaaacggtacaatatccgttccaagtaacttgccaaggaacggaattccagttagccacttaaccgactggtcccaaaaagtaaagtttgggttaattgaactccacggaatcaaagcaataatcatgagtacgaaagttaaacagaagatgaaaagcacccgtttttgcgccttggttaacttttcagcctcagcagcctgattctcatcaaaaccttgtaaaaagcgcttctgatcggcctcgcgttgaccataaaccagagatttagtaggatcctttttaatcttagtagcatagcgataaacgaacgtaatactaatcacgtcgaatagaactagcaagagaatccgagaaaataatccgtctcccatcgagatattaatcgtttgggaagcaactccggtagcaaacggattaaccgtggaagctaagcatccaatttgcgtaccaattaacgcaatcccaactgcagtaagggaatcaaagcctactttcatcattactggaattagtaaggggtaaaacgcaatggtttcttcccccattccaaacgttgtgcccccaagggaaaataaaatcattaaaataataatgagtgctttttcacgcccttgtagcttgtagacgatttgattaatacccttgtctaaggcttcggttttattaaccactcctaaaaatcccccaattaccaggatgaataaggaaattgaaatggcaccgtccgtgtacttgttcccgatcattccaatgattggggccatacaaatatcccaaatgccttggggacgatatcccgtctgctggtaagttccagcaataatccgccccgctttgtccattgcgtagtgaccgcttggaatgaaccacgttaaaataccgatcataatgataataaatactaaaacggtatacgcggatggcattttgaacttaaattttttgttcatagtcatctcatcacctttcattcaaattgcacattgatgtacctaaaatgatgataagtttttttgaacaaaaaaacaattgtcaggatacattttgtagccttttaagcgtattaactttaaagcttaactaagacatctttaaattggtttcgtaaatattcgccgatccctagcccattttcgaaaaatttcagctgcgtgccctggtaattaaaggaatatactttagtacctagaaaatcactttgggttacgtaaataatatcgctgagctttattgaacaattaaacttactagtgctggaaataaccaaatatccattatggcatttaaggttagcataatacatttgactatgactaccagcgattacttcaaaatacgtatacatataaatctccccctttaccttggagtttaaagggggaaatcggtttcatatcaagtgcaatactttattttgccaactggaacgggttcccttttacctaatttgttatgaaacgcgtttcatatattaaaatagacttatcaggattaggagatggattacatgaccaacattagagacattgctaaaaaatctgggtattcggcatccactgtttcccgctttctcaatcagactggttacgtatcccaatcggcgaagcaagctatccaacaagttatcgacgaactagattacgtacccaacgcgcttgctcgcgatttaagtaagggtaaatctaatacgatcggtatcgtaatcccacaaatgcagcacccgttctttactgaattaattaacggaattatggataccgcctttgctgcggactatcacgtttctgtgctagaatcgcgttacgatgagcaactggaagaaaaatacttagaaaaattgcatcgcaaagcttttgatgcgctcatctttacttcacacaagctaccattggcacgtttagctgcctatcaaaaatacggtccggtaatctgctgtgaagaccctgggattacgccaattgcagcggcgtatgttttacgaaaaaagacttacatggctgcttttaattggattaaaaaaaaccggtattctaagattgccattactttaagccggccctaccaacttagtgcaactagtaaggtaactttgcaagcctatcgagacgttttcgaaacttttccagacgaccagttgatttttgagggagttgatagtcatccagttgcttaccaagctgcttcccggatcgctcaaatccacccagattttatctttggcaacatcgatgacgtgattgctggagtctaccagtattacatagataatcaattgaaattaccgaaaatgatgggccaagaaaatcaaatatccgggaaattattaaaaattcccactattgaccaccatcttcgccaattaggacaagctgcgggacgtttagcaatctctggggacgttcgtcaaattgccattgaatccgacctaatcattcgttaaaactaaatttaaaagttaggtagcttgtgagcattaactaaaaattgaccattatgcttgaatttggcataatggtcaatttttagttaagcggaacgaactgacttttggcacacgttttgggtctactaaaagtcaacacaacaagatattttataagattttcatcttttacagtccgactagccataaaaatactgaaccactaccgcaagtagcgatgtaattgcaaatgcaaagatgagcaggatcacaaaattgcttttaaagccccgtttattgcgtttgtacgtcagcaaaaagtcaaataatccgatggtaataatttctaaaataaactgtatccaaactaataatggcgacatggcaactgtgtgaactacattaaacagtcccgtaagaataacaaatatatataatacccgtgaactgtactgcgcgattaatgtttgttgaaactggtcaattgttaatccatacgcgcaaatcattccgaccaaaatccacacaatactatgaagaaattcaattgttgacatgcaaagtaacccctttaaatttaagcttactaaagtagtttagcatagttgaacctttgaggttgacactagggcttaattgtaatcatactgaaatcttactttcctgctatgatgaacgcttattttatgatactttatttaatgttgcttattttcaattgaaagggattgaattaatttgtttaaaaaaagtgttagtgttgctctgtttggagcaattggcggtgctttgcgactactattacagtcatttttccatcacggtgccactgattttccatttgatttaataatcattaacctcctggggtcttttcttctaggtattctaacagggggcctattaactgctttagaaacttctgattttattaacgtggggcttacgacgggattaatgggcggctttactaccttttcaacatttattctatcctcagataaattgctggtacatttgcaatggattaacggtggtagctttatgatactttcccttcttctgggagtactttgcgcctatgcgggccaaattggcggcaaacagattttgcatcattatcgaaaggaatgggagtaatgagtttattaattgtgagccttggaagtgctctaggcgccctttttcgtttttgggcaaccactttcattaatcggcaggccctttctgaaagtttcccttggtcaacatttttaattaacatgctagcttgttttttgattggttatttaactagtgtagttaccagcccccttacccaaattttgctaactagcggtgtccttggaggtttttcaaccttctcgacgtttgcaaatgaggtagtcaccctattcaaacaaccaaatacaaaaaaactcgcggtgctttacgcactcgcgagtttactaggcggattacttctggcagctcttggcagccaactgtaattcgtttatttttttgtgtaatcaattaaccaagccaaagcaattgctttctcacctaaatgggttccgattacgggaccaaagtaagatatatcaattggtaagctaagatacttttcttttaggctctcccgccatttaatcgcgctcttttcatcattggcatgaatgactacggctcgcagaggataatctactgatttgtaggcctccgcaaagagtttttcaacccgtgccattgcctttttacgcgaccgaaccttttcgaaagcgacaatttcgtgcttatcgttgaaagttaaaatcggcttaatctttaataagcttcccacgaaagcagaagcgttagatagacggcccccgcggacaaggttttgtagatcatccacaacaaaatactcgtcaaatgtcgaacgtaaaaagtcgagtcgcgcaatgatgtcgttgatatcggcatcttcttttgccatacgcgcagcttcaagcgcaagtactcccattaaacgaatcgttagttgagaatcataaactactagattaactccgtcaatggtcccttctagactctttaagctcgccactaaacctgaaatcgtactagctaagtggatactgatgatattttcataaccctgtttagctaaatcttggtaaagttcaatcatttctcctagtggaggctgtgatgtgctaggaaatgattgcgacgtacgcaggcgttcgtagaattcttcggtagtaatatcaacgccttctttataactttttccgtcgataattactggaattggaacaaccgtgatattattttcttcaatttctttatccgttaaataacaagtactatcagtaacaatagctgttttcattagtacacctacttcatttaaaatccataacaatcactataccataattctttattgaatgctcccataacttgacacgacagccctattttaaagcgttttttaatacgcgattaattaagatttgaaacatggcggattcctcttcactccagttatcaaaaagatgccggtcaaactcagccattttttggttaacgtaagtccttaaggtatcgcctttatcggtaatcgtaaaagtacttttacgttggtcgatttcattactttgtttttgcaaaaaattatgctggatagcatgttttaattggcgactaacggttgatttatctaagccgcttagttccactaaatttaaggtcgttagtctagcatcgttaacgtaattcaccatcttccaatctgcaacggtccccgccatttcatgacaatatttttttaagtagttattacgaatatgagcaatttgctctaaggcagttaaactggcttgcataaatgatcctctccttcgaattgcattatacaaccaaattagttgtataatgcaattaagcaattctttgcaactaaaatctataaacggtatacttgaaattagtaattaattattagaagggactgattacatggcctttgatggtttatttacccacgccatggttaatgagttacgtagtcttgaaagtggtcgcgtagctaaaatttaccaaccttaccaaagtgaattagtactcactatccgagcaaatcggaaaaacgttcctttactaatttcctcgcaccctaattatgcacgtgttcaagttactaaccaagccctatccaaccccgctactcctagcaattttgtaatgagcttacggaaacaccttgagggcgctattttaaagtcggttaagcaactggataatgaccgtattattaacttctatttttcacaccgcaacgatattggtgacgaagaagacgtaatcctatcagttgagattatgggtcggcgtagtaacgttattttgtacttaggcagttcgcaaaaaattatcgatacgatcaaacacatttctgctgatcaaaaccgatatcggatgttagttccgggtgcacaatacattaccccacccgctcaagaattattgaacccctttactgactctaaccagcaaacctgggacaatttgcttcgggattacccaaattatgaagttttagctaagcaaattcaagccacatttcaaggttttggcaaagaaaatgcccttgaattagcttatcgcttaattaatggacaaactcccgcaacggttgtccacgagtttttagattgcttcaatgcgaacccaaaaggatttatttacgagtctcaagctaaaaagttaacctattcggcaatccagcctacgttaactgcggatcaaccaaatttgcaagcctttaatagcctttctgaaatgctggatcaatattattttgagaaagtccaacgggatcgggttcagcaacggggacatcaattaattcgggtagtgcgtaatgaattaaagaaaaatcgaaaaaaactaaaaaaattgcaaaatacaatggcccaaacccagtacgctgatagctaccggattaaaggagaggtattaactacctatttaagtcagattaagcgtgggatgacctccgttgaattaccaaacttttatgatcagaatcaaccaatcacaatcaaactatcaaaccaattatcaccgtcgcagaacgcacaaaagtattttaaaaagtaccaaaaggaaaaaaatgccgtcaagtacgttagtgaacagattgcgcagaccgaaagtgaaattgcttttctggacaatattgaaactcaaattgatttggctaaaccagaagatttggccgaaattaaaatcgagttggaaaatgaaggttaccttcgtaagcaaaagaatcctaaaaaacgtgtcaaaaacgttattagtaagccggagcagtttatttctagcgaccaaacccctattttggtgggaaaaaacgatgcccaaaacgatcgtttaacactgaagaccgctaaaaaagattactattggctacatgctaaggacattcctggttcacacgttatcatagaaagtagccagccgtcagaacaaactctgattgaagcagctacaattgcagcatattattcaaagggaaagaattcagctaacgtacctgttgattacgtaccagtaaagaatatccgtaaaccgaatggtgctaaaccgggatttgtgatttacgaagggcaacgtactttaaaagttaccccacagattacggtcgttcaaaaattgatgcagaaaaataactaactaattcaaaaaaactgtcatactaagtcggataacggaacacacttagaagttaagttctcaggtgtattcataattgactttataatgacagtttttttatgctctaatcttaaaactatgagtcagcttgttctagtttggcaccaattgctaaggagtatggcgccttttgtggttgcgttaacccaaattgcttatacggataaacatgttcgtaatgatacctagccatccggaccgggtgttcttcaatttggtacgttccggtaagcgtaatttcagtaatcattcctgcaaaatcttggttaaatgcaagggataagaatggtaaatcctggatcgccaccggtacacaactaatcaccttcaacgcggaagcttcttttttcaacattaccgaaaagattccgtcatgttcaatttgattagcttcctcatcaattgccgaggtgtctaactgttgatccacgactgagttctcagcaaaactaaacagtctattctgatccaccccgataatgccaaatagatgggtttgaccatttatcttactaattaccgccatgtaatcagctccgatgttttctgaccgcgttgttcggcttagagggatttgcgcgatttcaatgttttgttcggttaactgtgtaacaatttgccatttcccttgagccagtactttatcaggcttttcacgttggataatattcaaacaattttccacggttaagggttctaaatagactttgtccgctaattgctggttaaaagtaattgcgttagggttattattaatcaaaatcactttgtaccctaaagccttacaccgccgtaaggtttgaaaagtggtatattctgcagcactattcgttcccacctggctgtttgctgtgcctaaaactaacacctttttaccggagatctgcacagcctcgtcttcatcttcaaaagttgaataataggtgttggtaaggtacggaaattccccagcggtaggctcaacgcctttgtaggtcggaaatactttcgccgtttccgtccgaaatttgcgtactgcactaggagtggtgcgccagaggtgggcaatttgtgtgtctccaaagccaaagtatttcgcttctcgcaaagcctcggcatcaaaatggtgggcttttagacggttttcaactttaattaaatgccgtaatttgtagaaataaaaagcgtcaatgtgcgtcatttcagcaagctcgtcaactgtataacctcgtcgtaaagcctctagtaaatagtaaacttcgcccgcccgctcgtggatcaagacgttaatcagttgcgcctcgctcaattgggattcgtccagggccgcttgttccgcagctgtcgttgaatctactgagcgaatcgccttttgaagagcttcttcagcgctccgtccgaaagacattactgctcccgttgatttcattttcgtatttaactcttgatccgcattcttaaagctagcaaacgaccatgtcggaaagcgtaccgcaatgtgatctaacgtaggctcaattaatgccaaggcgtcgtgtttttgcactccggttagctcaatttcgcgaaggttctttcctaataagatctcggccactactgtagcaacgggatagccagttgctcgcgctgcaaaagccgtagtccggtcaaagaacggattgattcgtgttacgaaatacttgccgttcgtcgggtcaagtgcgtattggacatgacaaacgcccttaattttcaaaacttcggtaatttttaatgccgaagctcgcaattcttgaaattctgtatcggtcaacgtttgcgttggactaaagataatcgaatcccccgaatgaacaccgattgggttaaggtcttcggcaccattaataagtagcttcgaaccttctgcgtctctaatcacggtcatttcaatctctttataacccactacgctcttttctacggcaacttggttagttgtcgagaccttgaaggccgtctctaacacttcttgtaactggtgttcgttatcgcatttaattcggtttgtcttagttagggaagcaatcggtttgattaataccggaaaccctactcgcttagcaaacataaccgcgtttttttcgttttccactaccgtcgtcggaataattggttccttaatatgtcgcaggactttattcatcaattcaggattattgatgttgtggatcgtagtggtcgtgacgcccattgtccgaatattaagctcttttaggatcccagactcatttaactgctccgctaactgtagcccgccagtattacttactaccggcaagattacgtcgatttcatgttctcgaagaatctggattaaattgttcaccgttaattcggtgacgataaagttaattggcacgtctagttgcgggattacggagttagcatcgttggttacgtaaaataaattacgtcccttttgcgcaaaaatctcaacaatttgtgcggctgctgcttcgctttccgtatcgcgaccaatttgcgttggtccgttaccaataattaaaacgtttcttgcgtgaaatctagccaacttaacggccccctcttgtcgtcatcatttccataaattcatcaaacatttcggttgcttcacgaggtcctggtgaactatcagggaaaaattggacgctaaatgcggggaagtcccggtgccgtaaaccttgaattgagtgatcaatcatatcataatgcgtaacaattaaatccttgcggttcacggttgctgggtctaccgtgtatccctgaccatgtgaggcgtacattatttcgtcggtaattaccgataaaattggatgattagcgccgtgatgctcagaggttagttcactaatttggcaaccatttgcaattgcaaatgcttcatgtcccaacccaatcgcaaataaaggaatattattgcgctgtacggtttgaatcatttcgataacttccgctggtaaatcattgggattcccgggacccgtggaaataatcacaccatccggatcaagactaaaaatagtatcggcagttgctgaataagttaaaaccgtaacgttgcaatctcgttgatttaattgccgcaagataccatattttagtcctaaatcaattaccacgacatttttaccatttcccggattagggaatggtttaggggttgagacttggtttacctgttgattagtcaagacaatcgcccggagttggtcaaatgcatgttctaaatctttaaccggatcgataatgcttcccttcattttaccgttggtgcgtagtttcttaattaatgcacgggtatcaattccagaaattcccggaatgttttgtcgctttaaatattcgtccagcgaaaggcgccgacgccgattaatggaaacgtcggcgacatcacggacaatcactcctttacaagttgggtcaacagattcataactcgagcggtcaataccgaccgcaccaatggttggttgagaaaaaacaataatttgattatggtaaatttgattagtaatcacctgctgatagccggtcattacggtattaaaaacaacttcgccaaaggtggttgctcgtgagccaaatgctttgcctttaaaaacagaaccatcttctaaaatcaagtaacggtctgccataatgccacctccacaatttagtgcatctttaattcgttaataacactacgtcttcatcgtcgatttcacgaacggagacgtttattttttcattctgggcagtaggaatgtttttcccgacgaaatctgctcgaattggtaattcacggtgtccgcggtcaaccaaaacagctaaactgatttgcgctggccggttaatgtccataatggcatccattgccgcccgaatcgttctcccagtatacaatacgtcgtcgatcaagataaccttcttgtctttcaagtcaattttagataggttagcattagttttggtaggccgtttgcctgccccatcgcgttgatcgtcgcgatactccgcaatatctaactcgccaactggaatatcaatattctctaattgttttaggcgttcagcgattcgtttagcaatgtacactccccgagttttaatgccaattaaaacaatatcttcaacgcccttattccgttcgatgatttcatatgtaatgcgagtcaacgcccgtttcatcgccattgcatccataatttctttttccataatgtcagctcctccgtagttttaatatcaacgccatacttacgttatctaaatctttttcaaccttgtgcaaaaatttcttagtcactaatggctcgtaatttttttaaagtggtctggaaaatagctggtggatcagcttcaaacaccatttcttcgccagtccgcgggtgtttaaaccctagtaatttagcatgtaaaaactggccgtttcccttcaaggtctttcggggaccgtataacggatctcccgctacgggatgaccaatgtacttaaggtgcacccgaatttgatgggttcgtccggtttctagctggcattctatgagggtatattcgccaaaccgttctaaaactttaaaatgtgtgaccgccgggcggccttcctcgttgatggccatttttttgcgatcttttttagaacgaccaattggtgcattaatcgtaccagtatcttctttgatattaccatgaacgattgcccaatacttacgttggttagttttgtcctttaactgtttgctcaagcttactaaagcttggtcgtttttagcaaccataagcaatccggaagtatccttgtcaattcgatgcacaattccagggcgcaactccccattaatcgttgccaaaggcgtgtgggccaatagtccgttcaccaaagttccatgatcgtgcccgggagcaggatggacaaccataccctgggacttattaacgacaatcacgtcgtcatcttcatagacaatatctaaatccattttttcgggctgaacgtcaattgctaccggatctggtagcttaattataacttgatcgttcggtttaacttgataacgattggtagtaggcgcgtcgtttaccagaatctgcccttttttaatcaagctttgtacttgagaacgggttagatcagcgacgttttccgcaatcaccttatccaaacgaccctttgcagattcttcaatcgtaaaattaatttctttcataaaatccccttatccttcaattcggttatctcgcataatcgcaatcattaaaatgagcactccgatggttaagcaactatcggcaatgttaaagcttggaaaattaaaccaatccacttgaaacatatccaccacgtactttaaccgaatgcggtcaataaaattacccagcgtgccactaatcattaggctcaagccccaacgataccaaacgtggttatgctgcgtaattaataaatagcccaaaacaaagagcgcaacgattgtaattagagtaaataaaagttggcttcctgccaaaatactccaggctgccccgtcattacgtaaattagttaacgacagtgcacctggaattaatggccgtactgcacctaagggaatcgtgtggctaataaaaaatttaaatgcttgatcagctattaatagaattagcccaaaaatataagcagtgtatttcataacttctaatcactaaaataatccggtgatttctcctttatcattaacgtcaatatttaatgcagccggttgcttaggtagtccaggcatggttaatactttgccagttagtacaactaagaatccagcccctaagcgaatgttaatgtcattaacgtgcatagtgaatcctgtcggtgcccctaattgtttagggtcgtcggtgaaggaatattgggtcttagccatgcaaattggcaatttatcccaaccattttgctcacattctttaattttcttcaaagccgttgctgaatattgaacttcagcgcccccgtacattttttgcacaatcgctttaactttatcttgaataggagctgccacatcatacaacggttgcatcgtaacatctgaatttgtgtcggtagctgtaatcacggcctgggccaactctttacagccagcaccgcccttcgcccaagcatcaataactactgcttgtacgccagtctgttctactaattgcttgagttcggcaatttcttgatcagtgtcagaagtgaaatggtttatcgaaaccactactggcacttggtaacgttgcatatttttaatgtgtctttgtaagtttacaaaacccttttccaaggcgacaaggtcttcgttttgtaagtcagctagcttagcgcctccgttgtacttcaacgcccgtacggtagccacaatgacgatcgcgtcaggttctttacctaaaacgggagtcttaatgtccaaaaatttttcagcacccaagtctgctccaaagccggcttccgtaattgtgtagtcagcgtgttttagcgccgttttagttgctaaaacactgttacagccatgtgcaatattagcaaatggaccaccatgaattaatgctggagtatgacctaatgtttggacaaggttaggctttaaagcatcttttaagagggcggtaatcgcaccgccgacctttagatcacggacaaaaattggttctccagcataatttttagcaattaaaattcggttaatccgctttttaaggtccgtcaagctttctgccaaacacaaaatcgccattaattcacttgcaacggtgatgtcaaagtgatcttcccgcggcaccccactaaagcggccgcccatgccaatcacgatgtttcgaagagcccgatcgttaatatctaagcaccgccgccaaacaatggttcgcggatcgatattgagttgatttccctgctgaatatggttatcaatcaaggctgccaatgtattattagcagcggtcaatgcgtgcatatcgccggtaaaatgcaagttaatttcatccattgggactacttgtgaatagcctccaccagtagcaccgcccttcatgcccattacagggccttgtgaaggctctcttagcgccaccattgcagaaccagtcatttcatttaaagcgtcgccaagccccaccgtgaccgtcgacttaccctctccagccggggtaggattaattgaagtaactaaaattagtttacctaattgagcagcttcttcgtcttcagcaaaaatatcaatctttgccttgtaacgcccatatggttcgacggttttttcattaaatcccgcctgctgggcaatttcttgaatgggtagcatttctgcattttgggaaatctcaatatcgttcataatgatctactcctttgtaagaatttcataaaggcgatttaccgagcgacgcctcatcaatagtttatatcttttatgatcatattggaaacttatcgagatttttccgcgagtaacgtcttcgatattagcgatgcttagtacggtaaaattgcttttaaacacccgattgataataacttccgagccaattacttcgacccttcggcttaccgtttgaatactaattaccattacaaacagtgcaaagaaaactgccgtaatccaattaaacgtggtaacttccagccaaaaaatgaccccgacgattaaaatcaagaatgtccaacaccatgaaatgatattgtttaaaaaatcaggttgataataaaaactctctacttttttcattagattcctcctaatttaacgtaatcaccgactggcttagtcaaagaggtaacgtcgcgctgaggatccgcaactaagtctactagtaacttcccaatgattggtcccgtggttaatccagaagaacctagaccggatgcaaccataatttctggaaattcaggtaaataaccaaaaaatggggcgaaatctgctgtatatgctcgggtacctacgcgaacacttttaaccattgcttgagtaagcccggggattactcgttgaccgcttgctaataagtcctccacaatttgggagctaacttgtaaatcaaaaccttgatcattttcgtgtgtagccccaatcagcaaggttccttgattagtgggaataaaatctcgttcaccttctggcattagaacgggtgccttgtcagccatccgtgcgtgctcaggtagcgtaacttcaattaactgccctttttgtggccgaatcaaggcttccaccccaagtggtgccaaagtttgttttaaccatgccccacaagccaaaataaccaaatcaaaatgttcgccattaacgagcacgtgcgaaccttctcgtttcaattgggcaacgtcatggcgaaactcaagtttaccttgattacgcttttgtaaaaaattaatgaactggcgcccatcaattcgagcgccgccctttacgaaaagtccgtcatttttggtttggataaaattaaattccttttgaattgtctgatggtcgacaatttcaaattctcccatttgaggcgcttgtttaatccgcgtctgggctagttggtacaactcacttaacttatcagcttggtctctagtataaatgacgccgctctgataataaacgtcagctggcatttcgtatttttgggcgagctgatttaaatattcggcacctaatcgagccaagtgataccatttttgatttcttcgttttgataaccagggagctataattccagcagaagcggtagttgccgttcctttaatgccatcaaattgaacaatttggttttccgggaaacgctctagcatttcgctaacaaacgtagctcctacaatcccgttaccaattaccgcaattttcaccagtaagacctacctttcgcgtttaccccaaaattgaaaataatccgttcgtaacgctccgttatataatttgcgctttttagtggctgattgcccgtagtatttttcaaaatcgaggtcgctagtgatgaaatatttactccaagtgactaggggcttagttaccgtacctaattgacgataaatttcgcgggctgctttttggtcgcttaaccgttggccatatggtggatttccaatcattaccccatttttttgctccgttttaaagtccttaacggcttgttgtttaaaattaatgattccggctaatccagcttcttcagcatttttatttgctatctcaaccattttaccgtcaatatcataaccagtaatgtcgagttcgacatcgtaatcggctttttcgtctgcttcggcccggatccgttccactaattccttgtcagccatttcccagctttcacaagcaaagctacggttaaagccaggggcgatattttgtccaatcagggctgcttcaattggaatcgttcctgacccgcaaaatgggtctactagtggtttatcagcgtgccaattagttagcattactaatgccgcggccatggtttctttaagaggggcagatcctttatacaaacgatacccccgcttaaacaaactatctccggtagtatccagcgtaattaatacgtgatctttatcaatgctgacttctaacccatacttagccccagtttccggtagttgattgcgccagtggtaaacttcgcgaagtttttcaacaattgcctttttggtaatcgcctggacgtcaggcacactatgtaattgggattttttagacttaccatttactggaaaagcaccgttaatcgggattaactcgtcccacggtaatgctttaacctgttcgaaaagctcatcaaaagtgaccgctttaaactctcccacaataattttgattcggtcagcagtccgcaaccataaattagtacgaataatgtcttcaaaagttccttcaaaccttactcgcccattttctgtttggacatcataacctaaatcttttaattcgtttttagtcaaactttctaaaccacttgccatggttgctaataatttgtaatttttcataataacttccctattagaattgtttattagtaaaataaaaggctaggataaaagtaaactttcaccctagcctccctgaatttgtaaacctctataagccatgttttgtccaaaataaattctcaggaaaaatttaaatttgggtaatcatctatctgcagattttaaatctgcccccacatcttagttcatttccacgatgtgaagctcccctaccatagtttgggtttcccgctcgaggggtttaccgcgttccaacttattaatttcttaataagatcgtctctgtggcacttttcaaagctactagagcatggccgaagctttagctcgttggcttgccgtcatctgaaatcagatgccccagcttattttttcaccgggcacgaacactacaagcatcgcagcttgtgcgagcatggactttcctcagctaaccgatgttagccgcaattacccgagatttacaaaatgatatttaatttagattcgatgcgaatcgttgccgttatcttcaagttgagcaccaaatacgcgacgttcaagattggataaacgtttcaagacatccacattagttgctccactaacgggtgctgattcttcaacggttgcaccagcggaaacttgcttacctaattcgtcaaccttatctgataaccgttcattttcgtctttaagccgttcgatttctttcccaaagttttcgtaatctttaattacggaatctaagaaagtatcgacatctgctggatcataaccccgcatcttcggtttgaattctttttgcaaaatatcctttggagtaaaattaatgttgtccatcgctgcacctcgttgattactattgatcaaataactgtattctattgtatcaaaacttcttggaaattcaaagaattattcctggttttctgcgtatgcattagcttcatcttctaaatcataaaaatcgatggtggtaaggtcgtacgcattttggttttgatatctttgaattgccattaagtcatatttggtttttccttcccgctcactatcatataacaaaagtgcttcgtcggtatgttctaacataaaactttgataattttttaattgttgtggatttttgtatggcaaatcacttacctgaccgtaaaaatctacctttgctttaagagcggccaattgctcttgtttttctgacttccattgctgaccaaaatccgcgaacggtgccatcattgctgtttgtagctcgggataatctttttttagttcatttgctaccatcaatccccattgttcagttcctaattgcggtcctgcaatcacccaagtcgttcccgtttcaattttttcaatcaaccgattttttagggcaaacttaatcacctttaatttgggatcactatccgaaaaaatccctaattcataactacgataacctgttaaccaaagccgactcattttatcgctcccatttcataccatctgtaaatgaagtttactacattataggtacgcagaaaaactaaattgttttgtggttcccctattttttaagtcttttgtaatcttaaagagcttattagcatagtataataagctatcaggaggatgagccgtgaaatttaactacccaactggatcaacacttaataaccaccctagtgttgatcgtccacagaaacagagcgtgccgatttacggaaaacggggaatgtctttagaagaagagcttaacgaaagtaatcgttactacttatctcgtggaattgccgtagtgcataaaaagccaaccccaattcaaattgtaaaggttgactaccctaaacgtagtgcagcacgaattaaagaagcatattttagtaaagcttccactactgactataacggcgtatacaagggtaaatacattgattttgatgcaaaggaaactacgaatacgacttcttttccattaagtaattttcacgaacatcaaattacccatatggagcaatgccagaaagttggtggagtttgctttaccatagtaaaatttgtaaaattggataagatatttttactaccggcaacagacttattcaaattttggaaaaatatcaaaaatggtggtcgaaaatcgattccgctttctgtatttgaacaaaatggttatgaaattaactaccagattaacccgttaattccatatcttgagtcagtagatcaaattatatagtgaatcgatttttaaagagcaaggagattagatatgaatagtagaaatgataatcatgaacagcccctgcggcgaacgcaacattcgcaaatgcaacgttctcatactaataagagaggtccttcttcatgggttaaaaagcttttattagcggcggttggctttttagttgcgttaattgtttttggcggcggtttatttatgtattacgcccaaagcgcgcccaagattacggaagcacaattatctagcgacaatgccaccgttatttacgataaagacggtaaggtgttaacccgtctagggtcgcagaaccgggaatacgttaaaaaagaagagatcccgaagactttaaaacacgcgattgtttccattgaagaccggcgcttctataaaaataatgggatcgaccccgtacgaatcgttggggccgcattagccaactttaccggctcttccctgggactacaaggggctagtacccttacccaacaattagtaaaactatccgttttctcaacggatgcttccgaccgtaccttaaaggttaaagctcaggaagcttggttagctttgcaagttgacaaaaagtacagcaaggatcaaattttagaattctacattaacaaggtatacatgggaaacggcgtatatggcatggaaactgccgctaaatactactttggtaaatcgctggacaagcttgatttagctcagttagcgttgttggccggaatgccacagtcccctactaactatgatccaattagcaaccctaaatatgctaagtcacgtcgagataccgttctagaagcgatggttaagaataaggaaatctctcgacaacaagcagatcaagcagaaaacgaaagtattcaatctgggttaactgatacacacgaaactacttcagaatctaccaagaaaaacaagattattgacccgtacgttaaagaagtattaaccgaccttaaagacaagggatttgatactaccaagggcggtttgaaagtttataccaacatggattacgccgctcaaaagaaattgtatgaactagcaaacgatgatcaaaccgttaactttaatgacgacgaaattcaagtcggcgccaccatggttgataacaaaactggtaaaattgtcgcaatgctaggtggtcggaaaaccggcgacgtcacctatggtttaaaccgtgcggtacaaactgaccgtagttccggctccactgctaaacctttgatggattacggccccgcctttgaatacttgaagtggccaacttatcgtaaagttaaggatattccgtttacttatccgggaacaaacactaagctttacgattttgaccaccagtttaagggaacgatgaccgttcgggatgcgttgatccaatcacggaacgttccggctattcgcaccttacaagacgtgggcatttctaaggcaagcgactttatggaaggcttaggaattaccagtaaagatgggtacacccttagcaacgggatcggtttatatatttctactttgcaagaagcggccgcatacgcagcatttgcaaacggaggaatttaccacaaaccaacctacattcataaagtagttactaatgatggtaagatttacaaatacaagtctaaaggtagccgagcgatgtctaaagcaaccgccttcctgatgacttcaattttaaagggtgttaccacagatagtaatggttccggacgtgcagctaaccttccaggaattaacatggcaagtaaaactggtaccgtagcgtactctaagaaagctactgaagcatatgacattccaagtaacgcttctagtgattcctggatgacgggttatacaaaagactactcactttctgtttggaccggatttgatcatcctaactccaccactggttatttaacccaagaacaaactaacttggcacagtacctgtggaaatacatgatttattacatggctcagtattcatctaacgcggactggagtatgccatcttcagttggtaagaaaggtgaaaatgaatactatcaaattggggcagattatgatgataccggtaagagcgatgattatgcaaaaaataataaacgctcctactcatcaatctttagcagttcttcaagctccagcagttcgagcaagtcatcttcttcggatgaggataaagatgacgatcacgacgaacaaagtcaaaaagatgacgactcttcaagttctgagtcatcatcttccagtagttcagttagctctagcgaaccatctagcagtgtaacaccaagttcttctgctacctcgccttctaccgagaacgcctcggttagttccagtaactaacgaacgttaaataataaaaaatacctcctttgttaaggaggtatttttttatacatttatttattatcttggttatcagtaagtttaattagcggaatatatacatttgaggctttatttttagtggccttggaactattttccgcttcaccatgcgggcgctgcttgagactattttctacctgagccgccgtagtaaggtttcgttgttgccaattcaataaaattcgatccatatatttcaagttatacgcttgatttaaaaccgcttcttttaaagctaaccggattaattccggcgaaaagtgatccgtatcaacccattgggcaatcgtctcaatctcaatcggcgacaatgctcgcccaaattctacttgaatctggtcataaatgctattggttttctcttgcgtttgtgttgccacctcttgagtcgcctttccatctaagagggcaattaacttttggtaaaacaaactaaaatcataaaaatcagttagctgaccctgtccatcccgtctttgcttaatttccaacatctttttgtcttgtaaagattggatggttgcaaatagggtttgactgtcaatgcctaaactcgtggcaagtttatccatcggcgggaacccatttccccgcgattgttctttcttaatttgtaaatatagtaaaaattcgttgttagtcatccccaactttgcataattatctaacaaaaaattaggaatgctagtgttgccgtcctgtaataacttcaacaatacgtcttgcatatttgctccttaacttagtacgtggatacgtgcttgatttcttgtccagttttaaagtcaattagtttaatgactaaatggtccttctggttaatgtacgaaatcatccacaccggacgttttttaacaatcccaaatcggctggacgtaatttcttttaacgcagaatcttgctcaacagttttaattgcggcctgttccgacactcctgctgattgagggtataccgtgatcttctttccgtgatcagcaattaccacaaagatgttagtgccgtcttttttggcaccagaaactgtgtactcggtttggttataaacaaatcgcgtcacccgatcaactttggtcaagtcagtattgtctagcgcaatcgtttttgctacgcgggtatccccccgaatgggttggttaatctcattaaaaataatcacagctgaaccaataattgttgcaagcacaataaaagttatcagcaaaaatggatgtttaagtctaccttttttcataatcttcctcaactaacataaacaacgggactacttaaaaaagtcagcgacccttgttttaatctcatcaattttgccatagtgggcttctactccgttaggcagctgatggataaattgcttgccgtaacgacgtttcataatccgattatctaacatcacgactgctccggtatcatcgctattgcgaattacccgtcctaggccctgcttgaaagttaacaacgcgtctggcaacgtaaactgccggaacggatttcgtgcccgcttagcggctagttgaactagcttatcgcctggcgagcgaaatggaagccgggtcacaattaggtactctaaacggtcaccaggaaagtcaatcccctcccaaaatgacgccgcacctaacaggattgcgttatcctcatcgttaaactctcggataatcttagcacgagaaccatgcacgccctgagccaagattttacgggagcgctcaggatgttcctgcatcatcctagtatataccttctcaatggtatctaacgaattaaaaagtactaaagtttgccggttaacgtcttccgttaattccacgattgcgttggccaaaaagcgctcgtaagctttcggcgaggtgtccggatccagcgtaaaactagaatctaaaacttcaaagtcaagttgttttgcaaagtttacccccgtattaaaggaacgaataattgcattttccttggttaaggcgtacttgtctaagaaataatctcgatgattaccaacaaacagtgtaccaccgatcaacaaaatttgagcaaatgctggcacgatttctttttggtaaaattctccaggattaactactccccggccaattcggatactaccagcatcatggttagggcctagcgtaatccagtagtaactttgcgcggaatcatttttcaagtcgcgaattgcgtcgtaaaacttagttaggttaccttgaaacgccccgatttgtcgccaggcttcgttggttaccgaacctaagtcatgttgtttgaaataccgatccagcgtgtcaaattcaatgaaggtgttagcgagttcttgggtgagcgcattaaactcgttttgatttagctgttgaatagtagcttcgtcgattgcaatttcagctggttgattttcaaccagttccactttttgccgttgaacaaaatgttcatacaaattcccttgaatttgggaaattagccggttgattttttctaggctattaacgaaccggcgaatatgaaaaccagccaacggatgcttcattaccgaacgcattaggttatcatggtggttcattaataatcggctaactaaccgatgtgcttccatcatcaattcgtttaagtctagatattgttgatttaaattagctaattcctgtgcaaaatgctgagcttcgtcaatcactaagtatggcgcccgctcctgcacgttaaactttgcactgtgatgcgccaagtaagcatggttagtaataatgaaatcagcaaactttaacttggttttagcgcgccgataaaaatcataactgtaaaacggcgattgtgcagataatacggttgcccccgcatggcgaaattgatcaatactattgccaaaaccaacgtggtaattaatttcatcgaaatcaccagtctctgtggtggttagccaaactaaaattttcattgccaacaaccggccatccttacttagttccgttggggtggcaattttcttggcaaacaaatctaaattcaaataattgctgctaccctttaacaccgcaaattgccgggggtatctcaaaagcggatttagctgctccttacctaccttaagaacttggttctgtaaaacggtagtagggacactaatcaccactttacgcgcgcgctgccgccccacataactaagaggaagcaagtaccctaacgttttgcccatccccgtaggagcttcaacaacgatgtttctttcttcgttttcttgactaaactgttggtaaacatagttcattaaggttgcttgactcttacgccactttaacgtcttgttgtacaattttatcttgcttcgcttagtctgtggataagcttctttttttacgttaacctcttcacccgtatttaagggagcgggtcgtttaattgccaatccgtcaaccactaataagtcatccggtaacttattgggatgccgtttgcttttttgcaacgccgcttctaaaatcgttgcggtttgtaaaggtagctggtcacctaatttaactaactgctctaaggtaacgattggcaattcacttaacgcagctttaatttttaagaataaatgtgcggttgccacggcatcgctatctgccgagtgcgggtcgtcgtgttcgatgtgtaaataattagttaaatcccgtaaccgataaccacgggtacgcgaaaaaagaacctggcttaacgtaacggtatcaatcgcttttaagtctaattctgggtacccgctacgcaccaattctcgatttaagaacggaaaatcaaaattgacgttgtgcgctacgaacaccctgcccgccaatttttgatagattttatccgccacatctgcaaacttaggggcctggcgaacttgttgatccgtgatccccgttaatcgtgaaattcgcttaggaatcgtcatctgcgggttaatttttgtttgataagtttcagtaatttggtcgccttcaataaaagcacagccaatttgaataattcgactttcttcaaccgatcccgtaccggttgtttctaaatctacaacagcataccttgtttttttcattactaaatctccaaccttagtctctaattactaattttaccaaatgtttaccttctctacatcgaaaaatcctctgatttagagtatcatttactttaggccaaaaaggaggagcatcgtgaaagaggtaattaaaactagtaacgcaaaaattattttaataggtgaacacagtgtggtgtataatcagcccgcgattgcccttcccatccgtaacgtaaaaacaaccgtaaaaatacaatccatccctggcgacattcaaatacggagtcgctattttaatggcttcttaaatgatattcatagtaatttgttgggaatcaagcagctgattaaccaaactttaactacgttaggaaagccacattatggattgttattagatattgacagccaaattccagctgaacgggggatgggttcttcggcttccactgccgtagcaattgtacgcgccatgtacgccttttttgaccgtcccttaactaaaaacaagctattaaaaacggttaatatttccgaaaaaattatccatggtaaccctagcggccttgattcggcgaccgccagcgcagaccgaccaatttggtttaaacgagatgggaccattaaagctttgccaattaattttaacggctacttagtaatcagtgattccggaattaaaggaaagactggcgaagccgttgacattgttaaaaacaagctacgtatcgataatgatagtagacttttgattgaaaaattgggagaattaactagtcaaactgcaactgccctaaaggatgatgattctttggctttaggcgacattatgaataacgcgcaagtttgtctccgtcagctaggagttagccatccggcagtcgaaaaattaatccaagcggctaatcaatccggtgctttaggcagtaaattaaccggtggcgggctaggcggctgtgtaatttccttagtccccgatgcccaagcggcagaaaacgttagcgttcaattacgcaaagctggagcaactgccacttggattgaaaaattataggagtagattttagttttgaagacaaccgacaagaagcgtggctttgcccgcgcacataccaacattgcgctaattaagtattggggaaaagttgattctgaattaatcatccccgctaatgatagcgtatcgttgaccttagacgagttttatacggataccgtcgttaacttctctgaagattacaaggtcaatgagttctggttaaatggcaatttaatgccttataaacatatggctcgaatcaatcgcgtaattgacgccgtaaaagaagagtatggttaccctggatttgcaaaaattcggtcttttaatcatgtcccgacttcagccgggctcgcttcgtccgcttctggaatggccgctttggctggggccgctgcggatgctttaggcgatgaacatgacctaactaacatttcccgaattgctcggttgggctctggttctgcttcgcgttcagtcttcggtggaattgtgcattggcaccgtggcagcgatcatgaatcttcctttgtcgaacaagtggtcaatgaaaaagatattgatttaaacatggttactgtcgtagtcagtagtcatcaaaagagtattaaaagtactaacgggatgcaacgaacggtagaaacttctcccttttatcccacgtgggtatccgaatctaatcgcatggtccccgaaatgcttgccgcagtcaagaaaaatgactttaccaaaattggggagctagcggagcacagtgcaatgatgatgcacgcaaccacccttgcggccattccggcatttacctacttccagcccgataccttaaaagtcatccggctcgttacccggcttcgaaaggaacacggcatcgaatgttattacaccattgatgcgggcccgaatgtgaaggttctatgccaaaacaaagacgttttagcgattcgaaactttttaaagaattactttgaagaacgccaattagtcattgcccgtccaggcagtggaattaaattctcaaaaaactgaaaggaatttttaaattgataacacaaaaagctccgggaaaattatacgttgctggtgaatacgcaattgtcgaaccaggtaacagtgcggtattagttgcggtgaaccaatttattactgctagtattgaacctagcgagttaacttttggaaacatcatctctaagcaatatcatgacaacgtggtctcctggcgtcgtaaaggcggccaattggtagttgacaatcgtgataatccttaccactatattctagcggcaatctccatcaccgaagaattagcggttttaatgcaccgtcaactaagaacttacaatctctacatcaatagtgacttggatagcagcgatggtaaaaagtatggtttaggtagttcagcagccgtcaccgtcgctaccatcaaggcgttggccaaattttaccaaatccccctaaccaaaaagttactttttaagctagcttcaattgcccatttagacgttcagggaaatggttcgctaggcgacatcgccgcaagtgtttatggcggatggattgcataccgctccttcaaccgcgaatggttaaatagtatgcgacgcactaaagatttaggaacgattctacggacgccttggcccgagttaaagattgaattattaactcctcccgccgatttaaaactactaatcggttggactggctcaccagcttctacttcggatctagttgaccaagttgccaccaccagttatcaagaaaccgacagttaccacgagttcttggcaaacagtgcggaatgtttgcgcaaaatgatcgaaggatttaaaaacggtgacagccaattaattaagcaacaaattaccgccaaccggcttctcttacaacaattaagtttattaagcggcgtttccattgaaacccctgcgctaactagtttatgcgacattgctgaacaattcggcggagctgcaaaatcttctggggctggtggcggagattgtggaattgtaatcaccgaagaaaatgataatactgaaaaaattattaacgaatggcaaaaagaagatattcaaccattagatttggatgtccatgatatcgatgaattgagttaggagtactatatgaaaaatattcaatcccaccgtaaagatgaacacgtctcactcgctgaaaaattttaccagcccgtcgcatctgcaggttttacggaaattaagttgcgccccaacgctttaccagaaatggggattgatgacgttagcctccaaactaaattagcaggacttcccatagaagtccccttctttatccaagccatgactggtggcagcccaacgaccgcgaaacttaaccgtcgattagctatcattgctcgtgaaactggtttggcaatggcggtgggctctcagtcagtgggcctaaagtatccggaattagccgataccttccaagtagttcgaaatgaaaatccccacggactgattttagctaacttgggcgcggacgctagcgttgcggcagccaaaaaagcggtcgccatgcttgacgcagacgttttgcaattacatattaacgttgcgcaagaactggttatgccagaaggcgaccgcagttttaactatttagaacaaattaaaactattcaagcagctgtgagcgtccccgtagttgttaaagcagtaggtgcggggatgacccgagcggacgctctgcgactacaatccatcggggttcggtacattgatgttggtggtaagggtggtactaacttcgtccaaattgaaaacgcgcggcgttccgaaaaagatttcgcctttttaactgatttggggctcaccaccgttgaatcgctcaaagaagttagcgaattaggactatcggttaccgcaactggtggtatccgcacccctgctgacgtaattaaaagtattgcgttaggagcggacaacgtgggcgttgccggctacttccttcaccaactactgcatcatgatgatcaagaaatcatcgacctaattgagcgttggaagtaccaactccgctgcctaatggttttgctaggagttactaaactagccgacttgtcggagcggcaattacgataagataaataaaagctggatgacggtaacgagcgtattacgcttccaccgccgatccagctttttattttatttttacttaaccgcaaaatttatccgtaacccctttggataaaagttcttaactttaccttggactaactttcccggcccgacaatgatatcgtcaaccgctaaagcaacccatcccttgcccgcagcttccgtagcaatttcttcgccatgcacgtacttttgccactgctctggcgtgatctctactacttgttggatatccgcttttcgtaaggccatcagtaggcctaaactaggttcaaatcgtctcttcttaaattcccccagttcaagtcctggtttaacaattcgtaagccactcaaatccacgggaacggtttgataatatagccgctgattgtgcacaattaaatgatcctttgcaaaggattgaggatttacgaggaactggtttgcaaaatcttgccataatcgttgttgttcgcggtctaacgaattatcacttgcccgacccttctttttacgtttggcttttggctgaggtgtcgcagcttccgcgtgattacttaacttggcaataaaatggccttctcccttaaaatgatggggaaacaaccggattgccttagctaattcaggattgccgttggcccactcaggacgccctgcatccatattttccgttcgcgcaacgggttccatcttcaagtctggatagttttccaatagccaagcaatgatttgttcatcttcttcaggtgcaaacgtgcacgtcgaataaaccagattaccattcggagcaagcaattgcatggcacttttcaggatttcacgttgtcgccgcgcacattcttctgggtattccaaagaccagtattcgaccgcttcagggtcttttcgaaacatgccttctccagaacacggcgcatctactacgattaagtcaaaatatccgttaaatttttttaccagccgatccggtgactcgtttaaaattacagcattttgaattccgaaacgttccacgttttcagctaggaccttagcccgtccccgattaatttcattagtaaccaaaagtccttcctgagccataaaactagctaaatacgtggtttttccgccaggggccgcacaaagatccaaaactttttggcctggttgcgggtgggcaatttcgccaaccagcatcgcactaggttcttggctgtaaactaacccgctttggtggtcaatcgttttaccgttgaccttcccataatatccccagtcagaatatgaaattggctggtcgattgaatgatcatgtaattttaccgtgctcttcaacggattaactcggaagcccttttcaactgcctggtcaaaactcgctaaaaaaggttgtgcttcttcgcccagtaatttttgatatttttctttgaaaccgtcaggaagtcgcatattccactctcttctcaatttaatttactaaataaactcgcaatccattataactaattttactaaagtcgaccaccggacggtaagaattggtaaggtacctttcattttataagcacttggcttaaaataggctaataatacttttaaaaaggagcgatcaaatgcaacaaaaattaatcactctggatttagacggaaccactttaaataatcatagtcagctttcacccttaaccattaaaactttgcaaaaggctacccgggctggacatttagtttcaattgtcacgggacgaccataccggatggctcgcgacatttacgaccagttacaattaaccactcccatggccaattttaacggtgccttaacccacattcctcatcaaaaatgggatggcgagtattcaatgaccatcaataaggccgtagtttatgatttaatgcgccataaggatgattacggcattaagttactggcagttgaaaataagcattcgttctttgctgatcacgccgcgccggctaccttcgatttcttcccgcatgagatttcagacgaccaagttttaaccgaagaaagcctgcgggggaacccgacttccattaccatcctagtcgaacctaacagcgcccagtttgttaaaaaccagttactgtatcactatcgcgattatattaacgttggagtctggggcggtccgcacagcgtcttagaaatcgtctctaaggggattcaaaaagctaaagcggtcgattacttagcaagatactaccacattgaccggcaaaacatcattgcctttggtgacgagcataatgatgctgaaatgcttgactacgtgggtcgcggagtggcgatgcgtaatgcaaccgcccaaatcaaatcgattgctaacgacattaccgaatttgataatgagcatgacggggttgccaagtacttgtccgaatatctcgatctagctaactaataaaaaagcttcttcaatcagaaacaaccatccagcaggtgccagtccgtttctttgaagaagctttttattaatcaacctatttttcgtcgctctttaaaacccccgctactgaataacggttcttttgcatttcgttcaaaacaacgtgcacgtgttcggcgggtgcgccagtattctttactaccgctgcggtaacgtcctttaccagcccacgtagttgatcttcactacgtccttcgattaaatcaatgtgaattaacggcattttaaatccctcctttaataaaattgccacaactataatctcatgaattgctttaaaaaacaaagtatttttaacaattataaaatcaatttatcttacattttgctggcctgctttttagaaacaatgccctcatcgctatcggtttcttatgatacactaaaggaaataacgaaagaaggttttgacaattactcaaaaatattcagcttgtacaagtttcttagcgggtaaattggcaactgccgacggttcaacgatgattgcgcgtaacgaagacgctaaatcagcttggccaaagcattttgtggtacatccccaccacgtttccaccgcgaatgaacgaacgtttaagtctaacgacaatggctttactacaaaactaccggaagtccggggtaaatataccgccactccagaatggactgccgaatttgggctctttgaagaagatggaatcaacgagtacggtgtagcgatgagtgctaccgaaagtgcctacactaacgaacgcgtcttaggatttgatccgcttgtcaaagatgggctgggagaagaagctatggtaacggtcacccttccttacgtgcacagcgcccgtgaaggggttcaatacctagctaaacttattgaagaaaacggcactaacgagactaacggaattttatttgccgatgcggatgaagtttggtacatggaaaccgctggcggccatcagtgggttgcgcaacgtattcctgacgattgctacgcagtagtggccaaccagttgtcgattcaagaaattgattttgatgacccggatcacttcatgtttaaggccgacattcgtgagttcgttgcccaacaccaccttaaccccaacccagcaagtttcaacttccgtgaaatcttcggggtgaacgatttatcagatgagtattacaacaccccacgggtttgggaaggacaacgaattttaaatccggaaattaaacaaagtcctactagccatgaccttccgtttatacggcgggctagtcgcttaattcaagttgaggacgtccaacaaatcttaagttctcattatgaagggaccccatataatccggtcggcacgggtacggaaactgaaaagcatcaattccggccaattagcctgccggcaactcaggaatcacacattttacaaattaagccaggcctcccgatagaaatcggcgggattcactggctggccatgggcgtggctgcgcaaagcgtctatgtcccattctttgctgggatgagcagcactccggagatgtaccaccatggcgaaaaaatttactctgcagattccgcctactgggtcttcaaattggcaagcgtccttactgacgcgcactaccaaaagtttattaaagcacttaacgacacccgaagtaaggttaacgtagctatgaaaaataagctacacgaatacgaaacgcgggctacccaaatcgatcgtcaggaattaacaccgttgcttaaccaagctggtacggagattagcgatattgcgattaaagcttaccaagcgttgaccgcggagttaattaccaagtcaactgacttatccccgctttacttcgcccataatcccgaactataaaaaaacagcgaaaactagtttactagctttcgctgttttattttgtcttaaattaggcttacttccctttactttccgtatcggtcttcaaaacggtcatgaaggcttcttgtggcacttcaacctttccgaccgatttcatccgctttttaccccgtttttgtttctctaaaagcttagcacgccggtctgggtccccagtatgaatgcgagccgtaacgtccttacgataagcacgaatgttagtccgggcaatgattttatttccaatcgctgcctggaccggaatttcaaagttccgccggggaatgatttccttaaggctagccgtaatttcgttacctcgttgttgagcgaaatctcggtgagcgataaaacttaaagcatcgacccgatcgccattgagtaaaatgtcaattttaactaggttgctgactttatattcaccaagttcataatccaatgaagcgtaaccgtgtgtacttgacttcaatttatcgaaaaagtcaaaaataatttcggataatggtagttcatacttaacgtccacccgattctcgtcaatgtaatccatcgtattaaagattccccgacgatactgggccaattccatcacggcccccacgtaatcgttaggcaccatgatatccgcgttaacgtacggttccttgatattcttgatgctcgacgcatccggcatctccgaagggttttcaaccgaaatctcgctaccatcggttaattccacccggtaggtaaccgacggcgccgtagtaatcaaatctaaattaaattcacgttcaagacgctcctgaattacgtccatatgcaacaatccaagaaagccgcaccggaacccgaagcctaatgcttgagaagattctggttcaaattctaaggcagcatcgttgagctggagcttttctagggcctcccgcaaatcgttatacttagcattatcagtaggatatagtcccgaataaaccattggattcatttctcgatatccttctaatggttttgcagccgggttatttaataacgtaactgtatcaccaacccgagtgtccttaatatccttgatgctggcggtgatgtaaccaacgtcaccagccattaaatattcccgtttaagcgggtttggggaattaactcccacttcgttaacttcgtaggttgccccgctgttcattaacttgattgtgtcgccaggcttaaccatcccttcaaacaaacggacgcttaataccaccccgcggtaatcatcatatttggaatcaaaaattagcgcttgaagcggtgcgtccaaatccccatccggtgccgggaccttttcgacaatttgttcgagtaattcttcaattccgattccttgcttagcacttgccatcactgcatcactggcgtctaacccaattacgttttcaatttcatcttgaactcgcttaggatctgcagccggcaaatcaattttattaattaccggaacgatttccaaatcatcatcgattgctaaatagacgttggctaacgtttgtgcttccacgccctgggcagcatcaactactaggaccgcgccttcacaagcggccagactccgagaaacttcgtatgaaaaatctacgtgtcccggagtgtcaatcaaatggaagatgtacttttcgccatctttagcggtgtaatgcaattctaccgcattaagcttaatggtgattccccgttcccgctctaaatccatagtatcaagcagctgattttgcatatctctttttgcgaccgtatcagttaattcgagaatccggtccgctaaagttgatttaccgtggtcaatatgcgcaacaattgagaaattccggatgtgcgcttgccggtcttttaaatctttatattcgttcatagatagtttccttttcataagtaatcactaagctaaattatagcagacctcccgcaaaaatttaaatgctccggccaactaattcccgaaggtttcgcattttcagaaatatgctaaaattaaataagtaattttaaggcagtatgtcaataatctcaatgaaaggcttgtagattcaatggctgaaaatgaacaaaaggtaacgcaaacacaatcaagcagtaaagaaactactagtagtcccgctgcttcaagtcatgctacccaaaataataataatcacaattccaatcaaaaccatcaatcaagttcgcaaccgcgtcagtcccaaccaagcagttcggcgcccgcacaaagtcacgcaagcagtcgaccagcatcatcggcgccttcttcgtctgctaaatcgagttcgcgtcccgcggaacgtcaatcccaaaccaaccacaacggaaattggcggtggcaatcacacgaatacaactttggcaatcaaaaccaggccccctcatcatcgaccgtagatgacgagtccacggatgaatccagtaaagaatcgtctgaaaagtcgaagtctgctaaacactcgtcttcttctaaggcacataaagctaagaaaagtaaaatcatcaccacggtcgaatcggatacttcgcatagctcagggattgagtacaacgaacatcacgggggcctttggacggcattaattttactaattattattgtaggcgggtacctactttggcgtaaaaaacacccgcggacagccacggtgccatccgaacatcgcggaaaacggcgtttccgacctaatttgaattttttcgtaaaaccagtcggtcgccacggaaaacgacgtcgataaataaactacgagagactagaaaaactacagtaatccttttcaaggatgaaaagattcttaaaaaatgcttggtattttgacttcaatagcatcaaaaaaagcctattccgcttaacctcaaaatgaccatcatgccaaattcaggcattatggtcattttttgttactgctcgcaagctatccgacttttggcttactcgccttactttagtttaaaaattttggtaaatatttccggttccttcttccaaacatttttgatattataaaagcgttaataatccttaacgtgtttacagttaatagcgtcaatgtttaaaggaggagttatccatggattggcaaacctttatttcgacgatggttggcggaattgcgggttctattttgaccctaattgttgctaaggaacagtttaaaagagacgacctgttcaataaggagcaacaccgtaaatcagcgattcaagaattggagaaattaaactttgtgcttgagcaaattaaattaactgaattaccgttagctttaatcaaagagtctaaagatcaggcagttgcaattgctcaaaatataattgatgaatacgaattagcacactcggcttttttcaaagttctaattgtaattaacgattctaacgttactaccaacgatgtagatgaactttataccgcctcgcaacatctacgggagcaaagtcaaaaattcaagcacagtttgaggatgttttcagacgaagatattagcaatccagaagccttttatcgttcaaaattgaaactcgataacttttcccgggaattatcccacgctgtagcacacgtgcttaaacacagttttaaatacgaatcacactttgaaatcaaataaaaaacgggagcccgtagagtagtctacttgcttccgtttatttaatttatcgtgttcttaagatctttaatgctaatcaaattcgtcaactaactcttcccgagcaaggacggtatcccgaacctccttttgattgaagcccgtcattcgaaatgataattcgaaatccgtaacttttgtacggtacttttccagttgccactgtccgcaagaaaaactaccaagtgcgttttgctggtaatctaaattcaaaaccacgtagtcccgtttctttaaatcgatggtgtgtttggcttcatcaagatcccgttgttcataataagaagcgctaaagttaattccggatggattactaaataacatcccttgaccgcgttcatccgttaaggaggcccatttagtatctaaatgattcccgtttgcttgtggcactacgtaattggtaaataaaccatccacgtcagttgtgtaaaccccgagtagcccagcttcccgagaatcggcatagttttctcggggtccacggccaaagtaacgaacttgtgctaaatcaggatttaatcttaaatccactcccaaacgagggagcatgtctggggtcacatcaagcttaccatctggggtcccgtttagtttaaatagtatgtctccggttgctaaaatccgatactcatactggcaatcaaagtgccaagcactattagtagtcccgtgcatcgtcttcactcgaactactaccgcttgctcgctagcttgccaactaaaatcgcgcactacttcatgctctaaatgtaaaaattggcgttgcttcatttcggttacaatctccatatcgttgctagtcggcgctcgccagaaggtaaactgcgggccccgttttagtaacttttgcccatctttttgataatcaatcagctgaccgcgcacggtatccaacgtaactgtaaaattatttccactaatcttcaacgtggtcgccccttcactaacttgtaaagttcctcgtggcgacactaagattcggctagattgaattggtaaaacaaattgggcggtagctaattcaaatcccgctggcgcaaacgaggcgttctgtttgagccggtatgaaagatttaggtaatacgttgccccaggttccccagcatgcggtaactcatccagtaattgaatttcttgggtttgtcgtgcgggaatgcttggcaacgaaatgcggccactagttagaagttggtcgtctgccattacttcgtaaactaaatcaaaaatctgtaaattggtaaaatcataccggttaattaactttattcgtccttcctgaaggttaactttttcggtggttaccggctcgattacttttttatactcgtaaagaccgggtgaaggagtgcggtccggcattaagagcccgtcaatacagaaatctccattagtgggatcgtccccaaaatcgccgccatagcgataatacttgcgcccatcttccgtataagattcaatcccgtgatcaaaccattcccaaataaaaccaccttgcaatttatcatgagcatagaataggtcttggtactcctttaaatttcccggtccgttccccatggcgtgcccatattcgcaaagaatgtgcggtttcttggcgttcttaattacatccttcatgagtaattttcgggtcggatgttctaaccaggtgtacatcgtagaatatacatccactacctcagcatcaaaatcaccttcgtaatggaccaaccgggtcggatccatttctttagccacttccgccatttttcggaaattacagccaaaagaggactcgtttcctaacgaccaaaagataattgaaggatggttacggtcacgagcaatcatccgagtcaaccggttaacaaaggccgtctcccactgggggtcgtcgctaatccagtcatacttttcagttaattcaaagccgtggcattctaagtcggtctcgtcaatgacgtacattccgtagcggtcgcaaaggtcataaaaatagtatgcgtcggggtagtgactagttcgaatggcgttaatattaaattgtttcattaaaataatatctttttcaatctctgcttcactgactacccgcccgttacggggattgtagtcgtgccggttaaccccctttagcttaatggccaccccattgaccaaaaaggtgtctcccacaacttcaatagaccggaaaccgaccgtttgaggaatcacctcaatcacttgctctgcatgcttaaccgtcatcaagacggtatacagatgtggcagctcggcactccaaggtttaacgtgcggaatttgggtttcaaaccgaacctgcgtaccctgtggttgattggttgccgtgtaaaggacgttttgcttttcgtccagcaattccacttgcactgtctgcccagcttcttttcgtaaagtagcagtaatctgtaaatcaccatcttggtaatcgtggaccaggtccgcagttacttgtaaatcttgaattccatttttaggaacacccaaaagttccacatcgcggtaaataccacttaaccaccacatgtcctgatcttctagataagtcccgtctgaccactggtaaacttgtacggtcaaatcattgacatcgtgtaaagacaccagatctgtaatatcgaactcagcttcgttgcgtgctcccttactgtaaccaaccatttgcccattaacccaaactttatacgccgagtccaccccacaaaatcgaagaatgatggtttgatccttaaattcggcgcccacttcaaaagttcgtttataaattccagttggattttcggtgggtacgtacggtggatcaattggaaagttataccataagtctgaataatgcattttgccatatccttggcgttgccaatttccagggaccgtgatttcgttcatagtagtagtgtcaaaatcacttgcaaagaaattttctgggctatattccggtgcgggcaagaacataaacttccacaccccgttcaaattcttaaaggcctgggtgtaccgattttcaccaattaacgctctttcacgagtcggataactgttaaaatgtgctcgcggcgccattcgattaatcccatctacttgatagttttcccattgtttcattttttaaccttcctttacctaattaagtcgttgtttgcgttcataacggtaccaacaaatccacgcaaagcccatgaacacgattaagccgaccacgttataaatcaacattccgattggactagcggtccccttgggcaacgtgccgtggatttcctgcatgattaaatgagggtctggtacggtagacatgaagaatacaaagatgaaggtcagtaacagaaaaattcctaccgcaatcccaaacgaccggtgccctagcttaaagctccgcggcatatcatcctttttccagcgaagttgaatataggcaatcagcaagaataatactggcagcaaagacgtcgaagcggtcatgttgatgagggtttctaaaaagctgtccatacttccaatccctaacgccggtacaatcagcaaagtcgttacaataattccctgaacaattaaagcgttagtggggttgccttcttcgttagtccgtactaaccatttaccaaaaacaccttctggaatttcagaaaagaacacctttaccggggctgccgtccaaagggctaacgaacctaagcttcccaagcataaaatcactcccactaatcgaaccattactcctccaggaatgttgaaatagttaccgagaattttaaaaatatcaaaaatcccatttgaaaaatttcccttcaatacttcagtaggaaccactaggccaactgcgacggcccctaaaatatacataattcctacaatcacggtggcaccaatcattgttttaacgaaggtcttattgccacccttcacgtctttaatgtaaactccgatactttcgccaccgcccacggcttgaagaatccaagccatcgtcatgaagaacgtccaattaaacttaggagtaatcgattttagcgtaaaatcttgtgccggcgccttgccaaacccaaaaacaacgataaaagctaaaataacaaacgcgacgcccataaatagccgggcacttcccgcaaaattagttaccttcgagatccaagaaactcccttgatacaaacccaagtcataatccaaaacaaaattactgaaataattgcaatcaccttcgtaccatggctaccttcaaaaacgtttttacccacaaaagaatacgaagcataaatcaaggtattgggtagcaacgaacagaagaagaataggttaacaaaaaaatacgaccatgctcccaaaaaggcccagcgttctccgagaactgaagctagccaactgtgaatgccagattcattttcggcgttggctgaagcaaattcggcaatcatcaaaataaacgggaaaaagtaaaataccgaaccaaatatgtatccaggaatggtcgctaaaccaatttgaatactattgttgacaatgctggggaaagcaaaaactgctgaaaaggtcatcaacattagggctactggtcctaaacgctctcttgaattgttcatgattgtaaagccttctttcatctagattaagcaattgctatacttgaattataaagcgcttacatattcatggacataataattgttgcccgtttattgtaattttgttgacattaaccaataaggagttaacccaaatgaataaccaatttacagaagacgtcagcattcttgtagataacgatccccttagcgcagaatttcacatttacgaagtcggctatgaaaaatgtcagcccactaagccttttgaatacatcccgattgactattgggtgcttcactacgttatggacggcaaaggttacttttcagccggcaattccgacttacaacacctttcggctggcgatacatttttgttgcccgctaactgccccaatatttattatcctgataaggccgatccttggacgtatgtgtgggtcggaatttcgggcgaattaactgctaagtatttagctcaaatcggacttagccgccggaatttcgtaattaacgcctccattgataaaactaaagaagtgctatttaaccacgtttaccaagcgtttaaagacaaacaaaacttccagtcgttaagcgccgtttattctttattagattatctacaacaagaaaatcacgcaaataatccggttaaccaaggaaaacagatttttgataaaatactactttacgtcgacgaaaattttgcttcaggactcacaatcagccaaattgctgctaataacaacgtagatcgttcttacttatataagttatttcagcgttatctcggtaaaaaaccgagtcagtacgttcaccagttaaaattgcagaaggcctgttcgcttttacgaaaaagttcgttaaatattactcaaatcagccaagaatgtggtttttcatcctcggcatattttaccaacgtctttgctaaagaaatgaattctactcccttaaagtatcgcaatcggtttattcgtgcgcggaattgacttatcactagcccaacgagtacaaattgtttacccgttatgcattgacacccccgtttaaaatgtcttatactagacacttcgaaaacgaggagggaatttttgtgaaaataacggtattttgtggctcccgaccgggaaatcaccccagttttaaagaggttgcctataacattggcactaccctagctcaaaaaaacgttgaactagtttacggagggtccacttcaggaaccatgggagcaattagccagggcgttctagaccacggtggcaaagtgaccgggatttatcccgaaggtctttttgaagatgagctaccgcgcaaaaacaccacttcctttattaccaccaaaaccatggcaaagcgaaaagagttattaatcaataagggcgacgcctacctagttttgccaggcggtttgggaactttagaagaagttagtcaattgttgtccgatatggcaattggattggttccacttaaaaaagtcggtattttgaatattaacggatactatgatcacttaattagtttactggataattttgttgataccgcctttatggaatccatctatcgaaagcagctcgtcgttacggacgactaccaaaaaatagtaactgctatcttagctacaactgatagcgcagaaattagcgcttaagtaaatccaatcccagataaaaacaacctgattgctaatgccttatcgtgctttagcaaccaggttgttttattattaattataaaaatttccaatagttttacttagctacccaaccaccatccacgggaataatcactccttgtagatagcttgctgcctgactcgccaagaatagggtcacgctggcgacttcagtgggctttgcccaacgttttaccggaacttcttgggcaactgccttagcaatttcacccccatccgcaaaatcctttgcgttcatcggggtatcaatacatcccggagcaattccgttaactcgaatccccttaggtgcacaatccattgcaagctgctttgtaaaaccaacgatggcatgttttgaagcggtataagcaattcctccgcctcccgcaaccattccagcaattgaagccatgttaataattactccagaatgcttcattttaggcaacgcggttttggtaacgttaaacatactggtaacgttattattgaggatccgctgccatagggttaaagtcgtgtcttcaattggtaagtagtcgtctagcatcccggccgtatttaatagaatgtcgattctttctaaaggttgaagggcttttgtaactgctaagggatcggacaagtccacttgcgtaaatttaaaatggttgggatattgtttttgaatttggtccatttgatcgatgttttgatcaaatccccacacaagggcgccttgttctaaaaaggcttgggcctgtgctaacccaattccagaattgcttccggtcaccactacttggcaatcggtaaactcggtgatctgcgacattatcctacaacctgccaatcatctgccaacacgtcacataccgtgggcgcaaagctggagtatccctcgctagtggtcttaattagcatatacggggttactggaacccccgcaaacgtttggttttccaccacgattacaaactcttcgtcaccgttccattgttggcgaattgcctttccgccttgctttaaaattggtaagattttttcaaaagtcatttaaatccctctttaatttataaattattcatataagttaattttcttggtaattaggtaaataatcaccgcgccaattgccatcgatgcaatttcccccagggctaaaacccagtaagtgggaaagagcggcaaattcatgtataagtgcatttctaaatccactaaaaacattccgggtaattggcagagcgtagcgattaagaatttaagtggtttggcaccgatgtttcgtgccgtaaagtaggttagcgtagttccgattagcgtcccggctgtaccaaaaatcatgtccaccactcccaacggactgaaaatgtttacaatcaacacgccgagggttaccgcaaaaatatagcgcttgttaaacgcggctaaatggttaaacatttctgacaaccttaactgtactactccatagctaatgggagcaaaaattagcgtgattgccacgtaaagcgccgcaactacgccagttgccgcaatgttacggttaattttactcatcaataaatcactcctagttttaatttgaggcgggatttcgcgaaccgcctgagctggtaaacgttggttaaatagttaaattttcaggcctacctccagcattttattaaagtttctaaccaattcgtttaactagccctcctcatcttacccgtctattttagaaaagtcatcctttgttttaattcatatagtgaattaaaaagcccccttttattaggctaagggccggattcagaaattaaagtacctcctcaatttctaaaatatggccaaccacctaattatttaagggaccttcaaaacagctttattaaacaaatttttctgcctatcaagctccccctaactgccccaattgctccttgctatgaattaatcctgtaatcatttggtttactggggtggcgagttgatgctttcggcctagtttgactatgtagccgttcaaaaaatcaatttccgtgaggcgttgcttattcaaatcttgatgcatcgatggataatgttgcccactagcctggggatcgaactgtgcttccagcatttgtttaattatccttacgctaaagggaattccctcagcctgtgctaccgcgttaatttcttctaaaattagatcggtaagttgggttccgtaattcaattgcccaaattccgccacgttgcaatttaataaggcggataagggattaatcacactgttaaaaccagcttttcgccaaatcgattcgtggacatttttgactaagcttgcttggagtcctgcttcattcaaaagatttagcaccgtggttaactttgctggagtaaaatcagaagaaacggcttgaaaatcaatgcgcccctctcccgttgctttaatttgccctggtcctagcagctcggaagaccatagtgtcaccccaattaaaatttggtctgctgagacaaactgtcttaaagtttcttcgttgccaaacccatttgataaacaaagtaaggtggttggttcatcaatgatggggatgattttgtgcagaaaatccgccatctgcatcgccttggtaaagacgattaccaagtcaaatcgcccagttgcttgttctggaaaaagtgctggaatatggtagtttcgagtcccttgctcattttccactcgcaaacctgattgattaattgtttgaatatgttcttgccattggtcaattaacgtaacttgcacaccagcctcggcaagcatcgcgccaaaacgacaccccattgcgccagctcctgcaattgctactttcataattttttcactcctttttgttcgattctttgtaaagcctctttagcccaagcctttaataaataaattgcgagtactcctaaaactaacaaccccattgcaataataaagacgattgcaaaagaatgcgtatacttaaagaaagcggccgttacgtatggggcaaccaccgcgccaattgcaaaaccaaaataaataaacgcataatttaatccttggttacgtagcccaaaattagcgctggtgatacttggaaacacagctagcacacctgcatagcaaaagccgatgcctaatgcacaaacgtaaaaaaggcttgtatttcccttaccaagcagtagtaaggccataaaaagcgccattagtgcgtaaactagtgctaaagtgtggtactcacccaaccagtcggaaaccgttccccagattagccgaccgacggaattagcaatggaaactccactaactaccaccgcaccagcagttaagccgtacgctcccatcccaatttgcgccgacgaactactaatgaccatcccagaaaacacaccaaaggccatgatccaaaacatcagccaaaaacgccggtcttttagcattccccgccagttttggtccattttagaagccaccagctgtttgctatccttggctggtgcactgcgaatgaaaaattgaactacaaaaatcactactaaataaaccatccctagccaaaacaaagactgactaatattcatcttggtcaagaagaactgcgctagcgcggtacataaaagggtccccacgccaacgccagccagaacgcagcctgaagctaatccccgtttatcaggaaaaaacttaattgcattattaaggttgccagtgaaggccaacccgcttcctactcccgcaattaaaccgtacgttaataatagcaacggtaatgtttttacaaatccggatagaataaatccaattgaaaataagactccacctaacacaattgctaatttcccatgtccacgatcaattaatgccccaccccagatcatgggtagggggataatccccatatttatggaaaacgctaatgataaaactgccggatcccaatgatattgcgcaattaaaggcgttttaaaaaagctaaaggcgtaaactccgcctaaaacaaagttaattagcacatgcgccgtgagcattacccaccgattcaagttctgtttcatctgccactctcctaaagttaaaaatttcacaaatataattcaaaaacatgataagattaaaagcaaaaagaaacaattctcaaaaaactattagagtaattaacttttactatcgatgggaggcctcctaatgaatttaagacagttagagtatttcctagttttgagtgaagaacttaattaccaccaagcagccgaacggctatttattgctcagcctaccctgagtgtccaaatgagtaatttgcaacgggaaattggacaaccattatttttgaaagttgggcgccacatcatgcttactaacgctggcctgattttacaatcccatgcccgtaagattttacggcaagttcgtgccaccaaacaggcgcttcagccacgttcggaacctgcctcaattaaaattggcttgtctggaacccatcttttaacgccactgttgaagacatttcaaaaaattaacccacaaacgtcattcacgttacgagaaaatacctctgctagcaccttgaaacagcttttaaacgctgaaattaattttggaatagcttttttgcccattcataatcccgccattaattaccgttacttattcaccgacgaaattattgccgttaccactaaaacggggccgtaccacactctcgagaacatcacgcttacgcaacttaccaaagtaccattaattgttttagatccgcaatttgccattcgccagaccctcgaccaactgtttttaaatcaacatttgtcgcctcaatacctagttgaagtaacctcttattcagcctgcattagcgcgcttagccaattaaccgggatagcactcgtcacccgctccttttttgaaacacaaaaagccggccatgccgacttaaaagtgatttcagttgaggaacctggtttaaaacaagcgcttgccttggtttttccagcggacattccgccttcgcccaaaacaaccattcttatggaccaaattcaaaagtattatttaaccaaggaacagccttcttagtaatgccgccgccgaaaaatttggtaacccaaaacggcaaagacgatggcatatcccgcggttgccatccctaattgcaacgtcgaaaggtgcgacatatcgtgatacactgggtaatttgcgtattgtaagggtaacaacatcatatttaatggattccaacggagccagtggagatattgctgtggtaaaaattggattccaggaggcacaatttgccccataaagaaaactcctaaactgattgctaaaacaaccgcattttcagtaatcgaacaagaaattaagaagagaatgctgactaagaacatggttaccaaaatatcaaccagggtcatggttagcacgttagttaaaagactttggtgatacaaatacggtttaaataagtctaagcgaaattttggtagcgcaaaatttaaaattagggtcattattaccgcaaaaccatgtatcgcaacgtcacaaagcccgacaacggttaattttgctaaatagacatccttccgactgggggtttttgctaacatcgtcaatattgttcgttgcttaaactccgatgaaaaaaggttgccgcaactaaaatcattatcaaaggggcaatttcatcaattccgaaactcgacattaccagccagggcgccgaaatggcatcatcaaaagacatgatgaaaggaatcattagtaaaactattaaaaacggtgcaagccaagttatttttttatgtagcaacttataagcttcttgattaataacggttatcaaaatttcaccttcctatttacttcgttgtccccgactaaaaaacaggtaacttagcatggtaaaaataacggcataaattgtcgttccccaagctagttgcgcagtggataatttagtaacgctctttaaagccggattcgcgacctgacttacaagttgcaacatgttcaaggggttccacttaatccacggcccatcaataattttggggagtgcccctgccaaggttggcccggtaaaaatcaatacgaaactaaatcccatagccacgattttactccgggttaaacaagtcatcccgatggttaaagcggtgattaaagcaaccatcccggaggctcctaaccccgtcaaaagcgtggcattccaaagggaatggtggtttaccactaaatcccatgtcaaggtactagaagcacgggttgcctgaatcaccattgtgaatattcctcctgccaaacttaaaataagcacgtaacccagtagaactagtaatttagcaagaaaaaccccgccacggctggtgttcttataaaataacgtgtcaatggtctcattttcgtattccccgccaaaatcagttgctaccaaaatactcatcaccagcgcagcccatctaccccaatcatagctctgggcaactgaatcaaacgtcgtcccttcaagccaagccgaaacggccataagcaaccaaagggctacgatgccgccccagtagcctcggcgatgaatgaatttatagaactcttgttgcaaactgcttctcattagcgcacctcctggcgacttctaagcgacttcaccacttgctgctcaaaagttagtttttctggagccaccgttaataagtactgctcattttccaacaacagtttttcggctgcttgaagatctggagcgttgatctttaaataatctttttgtagctcgcttaccaccccgtgattttctaataattcatagctagcaaataaattgtcggttgtaatctggtaataacgagaattcccgctttggaaattttttaatgaatcggttaataaaatcttgcctttattaatcaaaaccacgttagaaactacccgctcaagctcacttaaaatatgactagaaatcaggaaagcggtccctttttgggccatccgtaaaattagattacgaactaaaatggtcgcttccacgtcgagtccgttcatgggctcgtccaaaatcactagatccgggtgatttaataatgctaacgcaatccccagtttttgcttcattcctaacgaatatccctttgcccgtgcgtcaatataagcttccatttccaacgcacgtgcgagttcatcaatttcgacctcgctttgtgcgtacaaagccaaattttgccggcccgtcatgtatgggtacaacgcggggtgttcaattagcgcccctactttaagaagggcttgatggtgatttgaggtaaccgtttgatgatttaccaagacctgccccttaaattttgtcaaggctaatatggttttcatgatcgtcgtttttcctgctccatttggtccaatcaagccgacaatttccccatcgccaacttgaaaagacgcccctttgataatttgttttctaccgataaatacatcaagctgttttacctccaacattaattttcaacctccgttcagttatagtgttctatttatacattacactataactgattcaacatgaaaaatgcaagcctttttccattaacctcatattttaatttaaccaaataaaaaccccgaggctgcattaatgcaacctcaaggtcctttattgatttatttttttaaatttaagttggttgccgattcccttgtttgtaaatctcattaccgtcatagataacccggttaattgcaaacgtgttatcttggccaaatgtagcttgggttcctaaccagtagtactcaggtgttagttgagtaagtcctttacgcaggtttccagctttttttaacaagtccagctctgtcttattgatcgccgaacgccaatacctcaccgcaccatcagcaaattctactcgcagaaataaactcggcagcaatgctacccgaacaacttttggaatatcttgcatttttacctcccgcacttaagtcttaacaaaatagcgttttcatctacagaataagcttaacatcggcaacgatttccctcaacgcaatttgtgagaaaaaaatattttttataagcatggttaagcatattcttagcttaaccattagtgaatttgctaagcttaaggtgttccaaaaataataaccttatgggaggagatttattatgaaagcattggatcttacagcattaatcttggtaattgtcggaggtattaactggctcttggttggacttttccaatttgacctagttgctaccttattcggcgggcaaacagcaattatctctaaaattgtatatattttagtaggtttaagtgccctatacagcttaaaattcctcgggatgcttagtcatcgccccgaagacgacgcacgttacaacaatcgttaattttttgcactacgactttacgaaagcgtgcactaaaagtcgggtagcttatcagtattaactaaaaatcgacgtgatgcctggattgggcataatgtgatatccctttgtggctgacagatgaaatatcataatttatctgttaatcatggagggatttttgaatgtctagatctgagccccccgcattagaatagcttttatgttaaacagcgtaaactgacttttgattttattaaagttaacctcctaagatatttttttcagcctcttttaattatggcgtgccgttttaagcaaatcattatgcaaaccatcgactctttgttacccttaagctaatctaaccgggtaaccgttttaaatttgaaggagggatgatttaatgactaaaagaagtccaaattggatcttattaatcgccagcattatcgttgtagaattggtcggaagcctatcggggatattatcaggtgatattaaagcaatttataacaacttaacgttgccgcccttagctccacctgactttatttttggcattgtctggccaattttatacctaatgattggaattgtcggttatttaattcttcgtgaccggaccaacgcacgccaaaataacttgattttgtttatcagccaattagttttaaacttcatttggagcatcattttctttggcgcaagcaaccgttggatcagctttttaattatcatcgtactcgatgcactagtgatttggtgtgtgaaaaaattttggcaaactagtaaattagccgctagtctaatggttccgtacttgatctggatcttatttgctacctacttgactttaggaacggcgattttgaattaaatataaacaaaaaacgttgaaaatagagcaatcccctattttcaacgtttttaattgtcttcaatttaattaattcataaatttatcaaagaaaccgcccttgccgttgcctgacggatgttccccactcgccttagcaaagagcttcaaagcttctttttggcccgcattcagcttcttaggcaccttaaccttcacgtggacgtgttggtcaccgttgccattgcctcgtaaacgaggagctcccttgcccttcaagcggaagttagttcccgtctgcgtaccagctgggatttttagcttaaccttgccgtgaacggtaggtacttcaatttcatcccccagtgcagcttgtacgaaagaaattgactgatcatagtaaatttctgaaccttcgcgctcataaatcttacttggctgtacttggaaaatgatgtaaaggtcaccataaggtccgccattataaccagcttcaccttgaccttgaagccgcatttgttgaccatcttcaacaccggctggaacagaaacctttacttcatgttcttgcttagtgtgtccagtaccaccacaagttgggcacttctctttaatttctttaccagttccgttacatacgtcacaaacctgttgccgaaccatccgaccaagcggagtgttttgagtaacttgaatgctacccgttccgtgacatttatgacaagtttctggcgaagtccctggtttagcacccgatccgccacaggtcttacattcagcttctcgtgaatacttaatcgtcgactttttaccgaaaatcgcttcttcaaacttaagcgtcatttggtactgtaggtcctctccttgtcgtggctggttagcggcctgtcgctgaccaccaccaaagaaagaactgaaaatgtcgtcgaatccgccgccaaaaccaccaaagccgccttggtcgccgaaaccaccgccaccaaaaccagcgttgccgtccgcggaaccaaattgatcatattgcgcacgcttttgcgcgtcccctaagacgtcgtaagcttcgttaatgtctttaaacttttgttccgctcccggctctttgttgatatccggatggtattttttcgacaagcgtcgataagccttcttgatttcatcttcagatgcatcgcgactgactcccagaatgtcatagtaatctttacttccagccatattcatcctccatgatttttaccagttttaaccgttaatcaccgcaaaagggtcaaagtcaacgacttcgacccttcattgctaatcacttatttatttgttgtctttgtcaggatcgacttcttcgaaatccccattgacagtgttgtcgtcgttattaccggtattctggtcgttaccttgagcaccatcagcttggccttgcgcttgttgcgcttgttgcgcttgttggtaaagctttacagataagtcttggacaatcttgctcaaatcatccttcttagctttcatttcttctaagttgttatctttttgtgctttttcaagagcttccttagcgtctttagccttcttgatttcgtcttcagaaaccttaccttcaagttccttcaaagtcttgtcggttgtgaagatcaattggtcaacttcgttacgaaggtcaacttcttccttacgcttgcggtcggcttcttcgttttccttagcttccttcatcatccgttcgatttcttcatcactgagacccgatgaactcttgatggtaatcttttgttccttaccagtacccttatccttagcagaaacgttaacaataccattcttatcaatatcgaatttaacttcgatttgtggaactccccgtggagcagctggaatgtccgttagttggaaacgacccagcgtcttattatccgccgccattggacgttcaccttgaagtacgtgaatgtctacagctggttgattatctgctgcggtagagaagatttgagacttgctagttgggatcgtagtgttccggtcgattaacttagtgaacacgccacccatggtttcaataccaagtgaaagtggagttacgtcaagtaaaacaacgtctttaacatcaccagttaaaaccccaccttgaacagcagcaccaagggcaacggcttcgtcagggttaatggaatggttaggttccttacccgtccagttctttacggcttcttgaacagctggaatccgtgttgaaccaccgtttaagataacttggtcaatgtcagaagctgataggccagcatctttaagggcgttgtcaactggtaccttagtcttagcaactaagtctgcggttaattgatcaaattgtgcccgtgtcaaagtcttttccaaatgcaatggaccagcttcgccagcggaaataaatggtaagctgatttgtgcttcgctaaccccagacaaatctttcttagctttttcagcagcgtcctttaaacgttgaagagccatcttatctttagaaaggtcaatgccgttttcttccttgaagccttcaactaaccaatcaataatcttttggtcaaagtcatccccaccgaggtgagtgtcaccatttgttgaaagtacttggaaaacaccgtcgccgagttcaaggatcgaaacatcaaaagtaccaccaccaaggtcgtataccaagatcttttcatccttgtcactcttatctaaaccgtaagctaacgcagaagcagttggttcgttgatgattcgtttaacttccaaaccagcaatcttaccagcatcttttgttgcttgccgttgagagtcatcgaagtaagctggaactgtgataacggcttgatcaacttcttcaccaaggtagtcttccgcaaacttcttgatatagctcaaaatcattgcagaaacttcttgtggggtgtatgacttaccgtctaccgttactttgtatccagcttccccgatgtgacgcttaattgaagaaatggtgttagggttagtaattgcttgccgctttgctacttcacccacttgtgtttcgccatttttgaaagcaactactgatggagttgtccgtgccccttctgggttagtgataattttaggtttgtcaccatccatgacagcaactgcagagtttgtagtacctaagtcaataccaataattttattacttgccattgtctaaaatccctctttctctatcttttattgagcaacaacgaccatcgctggccgtaatactcgatcctttaaaatataacccttttgaaataccttaactacggtatccgcaggatggtcatcgtctgctggaacggtctgaaccgcctggtggaggttaggatcaaacttttgaccatctgcctcgatttcagcgatatcattttctttaagggcttttaagaggtccttttgaaccatctctacccccttcaacagctgttctgaatgctcagcttccactgtcaaagctcgttccaagttatctaatgcaggtaaaattgcctttgctaatttttgaccatcatattttaaaatactagcttgttccttttcgttgcgacggcgcatgttcacaatttcagcttgcgcgcggatatacttgtcggaaagctcatcacgttccgccgtaattttttcaatttccgcaggatctaaagtagcttgctttgaatcttttgcggaatccttttgattattcttttcgtcttgggacgttgctttagcttgcttgtcagcgcccttactttcttcttcaacctttgcttcggttgaagctgattttgccttttcgtcttcctttgccaattcaatcctcctaactgtcatcaagatgcttatagtattgtagcattcggtgtgataattggtacctaaacgtattgatcaagcccaaggtcttcgaatactgcatactggttggaccaagaatggcaattagtcctttaccacggctccccacatcgtaagttgccgtaattaaactaaaatcctttagcaacgcgttacttaactcgtcgccaattttcacatccaagtcactccgcttattacctagcagtccgtcaatttgctcattttcattaaacagcgttagtaacccccgaagtgaatttacatccacattcttcgaaaagtttaaaacgtttaatttgccacccacgaaatagcggtcacgagttgaccgggtaacgatgtcttggaaaacgtccaaaactcctgcatcactctgcaagtatttttccactacctgcggaatatccgtccgcaaatggtaatatacctggctcaacgttttgcctaccaaccggtcgttcatgatgcgaactacccgttctaaggtttcgccgttcatctcgtgtggaatactgaactgttggctagtaacgtcgccattactagaaactaaaatcagcatcacctggttgccgcctaacggaaccattcggaaaccgtctaacgtggctcccttttgctccggcttaagcgttaaagctgtataatgtgttaaattggaaagcatttctgctgaagttcgaacaatgtcgtcaacttcttggaaatgagttgctagtcccctttgaatctgtagtgcttccgtctgatcgacttcttctgggcgaagcaagtgatcaacataataacgataccccattagcgatgggacccggcctgaagaagaatgggtcttttcaattaaacccaggtcctctaatttagccatatcgttgcgaatcgtggccgaactaactttaatcggcagattgttcatcaccgtcttggaaccaatcggtttaccattttccgtatattcttgaacaatttcctctaaaatcaataattcacgatcagtcaacatgaaaatcacctcttttagcacttagaaagtcggagtgctaagaacaactattaagataccagaggtttgtagaaatgtcaactttagtcaagcttggtcagacaactttaacgcttcttaaaaaatgcacgcgtatctgcttcatcctggtgcaattgcgcaattaacgcgtccaccgaagcaaacttaacttctccccgtaagcggtggtgccatttaacccggaccgtctcaccataaatttcttgattgaaatctaaaatgttaatttccgtagttacggggcgaccgtccccaaagacaacgttgcgtcctaccgaggccatccccgggtaccatttatcggcaatcttaatttccacaacgtaaatgccaatcccaggagtgatttgattaggattgctaacaatgttcgcggtaggaaacccgagggtccttccccgcgcttcgccgtggactactaagccattagtttcaaaggggtaccctaaatatcggttagcttcgtcaatctccccgtcggcaacggcgtttcgaatggcggtcgatccaattttttgcccttgtgcaatgattttaggtactttaactacttcaaaacggtgttgcgcaatttctggcaacgtatccatattagccgtggcaactggcccaaaagtataatcaaaaccggccaccaccacttcagcatttaatccgaccatgtattggtcaacaaattcttgcggggttaaactaccaaatgcggaagtaaagttaactacgtaaagaatatccactcccgccgcttccattaactctgctttccgagatacagaagttaggtagcttaacgcgctaaaccggtgctgcggcttggggaaaactaccgaagcgtggtgatcaaaagtcattgccgccaacgctaagcccttagcgttcgcaatctcacgagccttttgaattacggcttggtgaccacgatgcatgccatcaaaaaatcctaaagcaagcaccaccttttcttcgggaatcatttttttatcatacggatgatgtatcttaattatttgcatttatctcaccaacaacattttttctgggcggtatacttgacgagattcgtcgtattggtacagcgcctgaattttacctttatacttaacggcaacaaccggttcggtaagcgcgcgtttcaaaaagcccccgttttgaactaattgccactctgaatcagtaatttcaattgcttcaaactttgctaaagcatggtcaatcggatggagcacatcactttcgacccggtcttcgtcgcgagcctgctcaagttctgccaaagtaacgcactcttttagttcaaaccctccgctacttgtccgagttaaatcagacattacggctggcaacccaaattgccgaccaaaatcgactgctaaggtcctaacgtaagttcccttaccacactgcacctcaaaataaatagtttgttctcccttttcctcgtcgaactccgtagggcgaatttgtttaaactggtacacttggatttttcttttaggccgctccaccgtttctccggcacgagcatactcatataacttgcgcccattaaccttcacagcagaatacattggtggaatttgagttaattccccggtcatttgctttaaggctgcatcaatttgagcgtccgttagtggtttacttaaggggtgccgttccaccacttctccatccagatcctcagtggtggtcgccaagcctaacgtaattgatccttgataagttttaccaaagcgcattaagtaatctaccacttttgtagcacggcctacgcaaaccggtaaaaccccatccacgctaggatctagggtaccgctatggccgaccttcttggttcttaaaattccacgcaccttagcaaccacgtcgtgactagtcattccgcgttccttattaattggaataattccatccatcaaaataaacctcacatttctcgtgcaaatttgctcttcttaagtattttacagtagataccgtggaatacaaaatgttcatcccaatcagtatctcccactaacttaaaaagagcaaccattcgacctggaatggttcccataagctgcttacttgctggaaacgttcctgtccatgattgctcttttaacttagtcacgattaagtttattaatcagctgatcaattttttcaccgtactgtacagaatgatctctttcaaaaatcaattctggtgttttataaattgataaccgactacctagttctttgcggatcaaccccgacgccttttcgagacctttacgggtcttttcgtcgtcagaagctttatccgataagatgctgtaataaatttttgcttgttgtaagtcaccggtaacgtctacgcccgtgatcgtaactccctgcacgcgagggtcacgaactcggcgacgtaaaatgtcactgacttctttttcaatttcttgtgacaaacgatctgcacgatattgtcgagccatcttcaaatcccccttactattcgactgggacttccttcatccggtatgcttcaattacatcaccgactttaatgtcgttgtacttttcgattgttagaccaagatcaaatccgcgcttaacttccttaacatcgtccttgaagcgccggagactgcctaacttaccatcgtaaatgaccacgccatcccgaatcaagcgtacgccggcatcccgggtgataaatccttcggttacgtatccaccagcaatggttccaatccgagaaactttgtaagtttcccgaacttcaacttgtccgattacttcttcttcgtaaactggttcaagcattcccttcattgcggattcaacttcttcgattgccttgtaaataacttggtgtaaccgaatctcaacgtcttcagagtcagccatttgcttagcttgtgccgttggccgcacgttgaatccgataatgattgcgttacttgcggcagctaaagtgacgtcactttcgttaattgctcccacggccttatgaataatgttaacccggacgccttcaacatcaattttttgtaaactatctgctaaggcttctaccgaaccttgcacgtcagctttaataatgatgtcaaccttcttcatttcaccttccttaagtgaatcgaagaggttatctaaagtaacgtggttgttacgtttgcgttcttccatttgagcacgttttgcccgttcttcaccggctgcccgtgctgatttttcgtcatcgaagactacgaaacggtcaccagcttcgggaacgtcgtttagtcctgtaatttcaactggggttgatggagtagcttccttaacccgccgaccatgttcgttagtcattgtccgaacccgaccaaacgtgtttccaattacaactggatctcccacgtgcatagttccttgttgtactaaaacagttgcaattgaacctttaccagggtccaattgagcttcaattacggaaccagccgcattttgttcagggttagcttttagttctaagacttcagcttgtaacaagatcatgtcgagtaattcgtctaagttcttaccaaacttagctgaaatttcaacaaagatcgtgtcgccaccccatgattcaggaatcaaaccatattccgtaagttgttccattacgtggttaggatttgcacctggcttatcgatcttattaaccgcaacgatgattggcacttcggcagccttagcatggttaatcgcttcgatagtttgtggcattaccccatcatctgcagcgacaactaagatggtgatatcagtcacgtcagcaccccgcgcacgcatttcagtgaaggccgcgtgtcctggagtatctaagaaggtgattagcttgtcgtcatgcttaagttggtaagcaccgattccttgagtaatcccaccagcttcgccttctgtaatgtgactatgacgaagtttatctagtaaagtagttttaccatggtcaacgtgtcccatgatggtaactactggcggacgattttcaagatgatccgtgttcttttgttcatcttcaaacatcttgtcgatatctgaaatatcaacttccactttttgttgtgcttcgattccgtaatcggccgctaatagttcaaccgtgtcattatcaagtgattgattttggttaaccattacacccatcatgaataacttcttgatgatttcagctggttcacggtgaatctttttagcaatttctgcaacgttgatgccttcgctatattcaagtacctttggcaatggcttttctttacgagccgtaacgaccttcttttggctttctttcaaacggccgtcgcgttttgccttacggtttttcttcttgtttttacggttttctttgttgaaaggacggttgttgccccggttattgttaaaccggttgccgttcttagaaccgtagtttttgttattgtttgtccgttctttgcttgcttcaggtgcagccactgcttccgcaaccaccggccgcttgttagtttgcggagtagtgttagagtggttttgatttgaacgcttatgttcttgtggacgttcagcattatttcttacgtgctttttatgagcaggttggggcttttcatgagcaatttcacgatttgcttgagctgccattcgtgctgcttccgcaactgatgcccgaatcgctttttgcttgtcttggcgttcgctttgttcacgctttggccgattttgtccgttattttggtttcgattacggttttggttatgattttggttgtgattgcggttatcccgtgttcggttattattttgccgcttttcttcttttgtatgatctgtatttttgttgtcgttagtgtttgatttcaatctttgaatacccttcgcaccatttttatttggttggccgctctttttcacaacggtcttaccagttttactagagcggaacttcggtgtccgcttttctgccggtttttcggagccagcatttttcttaaaagcttcccgaaggtgcttttctgaatcggcatcgagtgttgacatgtgattcttgatgtcaagaccatctgcttgagccttttcaataatttctttactcgaaacgttgatttctttggctaattcataaattctttttttgcccatcgtttcacgctcctattcatttaatctcttgaggaacccttctgcgaaacccttattggtggttgccactaccgagcgcgattgtccaattgctgcagaaatttctgcttttgagccagcaacgactaccgggatttcataaaaatggcatttatcaataattctcttcctactggattctccaatgtcttctgccaaaagtactagcctggcttttttgcttctaattaaattcaagaccaattcttgccccgtcgtcaagtttcccgaccggcgcattagccctaaatattgttgaactgcgggtttcattacttatccccaaacaattctttacgggcctgttggtgatcaacgtatgcaattaagtcatcataaaattgatcatcgattttaacctgaaaagtacggtcaaaaatccgcttttgcttggccttcttagcaatttcgacgtctagtccaatgtaagcaccgcgtccagcggcttttccagttgggtcaatggacacttcgttttctttgtttttaaccacccggactagctcgcgttttggaaacatttggttagttacaatatctttacgcatcgggatctttctagttttcattgaaatgtacctccaatgggcttattcttcgtcgctatcgtcgtttgattcactttccaagacgttttcatcaactgtgctttcgtcagcactgctttcaacttcagtggcagaatctgctacttcttcttcgtcatcttcttcaacaaattcagcagcatcagtttctgatttaatatcaatcttatagttagtcaatttagcagctaaacgtgcattttgtccccgtttaccaatcgctaatgatagttggtaatcaggcacaatgacgatgcaagaattttcttcttcttcgttaaataaaacatcgattacttctgctgggttaagggcgttggaaataaattctgcatcgtcatcttcccattcaattacgtccatgttttcgccatgtaattcgttaacgatggtttgaatccgttgaccgcgaggacctacacaggttccaaccgcatcaatgtccgggttatttgaccgaaccgctaccttagcgcggtcgccagcttcccgtgcaacggacataatttcaaccgtcccgtcgtaaatttctgggatttcttgttcaaacaagcgtttcaacaatccttcatgactgcgagaaacaaaaatttgtggtccacgtccactatactctactttagttacgtataccttaatgtggtcgtgtggttcgtattgttcaccagggatttggtcttgtttagacattacggcttctacgccgcccaagtcaacatatacgtaccggttatcccgtcgagcaacttcaccagttaccatttcatcgaggtattggctatacttttcgtaaataacttcgcgttctgcttcccgtacccgttgcataattacttgcttagcggtttgggcagcaatccgtccaaagttttttggcgttacttcaaaacgaatttcatcatctagttcgtaagcccggttaatttgcaaagcatctgctaaactaacttgtaattggtcatcttccacttcttccactactttcttgacagcgtagacgtggatgtcacccttccgttcgttgaattctacttcaacattttgtgcttgaccataattacgcttatacgcagaaactagggcagcttccagcgcttcaataactacgctttgcttaattcccttttccttttctaagttagcaagagcggtaaccatttctttactcatttttaactctcctctaaatcttgattgctaatctagcaaacgccacttgattgtaagcgactttcaattctttatgtctagttttatctaggtaatctaaaactaattcatcattttcaaagctcttgaggtatccttcaaacaccttttgcttgttgattgacgcatataatgagatatggatatattcccctacagcagctgccaagtcctccttagtctttaaaggacgttctgctcctggggaagaaacctccaagaaataagcttgtggaatcggatcgggatcttgctgatccaagagttcgcttaattcgtcgctgaccatggcgcattcttcaatgttaattccgccaactttatcaatataaaacctgaggaaccaaccctgaccctctttcacgaattcaacttccactagttggaaatcatgactttcaataacgggtctagctaattccgttattttttcaacaacattgctactcaaatttgaacctcccgatttatattttgccaataaaaagagtgagcatcgctgctcactcacttaacgagtatcaaattactaactctaatatagcattgttttgcaaagattgcaaaataatctagaaaagactcaattgattttcatcaggtaaccctgctaaaacattattttcggtcataaaatcaattagcgtttgagaaacgtggccccgttttgcaagatcttccttagaaaggaacggcttatcggcccgagctgccacgatttgtttagcaacgtttaatcccagaccaggaagcgcgttaaatggggcaatcaatgagtcgccatcaattaaccactcttccgcatccgatttttcaaggtcaatcatcttaaagttgaagcctcgttcgaccatttcattagctaattccaaaacagtcaacaaattcttttcttttgctgaagcttcattacccttgtcattaatttcttgcattcggttttttaaggattcttttccccgagacatcgccacgatatcaaaatcgtcggcacgcacggtaaagtatgctgcataataaactaacggataataaaccttaaagtaagcaatccgcaacgccatcaagacgtaagctgaagcatgggcccgcgggaacatgtacttaatcttcccgcacgactcaatgtaccaatcaggaacgttagctgcacgcattttttcttcgtaaccttctggaatccccttacctttccgaacactttccatgatcttaaaggacgattgcgaatcaagtccataatgaatcaagtccatcatgatattatcccggcacccaataacatcttttaacgtaatggttcccgctttaattaactcttccgcatttcctaaccacacgtcggttccgtgagaaagtcctgaaatctgtaatagttcagaataagtggttggatgggtttcttctaacatcccccgaacaaacctcgtaccaaattctggaattcctagtgtaccggtcttggatttaatctgttcttctgtaactcccaacacttcgggaccggagaagattttcattactcccgggtcgtcagtaggaatggtttgcggatcaatgccagacaaatcttgcaatttccggatcatggtcggatcatcatggcccaaaatatccatttttaaaatattatcgtgaatcgaatggaaatcaaaatgggtcgtttcccaggctgcagtttggtcatccgctgggtattggatcggactgaaatcatagatatccatataatcaggcacgatcaaaattcccgctggatgttgtccggtcgtccgtttaactccggtagctcccttggcaagccgttcaatttcggcaccacgcaaatgctggttagtgtcccgttcgtaagccttcacgtagccataagcagtcttatcagcgacggtaccaattgttccagcgcggaaaacgttattcttaccgaacaaaacttgcatatagttatgcgcaattggctggtagtctcctgaaaagtttaaatcgatatccggaaccttatctcccttaaagcctaagaaagtttcgaacggaatgtcttgaccgtcaccaatcatcaaagtaccgcattctggacacttcttatctggtaaatcgtatccagaaccatattcccctttagtatagaaatgagaatattgacagtttggacagcggtagtgtggcggcaacggattaacttcggtaattccagacatcgtagctacaaaactagaaccaaccgacccccgggaacctaccaagtatccgtctttgttactcttgtgtactaaccgctgggcaattaaataaattactgagaaaccatttccgataatactggtcaattctttatctaaccgctcgctaactatttcgggcaattctttaccataaagagcatgagcctgatccattgccaactgcttaattcggtcctcagcacccggcattttaggcgtatatagcttatccttgaccggactaatgtcatcaatgctatccgcgatttgattaggattttcaaccacaatttggtgggcagtttcttccccaagaaaacggaaggcttccagcatttcatccgtggtgcggaagtgcacgtcaggcaattcggtccggtttaacgggttagctcctccttgagaattaatcaaaatcttccgataaattgcatcttgcggattaaggtagtgcacatcgccagtagccactaccggaatatctaaatctttacccaatttaacgatattgccgataatttcttccaatttgttagtgtcactaacgatttcttggtcaattaacggttggtaaactggcttaggcattacttccaaataatcataaaacttagcccgatcccgtgcttcaacgtaacccttttgtgccatcgcggtgaaaacctcaccgcttgagcaagcagagcccacaatgatgccttcccgtaatcgttctaactctgaacgcggaattcgtggcacccgatagaagtacttaacgtttgacaacgaaactaatttaaatagattcttcaacccagcttgcgttttggcaatcaaaactgcgtgattcggccgagcatgtttatacgcgtcgttttccgtcatgtgatcatttagttgatcatgatattcaattccataacgctcttcagcatcttttaagaacaaatagcaaaggtgtccagtcgtttccgcatcgtagatggcccggtgatgatgttctagagctacgttaaactttttagccaacgtatttaaccggtacccttttaaggttgggtataggaaacgcgctaaggttaacgtatcaataattggatttttaatctcttccatcccgtgccgtagatagccggtattcataaaaccaatatcgaaggtaacgttgtgcccaacaataatcgcgtcttcataaaattcccggaatttggtaaaaacttccttttccgaaagcgaaccccggaccatttcgttagtaatgctggtcaagttaatggtggtttcagatagcggaaatcctggatcaatgaactcttcgaattcatcaattacgttaccattttccattttaaccgcagaaagttcgattaccttgtcataaatcgcagacaaaccagtcgtttccacgtcaaagatgacgtatttaccgcctttaagtgcgcggtgtgcactgttataagcaattggtaccccatcatctactaggttagcttccacaccaaaaagtggtttaaccccgcttttcttcccagcggcatatgcttcaggaaaggcttgtagcccagcatgatcggtaacggcaatggccggatgcccccatttagcagcctgactgacaaaatcgctaatactattagtagcgtccatcgtactcatgttagtatgcaaatgcaattcaacccgtttttcgtcagcagtatcttcgcgctctgcgtgactgatttgggtgacatcataagcattcatggtaaggtccttcatgaagctatcttcttgcacactcccacgcacacgtacccaaagtccttgtttgactgccgcaaatagttgttcatcactttcattacgtgaaaacttcttgatggtaattgaagaagtgtagtcagtaactttaaaaattaaaagttgccgttctgaacgcaaagttttaacttctacatcaaaaatatacccctcgatggttaccgaacgttcctcttggttaatatcccgtaactgtgtaacctgctcttggtcactaatcggtttaccaatttgaaccttcccgttgaattggggagcggcttttttctcggtagccttcttcttttccgcttttttaattgcctcggttgctttttggacaatttccttatcacgtttaattttttcctcgtgatattgggctaagcgttgttcggctccatcattgtcaatcgctacctggattttaaattggggaaagccggcttgctgatatttctgtccaattgtccgtaacgcttcttcgctaagcaaattttggctgatttcattatcgaccttaaccgttaatacttggtcttgaaaatcaggaactgccttatcacatagtacctgtaataacgaggattgaatgccactatgcttaataatccaatcccagtatcccgttacttgttctttagtgattgtatttgcccgagtggtaatttggtagtctacgtttgcaatgggtttgaaagtatgtttcaaccgctcatcaaattctgcaaactgatcataaggtagaatatcgtcccactcaaaattaaaaaaccagcgtttcgaatttgcatgaaccgttaaattcttaattagtccttcgccaaccgctggcggggccgaccaatctatttgttttagcaaaattttaaattgctcattttctgataaactcaattttttggtcctcctggtaccacaatacccaatttcctaaagtgcttattaatttaggttttgcttccctaaaaaatatctggggtatgaacgattaaaagctgggttacccccagctttcagtcttcccaattattactgggcttgatttaataaaatttcgaccgtattcttcaattcagccaacttaacttcaaccgtttcgccagtttgacgcaatttaacttccacaattccttcactagcttttttaccaaccgtgacacgtaaaggaattccaatcaagtctgaatccgcaaacttaactccagcccgttctttacgatcatcaatcaaaacgtcgtaacctgccgcaactaattctgtattaatttgttcggcaacttgcatttgttcgtcatttttcgcattaactggaattacgtgcacgtcaaatggcgcaatattcttcggccaaactagcccattttcatcagctaactgttctgaaactgcagaaagtaaccgactaaccccgataccatagcaacccatgataactggaattgcacgtccgttttggtcaagaacggttgcatccaatgccttagaatatttggttccaatcttaaagatgtggccaatttcaattcccttggtgaactttaatttgcccttcccatcgggagctaattcgccttccttaacagttcgaatatctgcaaactgatctacatcgaaatcacgacccacgttgacattagtgtaatggtagccatcttcgttagcgccaaccacactatttaccatctgttcaacatacttatccgcaacaatttgaatatcttctggtcgtttatcaaaaacgggtcctaaattaccaaaatgtgcaccagttaaacgagtaacttcttcttcagttgcttcccgtaattcatcaacatgcagcaagttggtcagcttaacttcattaagttgatcatgtccacgaagtaaagctaaaaccggttggtcgtctgccatcaaaaccatggtcttgattaggcgcccagcatctacatcgagttccttggcaacttcgtcaattgaatgggcatccccagtagcgaccttttcaatttcagcgggattttcatgcatttgtaaatcttcgtaaacgctgctggccatttcgaggtttgccgcatagtcactttcttctgagtaagcaatggtgtcttctccaatcgatgcgattgcagaaaattctttagagtcatgaccacccattgcaccagcgtctccaacaatttcgcgatatttgagaccacaccggtcaaaaatattttgataagctttctcgaaagcacggaagctttcgtcgagtgtttcttcatccgcgtggaaagagtatgcatcactcattaaaaattctcgtccacgaagcaatccgtaacggggacggtcttcatcccgatacttcatctgaatttgatacaaagttaatgggagttttttataagactttacttcgtcccggattaacgttgtcatagtttcttcgtgggtaggtcctaaaataaaatcccggtcgtgacggtttttaaatttatataattcttggccgtaagtttcataacgacctgattttttccataactcggcaggcagcaccgctggggtaagcatttctaccgcgtcgattgcggtcatttcttcgcgaataatccgcttgattttttccattaccttgtatgccattggtaggtaggcgtacattccggccgaaatttggcgaatgtaaccagcccgaagcatcattttgtgactaagcacttccgcatcatttggaacttcttttactgtaggtattaaaatcttagattgtttcatattttcaattcgactccctttaaatcatttagaaaaagtatctttgaatatcgttccaagtaactagcagcattagcaacattaagaaaccaaagccgactagtgtaatcatattctctgtctccattttcattggcttacgccgaaccacttcaattaagtttaataaaatctttccgccatctaacgctggaatgggcaataaattgacgattccaaggtttaaggataggaatcccagaatatataaaactgcattgaagccttgttgggtagcttttgacgtggttgcgtagattgctactggtccacccagatcatttaaactaaagccgtgcagcatttgtgctaaagcactaaataaagccttagtcatttgccaagtccccgtaaaaccgtacataattcgagaacccagattagtggtcattgatgattgaatcccaatcattccgacctttttttgaccattattaaccgccttaggggtaaccctcaccgaacgagtcttcccatttttttgcagcttaagcgttatcgactgtttagggtggcttgaaacggcttttgaaattgccgaccaattctgcgtcttttgaccatctacagcaacgatccggtcgttattcctaacgcccgctttttgagccactccgttatcaattacctgaacttgatttgaatttgaaggcaccgcgccttgcaagatccccattaacgcaaaaaccacgatggctaagatgaaattattaaatggcccagcaaaattagttagtagtctgcgccaaaccgatgctgattggaactgtacgtcacggggagcgattcgtacttcggttccatctttttcaacaatcgttgcatcgtgatcgactgcaaaacgtttggtcgcaccttcatcaccgttttcgtaaccttcgatgaagagtgcgtcttgcagatcaaatttagtaacgattaacggtacaccgacggcagaacgaaacttctcagaagtattgattgtagttactactcccgcagaattggttgttaacactaccggctgtcccgcttttaattcctcgtcttcttcatccaagcccgccattcgtacgtagccgccgattgggagaattcgcagggtaaacgtggttccgcgtcgtttaagatcaacaatcttcggtcccatacctactgaaaattcacggactaaaatgccggacttttttgcagccaaaaaatgtccgtattcatggacgataactaaaatgcaaaaaacaatcaaaaaagtaattaccgtagtaatcatcaataactcctaactggtcgttaaagtaacccaaacagatacgccataggtaaaactaatagcaaactatcaaaacgatcgaggattccaccatgtcccggtagaatctttcctgaatcttttacgccgtagaaccgcttaagggcagattcaatcaaatcccccatctgtcccgcgattgaaagaacaaaactaaataacacggttgctactactccatggttaattgcacctaataatgagaagataactcctacaataactgcgacaacggttcctccaatggagccttcccaagtcttattaggactaatttggggagcaagttttctttttcctaatttacggccaattaagtacgcgccactgtccgtgcaccagacggttaatagtaggtacaaaatcattcctaggccaatcgtccgcgcttgtacgaacaaattaaatcctactccaatataaagcatggttaatgtgagaatgcccgcatcgtcaaagttaaaccgatttttactaaaaacggtccgaatcattaacgcaatcgcaaacacaataaaaatcgccggagtgttaatttggctgggtaaactatgtagccatgtttttggtgctactaaaaataaagtacccaaaatactcaaaattgcttctggagaaactaacaaaatttttttcatgattaaaacttcgctcatggcaactccagctagtactagagcagcaatttcaataaatggtcccccaagcaaaataattggaataaaaattattaaggccaccacggccgtaattactctttgtttcaaaactaattcctcactttttaatcgcaccaaaacgacggtcgcgtttttgatactctttaatcatttccataaaggtttgttcattaaaatctggccatagcgtatcggtaaaaatcaattcactgtacgcgatttgccataagagaaagtttgaaatgcgttcttcaccactggttcgaatcaacaaatccggatctgctaaatcgcctaaaaaactagtttgcaaattccgcgcaattaattgttcatcaatggcctccggaacaatttctccgttagcaacttgttgtgcaattgagcgggtcatttgggcaagctcatctcggctaccataatttaacgcaaagtttaagatcattttagttccatgtgcagtatcgctaattgcccggtttactgcatcttgggtagcttgtggtaagccttcaatattgccagtgaccttcacccggactccctgctcgattaattctggcacaaaggtatcaaaaaaggtaattggaagcttcattaagaatgaaacttcatcctgcggccgtttccaattttccgttgaaaatgcgtaaagcgtaagcaccttcactcctagactgcttgccgctttagtgattgttttgactacttccattccccttttatgtcccgcaacccgtggcataaagcgccgttgcgcccaccggccgtttccatccataataatggccacgtggttaggaatgttttcatttagcgttattttactttgttgatttgctttcattaaaagaagcctccaagttaatggttattattttaccaaaaaaagggcataaaatcattttcccgtgaaaataaaagagttaaaacaaccctacggtccagttttaactctaaaaatcacttcaaattaacttatccttcaagcacttctttttctttattagccacgatttcttcgacctttttgatggctttatccgtaatatcttgagcttgtttttctaaatcgtggaattcatcatcgttgtagtcaccgtttttatgagcttttttcaaagcttccatagcttcccgacgaacgtttcgaattgccactttacccttttcaccttcagctttaacgtccttggccaactctttacgagtttcttccgtaagttgtgggattactaagcgaattgcgcttccgtcgttagcaggattgattcccaagtcagcaactagtaaagcttgttcaatgtcgtttaaaacactcttatcgtacggagtaattaacaacacccggggttctggaatactaatggaggccatttggtttaaaggtgttggtgctccatagtaatctaccgtaacccggtctaatagggacgcgtttgcacggccagcccgaattgaacctaaatcacgttctaaagcttggtgtgctttatgcattttttcttcagctgttttaagtatttcgttatttgccaatttattctccccttactgttgttccaatattttcaccagcaactacctttttaatgtttcctggttggtttaaattaaagactaccaaaggaatgtcattttccattgataacgaacttgcagttgtatccattacgtgcaagcccttgtcgataatatccatatgagttaggctttcgaatttaacggcatttgggtccacgttagggtctgcagagtaaattccatcaaccccgttcttggccattaaaatagcctctgcaccaatttcagccgcccgtagtgcggaagttgtatccgttgagaagtatggactgccagttccggccgcaaaaattacgatacgattcttttctagatgacgaactgctttgcgtcgaatgtatggttcagcaatttgacgcatttcgattgatgtttgtacgcgagtaggtactcccaaagattctaaactatcttgcaatgctagagcgttcatcacggttcccaacattccaatataatcagcttggacacgttccatccctagttcttcaccagtctcgccacgccacatgtttccaccgccgacgacaattgcaatttgcactcctaggtcatgtacgtcccgaagttcttcagccactttttggattacaggcgggttaattcccgttcccttttcaccagctaacgcttcaccgcttagcttcatgattactcgcttgtatttaacttcagacattttacggcctcctatgtttttttaccttcaataaattttatcacaaatgtggttcagggtcattaagttcctttataaccgtggtaccaaatctttccattacccataaaaaaatcacggcgcctatcgcaaccgtgatttttgcaagataatgatttttattggcccatttccttacgaacttcttcagcaaaatcaaccgtttgcttttcaattccctcgccgacttcgtaacggatgaatgacttaacttttccacccttagaagcaacgtacttagcaactgtttggtcaggatccttaacaaattcttggtcatccaagctaacttctgctaagaacttgttcaagcggccttccaccattttttcaatgatgttagctggcttgccttcgccttcagcttctttagtaagtacttcacgttcgtgatcaagcacatcgcttggtacttcgtcacggttaacgtacttaggattgatagcagcaacgtgcatagcaacatccttagcagtttcttcgtcagcaccttctaataatacaagagcagcaatcttaccacccatgtgtaggtaagcaccaaaatgttcgttttcactcttttcaagagttgcaaaacgacgaagagaaatcttttcaccaataacttgagttgcttcgataatgtcatcgttcaaagtaccctttggtgatttcaacttaagcgcatcttcaacgctagctggtttttcaagagcaacttgtgatgcaatttccttaacaaggtcgataaagcggtcgtttgaagcaacgaagtcagtttctgagttaacttcaacgattgccgcagtgttatcatgcatctcaacatctgcaagaccttcggcagctacacggtcgctcttcttagctgctttagcaattcctttttcacgaaggaaatcaacagccttgtccatgtcaccatcactggctactaaagcttttttagcatccatcattccgacaccaattttgtcgcgcaattcttttacttgtttagctgaaatacttgccatttttatggcctccttagcatttaataattaaatcttaattttatgaaaccgtaaaaaaaggctgtgctaaatctcaggccataaaggtcttaaatcgcaacagcctaagtgagaattattcttcgttgcttccttcttcaaccgtcttcttcaagtcttcaagggagtctttgcttacgccttcagcaacttcttcttgttgaacagcttcatcatcttcaccttgacgaccttcaacaacagcatcagccatcttagaagtaatcaaacgaacggcacggatagcatcatcatttgatggaataattacgtcaacttgatctggatcagtattggtgtcgaccatagctacaaccggaatattcaatttttgagcttccttgattgcaatttgttccttgcgagggtcaacaacaaacaatacatctggaatgtgtggcatgtcttcgataccacccaagaatttttcaagcttgtctttttgcttgttaagaagtgctacttctttcttaggtagacggtcaaaagtaccatcttcttccatcttcttaagatccttcaaacgcttgatccgtttttggattgtgttccagttagtaagggttccacctaaccaacgatggttaacgtagaattgaccagcacgttttgcttcttcttcgatagcagtttgtgcttgcttcttagtaccaacaaaaagaacaaccccatcatttgcagcaacgtctttaacaaagttgtaagcattgtcaatcaacttaacggtcttttgcaaatcaatgatgtaaataccattccgttcagtaaaaatgaatggcttcatcttagggttccagcgacgggtttggtgtccgaaatgtacacctgcttcaagcaattgtttcatcgaaataacagacatgttattttcctcctagttttttcctccttggttatctacggtcgcaggacttcgtaagtcaacctcacaaagcacgcctttgacttccaaccaagtgtgtttttggcctcataagccgagtacaattttaccttaccttaaaactcatttcaagcagaaaaattactcaaacttgacttcattctttgaagaattcttttcaattaagtcccggttgttgtctaaggcgatttgaaccatgtttttaaccgctgggcgggtgtagaaggcagcgtgtggcgtaatcattacgttacggcgactcatcaaatcgttaaaaactgggtcatcaattggttgatcaccatgatcgacatcaaagatgccgacttcgttttcgtaagtatctagcgcagctccagcaactttaccactatctaacgcctttaaaagtgcaggtgtatcaactaaagtcccccgcgcgaagtttaggatgaaggttccgtcttgcatttgaccaaaggccttttcatccaacatgtggtaattatcctttagtgctggaacgtgtaaagtaatcacgttagcttgttggtaaagctcttctaaagtatctacatacatgcctttcttttctaatgcaggattacggaaaacatcgtacgcaattacctttgcgccaaatcctttaaaaatgtcaattgcagcacggccaatccgtccggtaccaattaccccaacggtcatttgattaagttccaaaccgatgtctggttcccaacgataatcgccatgagccattttgtattcaaattcaggaatcttacggagtaatgctaacagttgggtgactgacaattcagcaattgctcttggagaatatgctggtacgttcgaaattttgatatcatttttcttgagtgcatctgcgggtacgttatcaactccgacgttacgcagcgagaaggcatgaatcccaaattcgtgcatcttatcaaataaatcagcggtgtaaggcttttgttggtaagcaactaccccatcgtaatcctttgccaaatcaatgttactagaatctaacaaatcggggaccgctttaacctcgatatggttcttcgttacccattcgtctaaatatggtttttcatcgtcacgaattccataagcaataatcttcattgtaatattacccctttcttttttaatcaatataaatgtaccactaatgtgagaaagtagttactattaccccattattttttaaatatttaagtttctctttgcggctttgttttttaaaaaaatattctgcactcattgcatcatgctggttttcaaagctttcataataaagcagctgaaccggacgacgtttaggaacccgggtatatttagcgccttgaccagaattatgccgggcaacccgttgttttaaattaaccgtgtagcctgtgtacaacgtctgatctgcacaccagagcacgtagaagtaaaaaccgttttcacttggtgcttccatataacatttcctttactgttggtgaatattcaagcccgtcataagtaatgattggcggtaaaattctaactccattaggcctgccatccttgattgcttcgatcaaaaccatgttggcttcgtcgccctcatgcgagtgaacaaattgaatccgtttaggagcaagtcgattttgggtaaagtcattaataatttccggtaaccggtcgggacgatgcaccatgaatagttttccattcattttcaacattttttgactagtttccaaaatttcattgagggaagtcgttatttcatgccgggcaattgccaaaaactggttaggattttttttactatccggatggtttggaaaatacggcgggttgcaaacaatgttatcaacgctgtcagttttaattgttcctaatgagtctgcaagcgggaggttcaacacgcggtagcgttctttaaggtcgttaagtaaaatacttcgctcggccatctccgctaaacgtgactgaatttctaccattgtcacatgcccatgggtttttttagataaaaaaagtcctaccgctccgtttcctgcacaaaggtcaacaatttgtgccttggaactttgctttacttccgcgaaattagctaacaataccgcatctagtgaaaatgaaaaaacgctaggactttgaataatttgaatattatcgcgataaagctgatcaattcgttcgtcagcatttaacttaacttccatttaaaactccttttcaatcccattacttcataatataatcaaattaatatcaaattgaaagcaaaggttattctatatgttgtatacatttattaaacatctagtttcgggacttttaacgctgattaacgggcgcccgcaattccatcacaaagatcggttgccaagcggttcgtacgtgttagttgcaccacaccgaacgtggctagacccggttttatacgcattagcagcttacccaaagcgtttttcttttatggcgaaaaaggaactgtttcaaaaccgatttttaaaatggttaatcaccaagctcaacgcttttccagttgatcgtcagaatcctggcccatcggcaatcaaagtgcccgtcaaaattttaaaaaagggtgaactctcaaccattatttttccatctggcacgcgccattcccaagaattaaaaaacggtgcgttcgtgattgccaagctagctaacgttcccattgttcccgctgtttatcagggaccactttcgtttaaagcgctatttagccggcgaaaagtccaaattaattttggtgagccaatcgtaattgaccgaaaaactcggatgaacgacgaaaacttagcccaattggaaaaagacttaaacgcggcatttgctgctttagaccgcgaattagatccaacgttccaatatgttgacatggccgagccttcccatacaaaaaaagcgtccaaataacggacgcttttttattttttcgattgattcttcattgcggtcatcatttgatgaagctttttttgtgatggcttttgccccatctgaagcatcattgttctaagcatgtcttcgttaattggtgggttattctttaagtagttttccatgtaacgacgtgcaaagaaaaatccaccgattgctccaacaagaacggcgataattacaatcataatccaaattccagtcgacattgtcaatcctcctcgtgaacagtctgccttttcattttacacaaaaacaagtaaaaacaaaagccccgtttaatcgtcacgtaagccttttttccgttgaactttctttaccttttcaggggtgacttccttaccatctttatcaaaaatcttcatcatttcaatttggctccgaaaactttctctaaaccgttttaaatatttttgtcgcaattccttacgttcaatagtttcaagctcacttaagccttcttcttttgctttttttgctaattcattaatccgtttaattagcttttgcatttcttgatctgccattactattactcccctttatttatttcgtttagtaaaatgcgaacatctgtttgagaagttcacctgtctatgttaaaattatatcaaatattcgtggggtgaaaaaatgataaagaatttgagtactaagcaacttaacgttcttgagtatatctatcaaacggtccaaacgcaaggttatccgcctaccgttcgagaaattggtaaggcaattggtttatcttcgacatcaacggtacatgggcatatcgatcgcctacaaaaaaatgggtacttagaaaaagatcctactaagcctcgagcattagaaattacggctcaaggcttagaagcgcttggtattcaagaaaatgacgagcaaatcccagttttaggggtagttaccgctggggaacccatcctagccgttgaagaagctaccgactttttccccgttccaccagaatttaaaaatgaaagcagcgatcttttcatgttgaccattcgaggggaaagtatgatcaatgccggcattttatcgggcgatcaagtcatcgttcgaaaacaatcaaccgccgataatggcgaaattgtaattgcgatgactgacgaaaacgaagcaacctgcaaacggttctttaaagaaaccgaccacatccgcttgcaacccgaaaatgataccatgagcccaattattttggacaacgtcaccattttgggcaaagtggtgggactttttagaagcgatatatactaaaattaatagttatctattgatttctacgcctatacccgtcatactaatggtcaaggcaatgaatcatttcggaggacattatgttatatgttttagttttagcatcaatcgcgttaatacttagtctctttaagctacattcttcaattcgtagccgtgagtccatttttggagcaattattctttttataattcccctagccctagtcattttttcgggaaaccaggttattcatgaaaaaccgtctacagctgctagcacagctagttcacatttggctgctaaaaaaagtaaagaagcctcaattaaagacgacaaatttgaaaaaatgaacagtgatagtcaggcagcgtcacaacaggctgctaaagaaagaaacattactgctagtcttaagaaaaatttgaagtcattaggcgacctcacctttaacgcagatcaaaaagtatttgtggttaccccaactgatgcgaatagcaaaaaagctttcagtgcttgggtaaaagatccccgaacaattgataaagatagctacgcagggctaaagaaacaatttactggactttcaaaatccttaaagaaggagttaggtgctggatatacggtaaaacttttacaacccgatagtaaccgagctttgttagtcgttaaagatggcaagatagttgaagacgcgcttgcatcataaagtaaatttcagacttattaataaaggagacttcctggaaatggaagtctcctttattattttcaataatagcaccggccaattagtaatcaagctcaaaatcaatctttgcgttctacgtattgtcgttgctgatctttttgtccttttaacacaaaacgggcaggatcattttgatagtccgttacaaaatctgatggttgcgccgccatgaaaccacgataaatttcctcgtattcagttacactaactggcttacgttgccgtaactgcttagaaacgtttgtatctaacattttctcatagccttgcaccacttcaccagtataaaactctccttctgctcctgaaccataactaaagagaccaatttgatccccttcacgtaatgaatgtgcctgtaatagcgacaataaactgaggtataacgatccagtatataaattaccaacttcgcgatttaactggcgactgtcttcaaaacgagctaatagtccttcggcaatttgatcatcaggtgcttcttccagcacgcttcgaagagcttttaatcccattttcgtgtacggcaaatggaaaatcaacgctgcaaagtcgttaagtccttgcccagttttggctgagtactgttgaaaagtactttggaagaagtcaataaattcttgggatgagtagtgaccatctaccaacgcttcactacgataaagcgggcgccaaaaatccataatgtcttttgtcaaatgcgcactttcggggttaatctttaagatacgcggattagcactcataatcatggccactgctcccccgccttgggttggttcaccagccgtcttaattccgtaacgggcaatatcggcaccgacgagtaaaaccctgctttgtggatgcagggcaatatgtcccatcgccaactgaattcctgcagtaagtccaaaacaagcttgtttaagctctatcccgcttgcctgcgagttaatccccaatagcgactgtaagtaaaccgccgcagatttcgaattatccactcccgactcagttccaaacaaaatcaaatcaattgattgccgctctttttcatcgagaatttgccaagccgcattggctgccaaggtgactgcgtcttgtgaattccggatgaccgcttgtttagactgtccaatgccaattaaatacttattcggatcttcattgcgcgcctttgccaagtcttccattggtagataaaggtcgctagtaaaaaaactgatcttatcaattccgatattcaaaattagtgcctcccaatttttacgttgaaccaattcaagtaattctagcaaaagcgacgggctttatcaaaagcattaataaattttaattgaatgtttattagttgggtttccaaaagttatataaatggcgtaacattcatatattttaaagaaaaccatggtgttactgtaaaatttttgatatattttacactgtgaggttgcaaaaacgatacacaaactacatcaataagcattttagacagcgccacaagatgcgttctgcaaactaaaacatgtaaaagactaaaacacgcttagcattaaattactgctaaaagttttacggtcataagtattcgacagaattagaagacgggtattttaaaagatgtccaatcttttaatggatgcaatcaatataaagactttaatgttacatactacgctgacttacaaaataataaggcacagttattaaacacaaatattaaacacaaaaaatttgtcatttggtattaaaggattccgattaaaatagttgaatctttctaattaagtagcaaagttaatgttaatgattactaggtacagaaaatttccaaaaaatcctatcccactctagtaacccgttgcgattagacttcgttcgtaaaaaataagtccaaaaactgacgactttaaaagctgaaactttttggaggagttctacatatgaaaaaagctattacaacagcaagcttttttttagcaatttttgtagtgtttatggttggttcaaatgctgcttcagcaaaaagccactttaaatactaccctgttaaattaaaggttgtgaaaactgacgacactgactgggttgttaaaggaaaaaccaaagcacctgatggaactaaggttgttggaatcaccaaagaagacgacacttctttacttgaagattcggatattaacatccctactgtaaaaaacggtagatttaaggcgtcactagacgggatagcacttattccagacgaagctaaggctggaaaaaaagttcatttttacgtagcagctactactaataaaaagcctttgaaagatactgtaaccgtcaaacataaatatttaaaaaagatccgtaaatctaagtacaagcaaacattaccaattaagaaaagccaaatttctgctatcaattcacttactgaagataaacaaaaacctaaaaaatctaaacctaaaaagaaaaaaatttctaaaaatgttcaaatgaacaaacaaattgacatgcaattgaaacagtaccaaggattgcttgatgacgatggcaacccggtgccagacggtacacctgaggaagaatttgccttttctcttttgatcagcaaaatccattacataaagaaagatgatgaagttgaagttcattttacatctggttataaccaactaagtaaatctgatagaaaagaacttggtcatatgacaattaggcttatacgtggaattctaggtgaagttgacgaagatgaggaccctgaaatgctacatttcatgttctttaataaccaaaatcattacttaggacgtagtaaagtatttgatcctttacaaaccactttaaaataattgagtatttatatttctgaggattaaacaatttgctctaaaaactacgtatagccaccgtgttatgttaaatccaaacactgacacttttaaaagctgaaattttttgaaaggacaatcatgaaacgtttttatacaatagtaatttcatttatagctctcatcacgcttaccgcctgttccagtgataacaaagttgaaaaaaattctactgattcgtcagtctctcaaaagttctatacagtgaaggtcacaaacattaaacctgaagaatctgattgggtaatcggaggtactactgatgctcctgatgaatctcaagttgttgcggtcactaaagatgacgatatccaacttctagaagatgatgctggtgatgtacctactgtaaaagatggcaaaatttctgccacaatagacacttcattaactgatattgatggtaaacatgatggtgataaagtgaacgtatatatattggcagcatcgccagataacgtgtctgatacggacggtaacgagataaaagataagtatgtttcagaaatagaaaaagataagttcaaacaaacacttacttacacaaaaaaacaaattgattattatgattctttagatgatgactctggagatagtaatgaagatgtagacgattcttcaagcgataacgacttagacgatgaatctgatagttcagaagaagcttcatctgatgaggattacgatacagatggtaccagttctgaatcagatacggattctatagcgtctcgtgatgttgaagaatcaattaacgacgaaagctcatcttctacggaagaagtttcttccactcaagaaggcgattggacagttgctggacctggtatggtttttgtatcagatagtaatttgtactattcaagagttaagaatcctggtaatttccaatacgttagccaacaagatgctgattcatcgggtgctcatcgagcacctagaggaaatgaatacgctagaccatagcgtatcctcactctggtgggagttaacaagaaaaataaaggtccatcggaacttctcactaacttttttattagcagtttcgataaactctaggatgccaatggttccactaactattccgaagcatttctaaaaattatcgctacttttcacttctttaaaaatacctcaccacaaaaagccatagcattccagctatggctttaaaagtatcgataataattgcaaatttaatagtcctaaacgaggtggacgcctttatctacgtaaatcacgtcacccgttactccggttgccagatcacttactaagaatgccgcaacatttcccacttcatcagtagtaacgttttcgccatccaccgtccggctttgagattcttttagcagatcacggtgtttcttaattcccgtaactgctaaggttttaattgctccagcagaaattgcgttaacccggatgtgttgttcgccaaggtcgcttgctaaataacgtacactagattctagcgctgcttttgcaattcccatcatgttgtaattagggattgcccgggtagagccaaagtatgttaacgttacaatgcttcccgagttcttcataatttttgcgccgtagcgagataccgcgatcaatgaataggcactcacgtcctgcgctaaattgtagccagcctttttggtattaattacgccaccttctaaggtttctttgtcggcaaaggcaatcgcgtgaataatcccgtcgacttcgccatattccgccttgattttatcaaaagcagctgcaatattttcatcttcggccacgtcacattccactaagggaacgtcgggagctacaaatttgcttaagctctttttaattcgatcattttggtaagttaaaattactcggccaccttggttaatgatcgcttgggtacatccccaagcgatactatttttattggccacgcccattacaataattgtttttccactaagtattccttccaaatcggtaaccccttttctaaaatttactaaaccgttcgtggcgctgttcaacaagttcgtcagccgaaaattgtcgtaaactttccacttcggaaactaacatattttttaaaactttcgtgctttcttggtcgacaacttccggaatgattttatcaatgattccttcggtcagcagaatctctggtgtcagctttaattcttccgccgcgtccgccactcgtttagcatctttccaaacgattgaggcgtagccttctggcgatagcaccgaatagatgctgttttcaaacatccagacccggtccgcagttgccaaggctaatgcgccaccactgccaccttcaccaacaattacgctgatgtatggtacccgcagctccatacccaccattaagcattgggcaattgccgatccctggccgtgatattcagcatccattcctgggtaagcacccggcgtgttaacaaaggtaattactgggcgtttaaatttttcagcctgcttcattaaacgaattgccttacgatagccctccggttcaaccgtcccgaaatggcgttcaatattttcggcggtattttttcccttttgggttccgatgacggtcactggtaaaccgtttagtcgggcaattccaccaatgattgccggatcatcgcttaattgccgatcaccatgaaattcagtaaagtcggtaaaaatattattaatcaaatcttcggtggcaaccttttcttttgcccgagctgccataaccgtttcatatgctgtttttgtcattttcatccctacttattcattccgcatggaggcttaacaagttatttaagtagctttttaagtccttgcgttcgacaattgcatccaaaaatccatttttaagtaacgtttctgccttttggaaatccttaggcggtttttgattaatggtttgttcgattacccgccgccccgcaaaaccaattaaggttttcggttccgccaaaataatgtcggcttgcattgcgtaactggcagtcaccccgccggtagttggatccgtcaaaaccgcgacgtataacaagccttccgcgctatgccgagccacttcgtcagacaccttcgccatttgcataagggaatggattccgtcttgcattcgcgctccgccagaagccgtaaagatgattacgggtaaccgttcttgagtggctttttggaaaagatgagcaattttttgtccggtaacctggcctaaacttcccatgataaaccgggagtccatcaccgcaatagctaccgcaaaattaccaattttgccctttccagttaggacactctcgttgactcgagtctgcttaatcccgtttgctaacttctggcgatactttgggtcagcgttctgagggtcagtagtaagggctttatcccactcttcaaactcgtcacagaccatcttgattcgtttgcgtgcaccaattcgcattccgtacccacacttgggacaaacttctaagctacccgcgtgacgatagtaatacttctcatgacactcggggcattcacgccacaagccttctggaattttcttcaggcgtttaacaatttcttcttgggttggcaaggaaaacttacttttcattattcaaccactctttcaaaaagttattttcaatatatttagttgaaaattgtgccttttcaaaccctttatcaactaacaacgcttctaagaacgtcttgttacatttaaccccagcaatttcaaattcctttagaacccgtcgcattttaacaattgcttcttgacgagtcggcatttttacaatcattttagcaatcatcgagtcgtagaacggtggaattaaacttccttgggtaattcccgaatcaattcgcactcccatggtccccaccggcaaaaagaggtgatcaatcttaccagccgatggcataaagttgttactagggtcctcagcattaatccgacattcaattgcgtgacctaaaatgtttacgtcaagttgactaaaacttaatttttgaccttccgcaatcttaatttgttccttaattaattcaattccagtaacttcttcggtaacggtatgctccacttgtaggcgggtgttcatttccatgaagtaaaaatggtgatcttgatccataaggaattcgatggtgccggtgttatagtacttaattgccttagccgcccgaaccacgatttcacctaaagtttcccgttccgtgtgagagattactgcacaaggcgtttcttcaatcaccttttgattagtccgctgaagtgaacaatctcgctccggtaagaaaacgtagtgtccatactggtcggcaatcacttgcatttcaatatgcttggcgttttcaataattttttctaggtataaatccgcgttaccaaaagaagtttgtgcttcacgttgcgccgcttggtaagctttttttagttcgtctggtgaattaattcgccggattccctttccgccaccaccatcggctgcctttagcattacgggataaccaatctgctccgcaaccaccatggcgttttctaaatcccgcaccatcccgttactacctgggataaccggtacgttcgcactaatcatggtttcacgggctcgcgatttattacccatcaactcgattgtttggtaacttggtccgataaattttaaattgctttcttcacacaaccgcgcaaattcagcattttctgataaaaagccatagcccggatgaattgcgtcacagccggttaaaatggctgcgttaacaatattaaaagtatttaggtacgattccgctggttggggaccgccaatacagactgcttcatccgcgaggcgtacaaagagactattttcatctgcggtagaatagactgccactgcctgaatatctagctcgtgtaacgaacgaataatctgtaccgcaatttcaccccggttggctactaaaactttttgaaacatcaatactctcctctttctagcccacgatgaaagttaaatcagcttcacaaaccacttcgtgtcgctcattttcaatcaccccgtggcccgtcccaatttgacgcttcagtttggttaattccacggttagggttaactcgtttccaggaaccacccgctggttaaagattgccgacttaatcccgccaaaaaaggcgtttttgccagcaaattcgggtgctgatagtagtgcacaggcccccgtttgcgcaagtgcctcaattaataatggttccggcataaatagttcgctttgatggccaaaaaaccattcgttgatggtaacttgcttttgggcaaccgcctttttgccatcttctaaattaatcaactggtcaattaattgaaatggtggccgttggggaatgatgtcttgtacatttaccatttccacgccccctatttttcgcgaatccgagcgattggctggtcatattccaccatcgaaccattatcaaccaggatttcgacaacttcgccttcaattggtgaatgaacttcgttaaacatcttcattgcttcaatcaaggcaacggtgtcaccttttttaaccgtactaccttcttgaatatacggatcttcgccctctgccggagcaaaataaaccactcccacaaacggtgccttaatttcagctaacggttcgctttcaggcatggaaggagccgcttccgctaccggtggattactttgcattacgggttggctaaccgctactgcttcttttttaacctttaaattaaagtcgccgtcgtgaatttcaaatgacgtaaacgacgattgatccaatttagttaataatttatctaaatcaatctcttccattttctcacctcttaaatgctaataccgcattatgaccgccaaaaccaaaggaattactaattgctgcatgaacctttgttctccggctggcttccgttaccaacggaatgttgacttccggatccttaacttggagcccaacgtttactggcatcacgtcattttgtaatgccgcaatggttgctacggcttcaatggcacctgccgcccctaataaatgtccggtcatcgacttagtactacttacttggtaatgatcgttgtcagcaaaaaccttcgcgattgctttagattccgcactatcattagcgtgggtactggtcccgtgggcgttaatgtaatccacgtctgcaggagttaagcctccttcttgtaaggccatttccatcgcccggatagctccgcgaccgtcaggatctggctgggtcatgtggaaagcgtcactagtcattccgtagccgacaatttctgctaaaatgtttgcaccacgggccttcgcgtgttcgtactcttctaaaactaaggtagcggctccttcacccatgacaaagccatttctttccttatcaaacggaatcgaagcgcgtaaacgatccgtcgcggtcgataacgctgttaaagccgcaaaaccggcaattccgatttcattaattgatgattcggcaccaccagtaatcattacgtccgcatacccatttttaatatggtggaacgcattaccaatggcattattagcgctagcacaagccgtaacgattgcttgactagtatttttggcattaaagtacatcgaaatattacccgccgccatgttcgtgattgaattagtaacgaacaacggagaaactcgtttaggtcccttggtgttcattttgattacttgttcttgaattgtggttaacccgccaattccagagccgtagataacccccatctgttcgggatccacttcgccatccttaaaatcagcttgttccatggcttctaccgccgtgtacaaagcatattgggaaaacggatccatccgcttagcaatttttctttctaaacgttcggtagcgttaaaatctttaacttctccagcaaccgtaattccagtaggttcagcatcaaaatgagtaatttggtcgattcctactttagattcatttaacccttcaataaaggcgtcccgactattaccaagtggggttagtgcccccattcccgttacaacaactcttctagtcatattttcctccttgatttaaagggtcaatccgccatccacggtcagaacttgcccagtaatgtaatcatttttcagtaaaaagcttaccgccatggcaatttcttccggttgcccaaaacggtgcattggaatcatttcttcagtcttagcgcgaaccttgtcgcttagttttcccgtcattgccgtttcgatcatgccgggagcaatcgcgttgcaccgaatatttcttaataaaccttcgcgagcggttgttttggtcaaacctacaattcccgccttgctagcagaataattagcttggcccacgtttccgtgagttcctgaaatactagaaatgttgacgatgtttcccgaacgttgtttttgcatgattttcattgcgtatttagtaactgaaaaagttcctaccagattagtcgcgataacttcttcaaaatcttctaccgacatccgactcaataacttatcgcgggtaatgccagcgttattaatgacaatgtccacgtgaccttgttcttcgttaagttcgttaagcaacgtccccacttctccgtcagcgcgaatatccaagttcttgaaggtaattcctaaatcattgagttcgttttgtaacgcttcgtcttcaactgcccggcgcgcagtgataaaaaccttcgcaccttgttgcgctaaatctttggcgattgctagtccaatccccttagttccgccagtaactaccgcaactttatctttaatatccaattatcatggcctcctaattaaagactgagaaaacttaaattaaattttcccagcctattcgtgtctatcaatgtccgtaaacctttagataaccggttccttagcttgtttagtcactaggaactcgcgtagtttatttaaattttccacccggtcaacgttaaaaattggtagttccgcttttttcaacgtttttttcgcaaaaccactcaacgctttgccaggtcccacttcaataagacagtctagttcgtcaacgtttaaactatttaaacaatccgtaaagtaagtcggatgcgttaattgcttcgctaaggtttccttcaaattacttatggtaaacggtgccttcagcgtattgctaattaccgggatttgcggttcttgaaccggaacgtttgctaagcgctctgctaaacgagcactagctggcatcatatacggagtatgcgaagccaccggcattttgattggaacaacgcgttttacgcccgccgcctttaaagccgcactaaagcgttcaattccctctgcgttgccaccaaaaacggtttgttttggcgtattatagtttgctggaaaaacgtcaccaacttctcgggcatccgctagcgcttcatcgactactgaaggttctgcgttgagcaccgctaccatttgaccagggttttgtttaccagcttcactcatgtatcgcgcacggtctccaattactgttaaaccatccgccaatgaaaaactacctgccgctaacaatgcagaatactcacctaagcttagtcccacaaatttttctgctcgcagtttttcctgccgtaaaattcgttccacccctaagctaaaaattacaatcgctaattgggtattgacgggatcatccattaccgcaggatctgcaaaatcttggtctaaaatttgactagcttcatcaactaaagcccgataagctggttcagttttatagaagtcttgccccattcccgcaaactgctgaccctgtccgctgaataagtatgctgctttaaccattacgctctccttaatactgactaaaactaatcttgattttcaatgatgtaatcaactaatttgcctacggtatccatgttttcgtcagtatcaatgtcgatatcaaattcatcttctaattgatccacaacttcaaaaatgtccaagctatctgcttctaaatcttctgaaaaactagtttccattgtgattttgcttgcgtctttttccaattggtctgcgattacttcttgtacctttgcgaatacttcttcttttgtcattttatgttcctccaaataatatgtttttaaaatttaattacgttagttccgatggtcagaccaccgccaaagccgctgaacacaatgatgtcgccgcgctggattttatgttcctgcatcaattctgctaaaagcaacggttcgctggctgccgcggtattcccataatcagcaatgttaatcggaaacttctctatcggaagttccagtcgtttggccacgcttttaataatgcgggcgttcgcctggtgtaacaggaaatacttaacgtctttcgcgtcgatttccgccgcttgtaacactgcttgaattgattcaggaacccggttagttgcaaattcgtaaaccttgcggccattcatttgaaaaaaataagattgcgttgaatcagttaacgcagccacgttaccagctgtgaggtgttcccctaaatcgccataagtagttagtcgttcggcaattaaactagcagaactcgcgggatcattttcaactaaaacgcccgccgcggaatcaccaaacaaaactgccgtactccggtcttgccaatctaacaagcgagacagtgcctctgagccaattaataaagctttatgataattcggcgactggagcatttggttcaccacgctcattccgtaaacaaagccgctgcacgcggcactaatgtcgaaggccatggctctagaagctttaagtgcaccttgaactagtgcggccaccgaaggagtttggtaatccggagacatggtcgccaccacgatcaggtccacctcttcgggagcagtattcgtcttggttaataaagcttctgcgaccctagttgccatcgcagcattagtttcttcaccaattcggtgtcgccgcttgatgccggttcgtttcgaaatccattcgtccgacgtatctaacgtttgggctagttcgtcgttagtaataatcctttcaggactatactttgccgaatcaataatttttaatcccatttacttcaccaactatgctttaggctggtcagttgccccaacaataaaggtcaattgagcttggcaaactttcttttcaccgacggttgcaaatgtttccacaacccccatgttgcgttttttcttaatcatttcgacgtgtaatttcaaaacgtccccgggacgaacaatctggcggaatttagcattattaatcgcgccaaggtatgctgtcttcccggcaaactcttccgacttcaaaattaaaattgaagctgcttgtgctaatgattcaataattaatacgccaggcattaccggatttcccgggaaatgtccttggaaaaattcttcgttaatagtaacgtttttagttgcaatgattgattttcctggttctaattcgtcaacgtaatccataaacaagattggataacggtttggaattaattccatgatttctgccgcgtttaaaatactcaaattcttatttcctcctcaaccgagtgttccttgcgattccttacataaggaatattcaaaagaatagcgagaaaaatatctttgcgcaattgattttaaaatatgaacttttttctattttttaataaagctccgttaaactccgtaaccacggggctggaggctttcctttcttactgaaacagtttgacgtgaatcgtcacaattaattaaccccatgtactaaaatcacctttagaccggcttttaacgtgtcaagtcttttttatacatcctagacatcgttaatggtgtacaaataaactgattgtgtaacttgcttttagctccctactgtctttgattcgcgttataatatgagttacataaccattgagaaaggcagactcgttactaatgaaaataattatccatattgacgaaattgaaaaatggccgatggtgttaagcaatctcgcacatttgaatgagcattacgttaattcagacgacgtgatcgaattacttgttaacggtccggcagtggtggctttacaaacttcacaggttcgtagtgcgtcaattcaatccgccctacaaccacaaaatcagttagccgtttgccaaaattcattagaccaacgacaaattaatcccgggagtttaatttcagcagcaaaagtggttccctcgggggttgttgaactagtagaaaagcaatccgctggttatgcatatttacgtccgtaacttatacgaggaggaatttttatggaagaaatgttagttaccactaccgaacacattcctggcaaggaatatcaggtgcttggagaagtttttggcttaaccacccaatcaaagaacttggtgcgcaatattggcgcaggactgaaaaatatcgttggtggcgaaattaaggactataccaagatgttagacgaatcccgccacatcgcggtccaacgtttacgcgaaaatgctgcagaaatgggcgccgacgccgtagtcatgatgcgttttgactctggatcaattggttcggatatgcagtcggttgccgcttacgggactgccgttaagtttatccaagcgtagtaaaaggttttaataaaaaaggaaagtcatatctcgttaaaagatatgtctttcctttttatttttgctttaaattttaatatacgtattctcttgagggtcgtttattctaacaatgataaaccgctcggttaatttacttatagctcatgatgttccctcaacttaatcagtcactaataatgaattaataactaatttatagtctttgttatcaaatcaaaaagaaatcctaagtatacgaaatgctcctcgaatactccggattcctttttgattaattacctagttgagttattaatatttttcagcaatctttagaactgcttgtcttgtattagcagctttccagtgtccgtttgcgcctgaataatggggtagcttttcaaccgggcgttgcgcaaattgacataaagttgcggcagttttatctccaagtccaaccaagacggcctgagatgaaacgccaagttgatcaagatgtgattccagtgccttgacctcagcttccccactaaccacgttatcactcttactttcattaatggctactaaatcagtcataaaggctccccaaagtggagtaccataaatagctgctgctaaacgatagtcgaggctctttttttgaccatggaaatttaaaaaatcctgttttttatcaatcgttacccctgcattaccaggatttaagccaactagtacaaatttaactttcgataaagcttgctctaaattcgatgttaattgttcttttggaaaatggtttggttgataaacttcaccaaatcgtgtttgtcgctcctcatcatcaagttgatctatatcactagccggaatatcccaaagggcccaactgtcaagcgtattaaatgttaaatcttgcattatgtattccttctttcaggtataaaatcctatccactataacaattactattttgcaagactcattctagaacgtcaacctaaatttgcggttataattctattgttggtggtgataaattcaactacctccgttagcgttttctttacattcttaacaacaaaaaaaccaacccgcaattaagcgaattggtttcttcaatagccgttacccaatcttagtagggttaaagactatttgtttttcatagcgttagctttacgacggtcttccttaatccgagctgccttaccatgtagtgcacgtaggtagtaaagcttagcacgacgaacgcgaccgtaacgaacaacgtcaatcttagctacacgtggtgagtggagtgggaatgtccgttccacaccaattccgttactgatcttacgaacagtgtacgtagcactaatacctgaaccatgacgcttgataactaccccttcaaacatctggatccgttcgcggttaccttcaacaaccttagcgtgaacccgaacagtatcaccagcgcggaattcaggaatgtcatcgcgaagttgttcttttgtaatcttgttgattaattcattcatcaaaaaatcttcccttcaccaatcttcttaactcacccggagccagcggaacattgttatttgttggcattcaagccaaataaaataataacacatccgctgctgtgatgcaaagttattttagctgtaaatcatcattataaaaaagcggatacgccatataacacgcaatcacgctaccaatactagtagccgctagcaacatgaaagttaccatgatttggtacaaaattgcctttgtcggatccactccggcaaaaatcaatcccgacatcattccaggtaaacttacaattccaaccgtcttagccgagtcaatggtcggcgacattcccgtcttaattgaactttgaacaatcgcccgtgacgcctgttttaaattagctcctaacgccaatcgttctaaaaccccttgacgctggtctttgaaggtttgattcatgctacggtaacataaaccaatcgccaccatcgtgttactagcaatcattccggaaatcggtacgatttgactaggggtaaatttaattgcgcgagccaacactagcaagcaaatggtagttacggtggccacgctaatcgctaagagactgataaaaaacgcgtggggaatcttgtccgcccgtttttttgcgttaagagcggcattaaagatgatgattaacaccattaaaatggttaaccacacccgatcaaccttaataacgtacgttaaaacgtaacccacgacggttaattgaataaccgctcgtactacgcccaccaccatgtctttttccaaaccaattttttcgtgtaaattgattcctaaggcgataatcaccaggatgatggcgaaggataatgctaagggactaacgattaagttcatgtcgttcacctacaattctgccattttcaattgttactaaccgatgagctaaaccaatttcggcttcatcgtgcgtaattgctaaaaccgtaattttacttttttgattcattttttcaattaattgatggacaatcgccttggtatccacatctaaccccgtggtaacttcatctagcaaaaggacctttggtgggaagagcaagttgcgtaccaacgctacccgttgtttttcgcctccggagagatcaacaattggtttatccaaaaagcgcgccgttaaatcgacctgttcgagcgacctaactgccttatcagcattaaaaggatggttacgaatttcaaaaggaaacgctaaattatcgcgcacagtttccccaaacaacgtgggttgctgaaaacaataagaaacttccttacggtattcaattttggggatcgcaagctggtcttccccatgatacataatcgttccacttgtcggggtcagcaacgtggccaaaatctttaaaaaagtacttttccccgaccccgatgggccaattatcgtaacgtaatcaccaagttccgcatcaaaatcaattgaatttaaaattctggttccgttaaccacgtaattaagattacgaacggaaaagattttggtcataaaagtcactcccctaacttatttagattcattataatttaaaaaaacgtaagttactagtaaaaagaggatgaaccgctattctagcaacatagttatcttttaaaatattttaggatggccagctttgcgccatgtcatccttttactagataattgctaaaataatgttcatcctcattatatatctggcgtttgcaattcccggaggattttttggtcttccgtcgttagtttagcagtttttagcaaatctgggcgacgttcgagcgtcttctttaatgccatggttcggcgccactcgtcaattttgccatgattaccacttaataaaatctcgggaacttttaatcctcgaaaatcagcgggacgggtatactgcggaaactccagtaatccggttgaaaacgaatcatcttcagcagattcgtcattacctaaaacatctggaagtaagcgcaccgtcgcatcaatcatcgtcaacgccgctagctcaccaccggtaatcacaaaatcacccaaagaaacttcgtcgtcaaccaacgtcttaatccgctcatcataaccttcataatggccacaaataaaggtcagatgttcttctttcgcaaagtcttctgccatcgcttggtcgaatcgtttgccacccggatctaccaaaatgacccgacctgccgattgctggttttggcttttaacatgttccatagcgtcaaaaattggttgcggggttaacaacatcccggcgccgcccccgtatgggtagtcatcaacgttcttgtgcttattagttgaatactcccgaaagtcagtcacctcaacgcctaatttgccgctttcgatcgcttttcccacgattgactcgtggagtggcacttcaaccattttcggaaataaagttaaaatatcgatcttcattaatctaacccctcaggtaccgcgacctcaacgatacttttatctaaatcaacctttaaaaccacgtcgttcaaatatggcagtaacaagtcttttttacccggccgttcaactacccaaacatcgttagggccatacgataaaatctctttcactttaccgagggtttgtccatcttcaattaccgtcaaaccaataatttcatgttggtaaaattcaccatctgcgagttcttgaagctggtcttcagcaatttttaacatcatgcccttgaacttttcgacttcgttgattgagtctagtccggccaattggattaaccacattcccttaaaaggttttgccgattgcaccgtcaccgcttgggttggtgtcgttgcgtttgcgtctttaaacaattgcaactcggtgccggcttggaaacgttcttccgggaagtcggtgtacgcaatcacctttagttcaccgcgtaagccacgcgtgttgacgattttggccacgttataataattcattattcttcctccgatacaaaaagaagggcgtaataaaacaaccgttttacttacgcccttcatttcaggttaaaacctattttgtatatttagcttcgtgatacttcttcataattcctgctttagaaagaatattcttaaccgtatccgaaggttgtgcaccattgtttaaccagttcatgatttcttcttcttcaagcttaacagcaactggttcaactaatgggttgtatgttccaacttgggcgataaaacgaccatcacgtggtgaacgtgaatcagcaaccacgatacggtagaaaggacgcttcttcgaacccatacgttttaaacgaatctttacagacatgttaacacctccactatttattcacgagtaataatataccagttattcgaagagatgtaaaggttttttccttaacagattaaatttaattatttaatcagctaaaatacggttatttccgctttttattctttttcatccgcttctttttgttctttttgtttcgcttaaccatcgaattcattgccattttagacaattttcccttaattccgttaccaaacatcccttccattgggccaaagtttcccttagacatttggttcatcattttcttcatttggttaaactgcttgatcatccggttaacttcgacaactggccgacccgatccggcagcaatccgccgccgccgactcggatttaaaatgtccggattttcgcgctcttgtttagtcattgagtagacgattgccttagtatgctcaatgtccttcgggtccacgttaatgttctttaacgcaggattattcgccattcctggaatcatcttgacgatgtcttcaatcggccccatactttggacctgattcatttgatctaagaaatcgttgaaatcaaaggtgttttcccgaattttctgggacatttcagccgcttgcttttcgtcgaattccttttgggtcttttcgattaaagtaagcatatctcccatgcccaagatccgggaagccatccggtctggatggaagacgtctaagtcttccatcttttcaccttgaccaacaaacttgattggcttaccggttactgctcgaattgacagagcagcaccaccacgagtgtccccatctaacttagtcaggattactccggtaacgtccaacttgtcgttaaagccttccgcagtgtttaccgcgttttgcccggtcattgcatcgacaaccaatagaatttcatccggatgtgctagatccttgatgtcggctaactcttgcattagcttttcatcaatttgtaaacgccctgccgtatcaatgaaaacataatcattcttgttttcagctgcttgttcaagaccatgccgaacaatttcaaccgggctgacgtcggtaccctcttgataaactggaacgtcaatttgttcaccgacttgaaccaattggtcaatcgccgctggccgataaacgtcagccgcaattaacagcgggcgagctttcttttcattttttagctttaatgctaatttaccagtcgtcgtagttttaccagcaccttgcaaccctgccatcatgattacggtaggaatcttaggtgcctgatttaaaggactagcttcggtacccatcatcttcactaattcatcattaactagcttaacgatttgttgtgccggatttaatccttctaaaatatccgaaccgagtgcttgttctcggacggttttaacaaatttctttacaacggtaaagttaacgtcggcttccaacagggcgagacgaatttctcgcatggtatcccgcaaatcggcttccgttacctttcctttttttcttaaattattaaaagttttttgtaaacgttctgttagaccttcaaaagccattgacagcccctccgtcttattcttcttcactttgctcaaggtccgctaaaaaacgcttgagctgggtatcttctggatatttcttggcaacgtacgcctgaatacggtcaaatttggcgtttcgggcctcaaaattacgcaaaaggtgcaactgttgctcatatttttccagaattttcacggtccgtttaatattatcatacactgcttgacgactaacgtgaaattcctcagaaatttcgcctaaagaatagtcatcagcataatacagggtgatgtactctttttgcttcggggtcaacaactgttcataaaattccaacaagctattgacccgattattcttctcaatttccataggcactattcatccagtaaacctttaaacaatccccggacgtactcttccggattaaacggactaagatcttcaaccttttcccctaagccaacgtatttaactgccaggtgaagctggttacggatagccaaaacgattccacccttggcagtcccgtctagtttagtgaggataatccccgttacgttagtggtttccaaaaatgctttagcttgggttaacgcattctgcccagttgtagagtccagaactagtagtgattcttgcggagcgtccgggatttcacggctaattacccgcttaatcttgtctaattccttcatcaagttaactttattttgtaaacgaccagctgtatcaatgaaaaccaagtcataattctcagctttggccttttttaccgcttcaaaggctaccgctgcagggtcagatttttccttaccggtaacgatatcgacaccgtcccggttagcccactcttccaattgttgaattgcccccgcccggaacgtatcgcaggctgccaaaaggaccttccgtccccgagctttgaaacgagccgccatcttaccaatgctggtagtctttccaacaccattgacgcctacaaaaagaaataccgttgggccttccttactgaagactaaatggttatcttctgcactgccgttacgcgtatataaatctaccaaacgccgaacgattagttgcgaaattttttcggggtccgaaacgttttcgaactcaatttcttcacgaacctcttcactaatctcaagcgccgtgtcaaagccgacgtcggcttcgattagggtttcttcaagatcgtcataaaaatcatcatctacccctgaaaaattagtaaacaaagcggaaagcttttgaccaaaagactttcgagaacgttccaatccccgatcatacttttcagcttcatttaattggggctcttcattaactggcgccgcagaactaacttccttagccggagctggttctggtttactttccggttcctttaccggtgtagtgttcgttggtgcttcttttactttatccggagaagcctttacttcgggttgtgaaactggggttgatggttcaacctttttttcggcttctttagccttctttttctttttaccaaaaaaccatgccatttatcccacctgctctcttcgttcgatttcatcaactgataccgaaaccatttttgatacacctgattcttgcatggtaactccataaagtacgtccgcctccatcatggtcccttttcggtgggtaatcacgatgaattgggtcgtgtcttggaaagttcgcaaatacttcgcgaaccggtccacgtttgcgtcatcaaaggctgcttcaacctcatccaaaatgcaaaatgggacgggtttaacctgtagaattgcaaacaatagggtaattgccgttaaggacttttcaccgccggacaacaaactcaaacgttgcagcttcttccccggtggctgggcctttatttcgatcccagtagtcagcagattatcaggatcagttaattcgagttcggcgtgccctccaccaaacattttaacaaacacttgtccaaattcttcagcaacttggtcgaaagtttgcttaaatctttgacttgcttcttgatcgatttccgcaatggattgttccagctgttgtttggaactagataagtcttccttttggtccttcaagaaattataacgagtagaaacacgctcgtattcagcaatcgctccgaggttaaccgtgccgagttcatctaagccccggcgcaataatttcaattcacgccgtaactgctcatcgtccaacgattggtcaacaactgcttgagcactttcaaacgtttgttggtaatcatcgttaagctgatcagcagctaattcgattttactttccactaacgccaacgtattttgcgcttcttggacctgactttgcgcttcgctacattgcttttgagttaattcgtagtcggcaatgacccggtcttgtgctacctgggccttttgccattctgtttgcaagttcgtcatcgcttcttcacgttgtttcaaacgtttttgaacatctactaggttgaccgcttgtgtttgggacttcgcagacgaagattgttcttcttgtagctgaactaactgacgccgaatttcttccaaacgatcctgcaagtcaatttgggtttgccttgccgtctgaaattgttgttctttttgagagtactgctcgtttagttttgctaattttatttgtaattcagcccgttgttcctgacgagcttcagcatcgttatcaaaaagtgccaattgcttttgcttttcggccgtttggtcctttaaatcttgaatttttgcttctaattcgctgatttgggcgggtaatttttgaattgcgtcatctactgggctcaactgggttaattcaaagttagtagctttaatccgacgttcgagttcggcaatccgctctttagttaagctaacttgattttctgccttaaccttagactgttcgctggttcgctgcgtttcagttaattttgctatttcaccttgaacttgtttaccctgcgctaataactcttgcacatgcctttcctttatcgctaacttttgcttcatttcggcgatttgcgtttgcagccgcttgatttcctggtcctgctgcaaaagtccttggcgaccatgtttcatggttccaccagtcatcgttcccccaacgcccactacgtcaccggccaaagtaatcacccggtaacgacgctgaattcgttgtgaaatttgtaaggcatggtctaaattatccgcaattaacgttgtccctagcaaatgctggctaactacgcggtcaacgttagcaaccttgattaaatcacttgccaccccgcaaaaaccagctagcgagtgaacttgcgtaagcatttcgctacgaatcgttcgcgcctgcaacgtatttcgaggtaagaacgttaccctgccttggcgttgtttctttaaaaattcgataatcgacttggcagtttggtccgtgtccaccactacgttttgaatttggcttcctaacgcggtttcaattgccacggtgtactgttccggtacttcaatcacgtccgcaactggaccaaccaaccctggaaaacgttccctttgttgtaaaaccgcacgtactccttgataaaagcccgtgtgttcatttttcaaactggtcagagcttctaatttgctggttgcgcggtgcacgatgtccgacccgtctagccactgctgacgcgcttcctcgtattcttggcttagtcggttgcgtctttgcgtcagttcttgaagtttaccagtttgtttttgaaaaatttccgtagtgttagccaccgcctggtttaattcagctagtttagtctgaagctcttgaagctctttgttaaaccgtgctaaatttaactccactttcaaccgttgttgttcatcacgcttttgatcttgctggctgaaactatattgattcttcaatgaggttaatttttggagatgatcaacatactgcgcccggaggtcttcaatttgggcttgcaaatcagccttcttttgttcttgatgatcatcagttaatagttgtaaagcttgcttagtctttttaatttgttgattaaggtcggtggttaattgttctaagccctttaagtcctgctgtcccgcatcaatttgcccttgtacttgttcgatttgttccgttaagcgggtttgttcttgctcaaaatatttccgacgttcaatctgtaagtcatgctccccagctaattgttgctcaagccggtttaagcggactaactccgcttggaggtcgtctttttgcttactttgctggttcacttgctccttaagccggtcacgctgcttaaccaactcgtttaatttattttctaattgatgcgcctcagtttgcttaacttcagcttcctttgcccaccgcttttggaggtcgctattatgagtaattgttcgcactaaccgggtttgttctaagcggtcaaaccgttttttttgttgcaaatagtcctttgctaccgcggcttgttcttcgagaggttccacctgtttttgaagttccacaattaaatcattaactctctctaaatagccactggtcttttctaattcactttcagcccgccgtttatcttgcttgtactccaacactccggcagcctcttcaatgatcgcgcgacgatcctccggtttactattaaaaatttcttcgatttttccttgcgagattaccgacagggattcgcgacctaacccagtgtcgataaacaaatttaggatatcttttaaacgacactcctgatggttcaattcgtactggctttcaccatttcgaaaaaggcgtcggctaatcattacttcgtcaaatttggaatccaagaaatgatctgaattatcaaaaacaatgctgaccgctgcccgagaaagcggcttacgtttctgggttccggaaaaaatcacgtcgggcatttttccacctcgaagacttttagcggaagtttcccccatcacccagcgaatggcctcaataatattacttttacccgaaccattcggaccaacgatccccgtgatcccgtccttaaaatcgatcttggtatggtcagcaaaagatttaaatccgctaatttcaattgtccgtagtttcattaaaaatacctaattcctattacgcaatttttgtaaagctttgttagcggcattttgttccgccgcttttttagaatgtccgctacctttcgctaaaacttggttagccgcacttacctgaacggtgaaaaccaagtcattatccggcccagtttcagatattaattcgtaattaatctccacttcaccgtttcgttgcaaaagttcttgcaattcagatttatggtcaataatgtggtcaaaccggccttcatcaagcttaggaaaaatcacttggcggacgaatttttcaaccgcttggcgtccttggtctaaatataaagctccgataaacgattcaaaaatatcacaaagaagtgatggacgctgccgcgcgccggatttttcctctcctttaccaagccggatgtaccggtcaaaatgacattccttggcaaaatcactgaagctggcctcacaaaccattgcagctcgcaaacgggttagctttccttgtggcatttcaggataacgtttgtatagatattccgaaactactaactgtaaaaccgcatcccctaaaaattcaatccgttcatagaacttcaacccttggtgtgggtgttcattaacgtaagatgcttgagtgaaggcttcgtccagtagttcgtgcttggtaaaatgaatatcaaacatttcacttagatcgtcttctaaatcttttaacaactcgatcattcctttctaaatttaaactcaataattcttttatagataagaataactcggtgaccaaaatacattcaatcaccgagtttcccattattgtattaagactgatgttcactaatgtagttaacagcatcggcaactgtagtcaacttttcagcgtcttcatcgctgatttcagctccgaaagtatcttctaattctagtacaaattcaacgatatcgattgaatcagcgttcaaatcttccttgaagttaagcttttcggtaatttgatcggcatccaactcaaaacggtctgccaaaattgccgcaattttgttaaaaatttcttcttttgacaatttacttgctccttaaatttgttataaatcctgataatattttaattgtttttccgaggcttgtccacttcgtcttgttgaatacatttaacgtgcatgtcaaagtattcggcaagatttttaactaatttggagtccacaatttcgtgaacttgaattaaagcattttttacttggttagcattactagagccgtgcgccttcactaccggggcttgaacccctaagagtacggcacccccgtgcttagaatagtccatttggtctttaatttgactaaaggcggacttcagcagtaaaccgcccattttaccttttacgccactgtttaaaatggtgtccttaaccagtttaagcatggatagcgccgttccttcagtattttttaaaaccgcgtttccggtaaatccatcggttaccacaacgtcagctgcaccgtttaacaattcccgggactcaacattgccgacaaaattcaaagagctatcgtcatttaacaattgataagcttccttatgaacccgatcccctttatcatattccgtaccgttgtttaagagagcaatccggggattcgtaatatgcattacgttagcactataaaaattacctaaaatagcaaagtcgtgcagattcttggctttgctttccgcattggcacccacgtcaagcatggtgaaattatcgtgaggcccttgtaagcttggtaacgtggtggtcattccgggacggtcgacccctttaatccggccaatgacgaacaatcccgccgctaacagcgctccggtatttccagcagaaaaaattgcatccgcattgccttccttaactgcttgagcagctaaaaccattgaagactgtttcttacgtcgaactgcccgcactggttcatcttccatagtgattacttcgtcagtatgcacaatttggacgttccgaaagtcgttcatatacttagtaatttcatcttttttcccgtataaaataaattccacgtccggtaaagcttcacgagcggcagccactcctttaacaatctgctcgggggcgttgtcgccgcccattgcatcaacggcaattttcatttttactctccttatgtttattatctagtttaattaatctaacccttgctcaatttgcataacttggttcaaatacttggctaagttttggaaagctggttgggattgccaatcgggttggttaacaatcttagcagcttcaagttgggcagtttgtaaggcacctaaatccaccaccgggtccccgactttaaattcaggcactcccgattgttgttgaccaaacaaatccccttgcccacgcattttaaggtccgcttcggcaattcggaaaccgttattggtttcaaccatgatttgcatccgttgtttacccacggcatttttgggatcggcaaccagtaaacaatatgcttgttgctgtccccgaccgatccgtccgcgcaattggtggagctgggctaacccaaaccggtccgcatcttgaatcaccattaaggtggcgttaggtacgtctacgcccacttcaattaccgtggtcgagactaaccccgcatactttccagctttaaaatcggccatgatctggtccttttctgcaccatccattttaccatgcaagattccaatcgcatatctttgtccgaagaaatcttttagttcctcatacaatgccatggcattttgcaaatccatgacttctgattcctcaattagcggtgccaccacaaaagcttgccgtccctttttaaattcgtgttccatcaatgccagtactttatcccactcgccttttttcaaccacttagtaaccactggctttcgaccagcaggaagttgatcaataatcgatacatccatatccccgtaagcagtaatggctaaggtacggggaattggggtagccgtcatcgccaagatatcaggattcgctcctttttggcgcagcttttgccgctggttcaccccaaagcggtgttgttcatcaatgatggctaagcctaagtttttgaattccacatcgtcttgaattaaagcgtgggtaccaattacgatgtcaatttctccagctttaacagcttccaaaagctcattgcgcactttcttacgcattccgccaactaacagaccaattttaacgtcaaaattggcaaaaaacttaatgaggttattagcgtgttgctcagcaaggatttcggttggcgccatcaaggccgcctggtggccggaggtgatggtggcgtacatggcaattgccgccaccaccgttttcccgctacctacatccccttgcaacaaccggttcatatgccaagctgatttaaggttagctaaaatttcattggtaacccgcttttgagctctagttagttcaaacggcaactgttggataaattcccgaactagttggatctgatagtcaattttggttcctttttccacgcggtcccgcgatttaaccacttgcaatcccatttgaaaaactaaaaattcttcaaacattgcggttcggcgggcttgtttagtaatctgctcgtcgccaggaaaatgcaaagctttaatcattgccaaacgatgcattaaccggtatttttcaattaaagcttccggaatcacatcctggacttgctcagcatattcattcaaagctgcctccactaattgttggattgtcgcttgtcgaatatgtttgttagcgggatagacagcttccattccctgttcttcagtaattatcttgattccggtcaaactttgccggttagcatcccattttccatagatagccacttcttggttagcttcaagctgctttttgatccacggttggttaaaaaaagtgaccatcaccgagctgttttctactaatagccgaaaattaacccgcaccttatgccttccaaaacgagcaatggtcggtgcagtagccacgattccttgaaaagtaactttctgttgatcagcaacttcttgcggcttttttgctgctaaatcttcgtaacgaaagggatagtaggtgatcaagtcttcaatcgtctggattcccagctcttgcagtgcttgcgcgcgcttagggccgactcctgccagtacctgcactgaatctgtcagacttttcatttttcctccacaatgcaaatcgaggctgtgacatcaattacgtttgtcatagcctctaaaatctatttcagcattagcttaacacttttaaaccgcttagcctactcaaccgaaattaaaaatggatatacgggttggtccccttcgtgaatttcaatttcaaggtcttcgtcaattgctaagatagcctgttctaattcatctgcttgtttttggtttgcatctttgccataaataatcgttacaatctcactatcttcatcaagcattaacttaaccatttcagtagttgcttccatgaggtttgcagcggtattaacgattttgccatcaatcatgcccatgtaatcatctttgcggatttgacgtccgtctaacttagtatcgcggaccgcaaccgttacttgaccacttttgacggtatctaggttatcttccattgcacttgcattttcatcaagttccgcttcgggatcgaactcaagcattgccgccattccttgggaaattgtccgactgtgaacgatcttagtcggaatttcagcaacttccacagcttgttctgctgctaagaagatgtttttgttgttaggtaaaacaatggcttgcttagcacccgaattgttgatcattgcagcaatgtctgccgtacttgggttcatggtttgcccaccgctaataatgtgggtaacgcctaagctattaaacaattttgaaatcccgtctcccgaggaaatcgcgattaccgccgtttcgggggcttccttaggttcgggagcagtcaacgagtcgtcttgttcgataatctcttcttgttgccagcgcatgttatcgatcttgatcttggttaaatccccgaattgttgtccccagcttaaaacatcgccaggatgttcggtatgcacgtgtaccttaaccacttcatcgtcattaattacgagtaaggaatcccctaacttcgcaaggtagttgtagaaggtgtcgtaatcaaattcttgagaaacttggagtcccttaccgatccgcaccatcatctgggtacagtaaccgtacttaatatcttcgggattaatttttccttgcacgctttggtggtgcttggcttccaccatttcattgatttcggtaacgtctggttcatgttgatattcgctgacgtccttaccgtttaaaacatcattaaaggcgtcaaaaacaaaaaccaatccttgaccaccagaatcaactactccgacttcctttaaaaccgggagcagttccgtagtctttttcaaagctgcttgcgctgcagtatcgattgcctgcattacctccgccaaattatcactcgttaaagcagcttcgttaccggccttagcggcttcccgaaccaccgttaagatagttccttcagtaggtttcattaccgctttataagccgtcttagcgccattagcgaccgcatctgcaagatccttggcatctaagctttccttaccttccacacttttagcaaagccgcggaaaatttgcgataaaataacgcccgaattgcctcgcgcgcccattaaaagtcctttagctaaggaacctgccaagtgaccaacttcttcactagcatcgttagcttcgtactttgcaccactttctaacgataaactcatgttagttccggtgtctccatccggtaccggaaaaacgtttaatgagttaataaaatccgcattcatttttaagcgatcagcactagcctgcaccatctgatcaaaaacttcattagtaactaaggtttcgattgcttccaattctttatcctcccaacccaacgaactaatcgctgagtgcctttacaccctgaacgaagacattcactgagttagcagaaatgcctagcattgattccaggttatattttacttttgattgtacgttttttgaaatttcagaaatttttgtaccgtaaccgacaatgatgtatacgtcaattgcaaccccattatcttcttgtttaattaccacgcctcgtgcataattttcacgttttaaaatttcattaatgttgtcgcggatttgattcttgctggccatgcccactacaccatagttatctgtagctgcgctgccgaccaccgtcgcgatcacatcgtttgaaacctcgatggttccattttttgttttaattttgacagccatcttcctgcctccttagtatcatatataccaacgatattttaccatatcttatctagacgctaaatacaagaacctgccccataaatcgacgtcaattcctattatactgggaaattatgttcgtgccaattcttaaacagaagtgacagcaacttttatttcgtcacgttaaaatatctgtcaaggataattacttgaaagtttcctattgcaatataccgggcaatgtgataaattgttatggtaattgaaatagattctattgagatatagaagtgacaaaggagggtttcaacatggcaaaagattttgtcaccggtaagcgcacaagttttggaaatactcgctcacacgctttgaaccacagccgccgaagctggaagccaaatttacaaaaggttcgcatcttagttgatggtaagcctaaacgcgtttgggtttctgctcgagctctaaaatcaggtaaagtaactcgtgtataaccaagcacttaaaagcttaaaacaaaaaatgctcttaaccgttagataatcatctaacggttaagagcatttttttattttacttagtccttgctttgaataaccgcaattaatccgttgcttaagtaaacggtagccgtactaccaataaactcgttgcttacgtaggcccgcgcattgggcaccatgtgattatgcagttggtacttttcatcatccaaagtcaatgcgtcaatgggcgttaacggaatgaatgacaaatatttaaaaccagcttcctttttaattgtgtgttttccagaattgaaaaaggtaatccgattttgccggtcaatcaacgtaatctgttcagcaaatcgccgaaagcgtgcttctagcaccattaacacgtttgctagcaaatggtcgatccgcccgccgctaacgcctagaatgcgaacctgtgcgtgatcgtcaatatttaataccttagctaacgccgcttcggtgtccgtatcatctttgatggggtttaatttaaccactctatcaaatcccgctgcgacctttgcaaactctgcttcgctcaccgaatcaaaatcgccaattgccaaactacctttaagctgttcatttaccaaacgtaatgctccgcggtctacgccaacccattcaccatctaattcttgccaattttctggtaaatttgccgggtcgccgccgactaataggttaaatattttcattatttagtaaggtcctttaaggtttgtacttgtttagtataatcaggtgcgttaaaaatgtatgatccagcaactgccacatcaactcctgcgtcgtacacttgtttaacgttttggtcactaattccgccgtcaatttcgatgtcaaattctaaaccacgtgcttggcgtaatgctgacaaacgtttaactttactaatcgaactttccaagaacttttgtcccccaaatcctgggttaaccgacatgattaatacttggtccacttctggtaaaagttcttctaattcagttagcggtgtgcctggattaacaacgacttctgcttgcgcacccgcttgtttgattagttggatagcccgggcaatgtgctgggtgctttctacgtgcactccgataatgctagcacccgcttgggcaaattgctccacgtaattttccggattttgaatcattaggtggacgtccaacttaatatcacagtcttgtgccaagcccttaacagtgtttaatccaaagcttaagttaggaacaaaactgccgtccattacatcgacgtgtaagtagtcagctccttgaacctgttcaacatccttcattagatttgctggatctgcacttaaaattgatggtgctactttaatcatttcttcttcctccgatcttttttctggtaccctttacgtttataatctggtttttgggaccggatcaaccccatgaattgttcataattagcgtaacgactagccaaaatttccccattttctacagcagctttcaccgcgcatcctggttcgttaaggtgtaagcattcgcgaaaacgacaattttggccgatttgctttatctccagaaagcattctttaagttccgtatccgccatttcaaaaaccgcataagaggaaaaacctggcgtatccgcaactaatcccccatcaatgttcattaacgaaactttccgcgtcgtatgctttcctcgatttagtgcctgagaaacttcaccggtctggatgttcaaatccggatcaattcggtttaacaacgtcgacttacctgctccagtttgtcccataaaaatagttaatcgctcagcaaaaagtttgcgcaacgccttcacatcggcatcgtctttttggcgaacaggaaaaactacttgataaccaattttttggtaatagtcggcaatttgttttaaatcttggtaagcctcgttatccaataaatccgttttggaaaaatagatcactgcgctaatctttttttcggcaagtgccactagttgccgatccagtaaattagctgagaaatccggctgggtagctgccgtaaccactaccgcttggtcaatgttggctaacggcgggcgtactaattcgtttttccgggggtgaatgctagtgatgtagccagtttgatccgaattttctttgaaatcgaccacatctcccaccaacggtttagtttgttggttacgaaaattcccccgtgcccgggtgcgaatcacttcgtgttgctcagttagcacatcataaaatcctgctaacaattgtataatttgtccagtatgcatgcacttctccatctatttagcgatcgtaaacgtaatcgttgtcaagcgcgggacgactacctgaccagcaaccacatcttgtgaaataatgcggttgttgtcaaaacgattagtaaccacctcttttttcttaatggtgaatcccttagcttctagttgccgcttagtgcttggataatcactacctacatagttatccacatcaaagctatttggtcccttactaatcaccacgttgaccttaattccttcttgaacagctttaccattctcaggtaaggtcttaaccaccttattataaccggttttatcatcagcgaccttagttattttacccactccaagattttccttagataatttggtcgttgcttgattttgcgtcaagccatgcaaattgggaaccctaaccatttgcgggctgcttaacttaaaggcaattaaaatccccaaaatgaaggccaagatggcaaacgccataaacgccgcccgcctgcgcagcgggtgccgatgtttaggtcggtgcatttcctctgtttttgctgcgggctggtgacttttcttaattgatttaagcttctcgtttacctgcatcttaattgagcgggtctgttcgctatccggttcatccaattggcggttaatcgccttttggtctaaaacgatggtgtgctcagttaaagaatcctctacgaacttgctttcttgcgcacgttgcggacttagggtcgtttttaaatcaagtgccatttcggcaacgtttttgtagcgatccgtcgggttcttggcagttgctttaagcaccacgttttccaacgcttgcggaatttggtgattaaaatcagttactaacggtaattgatcttggtaatgtttaatagcaattgataccgccgtctcaccttcaaacgggacctttccagttagcatttcaaaaagaataattcctaatgaataaatgtccgactgttgcgtagccacgtgcccgcggacttgttccggcgagaggtactgtactgaaccaatcaccgtgttggttcgggtaaaactactttgctggttggcaattgcaattccaaaatcggtaattttagcattcccatgtttatcaatcagcacgttttgcggttttaaatcccgatgaataatcccatgccggtgggccgcttgcactccgcacaagatctgccccattaaattgaccacttgtggaagcggaagcggaaactcatctttgatatatcgttttaaatcttttccttctacgtactccattacgagataattcatcccgtgctcttcaccaatgtcataaacactaacgatgttgggatgaaccagctcggtagccgacaatgcttctcgttggaagcggcgcacagccgaagcatcgtcttgcatatcaaaacggactaacttaaccgctacgtcccggtctaaaatcaaatcgtgagctagataaacgctagccatgccaccttcaccaacggggcgaataatcttgtaacgtccgtttagcgtttgattcggggtcatcagctcgcccccatttctgtttccacaatcagcaccgtcacgttatcaaaaccgccggcgtggttagccaaatcaaccagcttacgcgttttggcttcgagactttgttgatctcccaagatttgttggattacatcattacgaactaagttagttaacccatccgtgcaaagtaataaaatatcaccagccgccacgttaaataccttgatttccgcttcggcttgctcagaaataccaagcgttttggtaatcacgtttttttgcgggtggttacgggcttcctctggggtaatccggccagtttttagcaactcatttactaacgaatggtcggttgataattgacgtaatccagcctgctgattatatatgtaacaacgactgtcgcctagatttgctacgaccacttgatcattaataaataacgccaaaacaatggtagttcccataccatttaaatttttgtagtgcttagaagcttgtagaatcttacggttttcaattgccaactggtgggttaaccagtttttggcgtcttcaacagtgttgatgtcggaggtctcaaataaataaccaatgtgggaaaccgccatctcagaagcaatgtcaccgccccgattaccgccaacgccatcagcgacgatcgttaaaatcgattctgaatcacttttaaaaattcccacgtagtcttggtttgttttgcggactttccctttgtccgataggtacgcatatttcatatctatcaatcacttcacttttttcatattcgcaatgaagaaaccatctgatccaaaatcatctgggtaaatatttaggctcagatcagtgcggtctgctttaacttttttatccgtctgcgtttttaatagttcaaattctgggtgctgggttaaaaactcatcgattgtcatctgattttccttacggagcattgtgcaagtgctgtaagtaagaattccgcccaccttaagcatcgacgctacgttatctaaaatgtccaactgaacgcggtgtaaatcgctgctatcctttttgctcttaaggtaccgcgtttcaggctttcggcgtaataaaccgattcccgagcacggggcgtcaaccaaaatacgatcaaattcttcctttaattctgggcaaggagccgtggcatcgtggacttccgtaacgatgttcgttaaatgcatccgccgtgcattttgttgaattagccgggtacgggattcataaatatcccaagcaattacttgtccatcaggtcccgctttttgggccaactgggttgtcttaccccctggtgctgcgcaagcatctaagactttttgtcccgttgctaattgcatggtttcaccaactaacattgccgactcatcctgtgcaatcacctcgccagcttgaaaactagcggactgcgccagtccaggaccattttgtaaacgtaatccgtccgttgctaataaactttcttgaacgtcatattcttcggataggctttggcgaattgccgccgtcgaacgttgaatagggttcatcctgacacttaaatgagctggtcgattaatactatctagtatcttccggcacttatcttctcctaattcatacattaattggtccacaatccacggagcaacgctatattcggttgctaatcgctgggttaaatccggaatgctgtctaaacttggggttccttgacgttgataagaacgtaacaccccagttaccatcttacgaacaccgtcgcttccccgccgtttagcaatttcaatggtttcattaaagatggcaaaggtggggacccggtccaaaaattccatttgaaaaatggccgtacgtaataagttgatcacccaccgcggggtctgttctggtcgctgcaagaaatttgctaaataaaaatcaatggtcaagcggtgttgtaaaacaccataaaccaattcggtcagtaaatgcttatcgacttctgataagtctgcatcctggatcacctggttcaactctaaatttgaataggcgccttcatcaatactttctaaagcgtcaaccgctaaatcgcgggggttatttttcaattccgtcattgtctataatttgctttccggggtgtaaattatcgccaaccccatttaaataatctgtgatggacatcttttgttttccagctggttgtaattctaaaatgctgattacaccatgctcaccagtggccacaagcaattcatgcttggtcttttcaaccacctgtccaggtgctaaatcagtactttgatcaacgaccgccgtcttccacagcttggtccgctgtccttccatgatcacgtaagcaactgggaaaggtcgcaatccgcgaaccttagcgtctactaagcgtgctggtaaattgatatcaaccgcttcttgttcaggggcaatgttaggtgaaaagctaacctgtccttcatcctgcgctaccggcgtgatttctccgtttattaacttaggtaaggtttccagaagcgtatcccggcctaaaatacttaatttttcaaacatgctaccaacgtcatcttggtcggtaattggcattttagcttgggcaagcatatccccggcgtccattttcttaaccatgtaaataatggtgaccccagtttctgcatccccattcatgattgcgtaatgtacgggtgctcctccccgatatttaggtaataacgaagcatgcacgttgattgccgcaattttaaccgagttaattaatttcatcggtaaaaattgaccaaaggctgcagtcacgataaggtccgcgtttaaattaattaactcctccatttccggactgccactaagtttttccggttgataaaccttaatatcgtgcttagttgctacttgtttaaccggacttggtgtaagaacgtgctttctaccaactcggcgatcgggctgggtgaccaccccaattacgttgtaatccggatggtcaattaaactttgtaaaatgggcgccgaaaattggggcgttcccatgaaaataattgatttcattaaaaaacctactttctatgcttacataaagttttgcggatcggcatcaattgtgattcggaccccgtgtcgaaacttttcttgtgattcatttagcacctttaacaaggcgtcatggagtcgcggctccttttggtacttaattaaaatctggtaataatatttttgcttgattttagaaactgatttaggcgtaggccctaaaacaattgcttgcgagcttaattggggctgaattttatttaacacttcgtacgcatttttttgcgcagtagcttcgtcggaagccgcaacgctgattaaaaccgtaaagtagtacggtgggtatttccctaggtggcgcagatacatttctttttggaagaagtcttcgtagtcctgtttttgcgccagcttaatcgcgtaatggtccggattaaaggtctggataagaacttcaccagctttttgcgcccgtccggctcgtccagcaacctgtgtcaacagctgaaaggtccgttcactggctcttaaatctggcagttctaaggaagtatccgcattcaaaacccctacaagagttacctcaggaaaatctaatccctttgcaatcatttgggttcctaaaagaatgtctgcgtcatggttaccaaaacgagctagtagccgttcgtgagccccttttcgccgagtggtgtccacgtccattcgtaagacccgtgcttgtggtaagatctgttgcagctgttgctcaactttttgggttcccgtaccaaagaaccgaattttgtcgctgccacaattttgacattttcgcggaatcggttcttcatgcccacagtagtgacactgcatcgagtgagtatccagatgcatggttaacgaaacatcacaattagggcatttcaatacaaacccacaatcacgacacatcacaaatgacgaaaatccccgtcggtttaacattaaaactacttgttcatgctttaggagtcgttcttgaatcgcgttaaccatgggagccgaaaagttctcattaaacccgtcgcccaggtgccgtcgcatatcaattacccttattactggcaaagcctgttggttagcgcgtttatgaatctggataaagtcataaaccccccgttctgcgcgcgcccgactttccagcgctggagtcgcactacctaaaaccaccgggcaattagcattttgcgcccgataaatggcaacgtcacgcgcatggtatcgcggagcatcggtttgcttatatgtttcggagtgctcttcatccataataataataccaagattatgcaggggtgcaaacaccgcagaacgcgcacccaccactactttaacctcgttacgcataattcggcgccattcatcaaatttttcgccatcagaaagtgcgctatgcaagaccgccacttggtcgccaaaccgcgcccggacgcggttaaccatcaaaggagttagtgaaatttctggaaccattaagattgcggtcctgccttggttgagcacctgggaaatgctttgtaaatagacttccgtttttcctgagccagttactccctctaataggattggcttagcacgacggttttgaacagcatccgaaatttttttaaaggcagaggcttgttcatcattcaagttgagctcttggtcggtttgcagatcactttgcgcaaacgggtcccggtactgttctactaagtcacgctttaaccacccttgctctaccgcgtggtcaaccgttccgcgactaatttgataatccttgattaaggaagcttgactaaggccttctttaacgcttatttctggtattaactgcaatagttttaactgttgacgggcgttaggtcgcaccgtcttggtaatttgagtgatttgttcagcatccactagcggccaaatccagttaatcatcttttttctagcagaattttcggtggcgtactctaaagtaacgctaccgtccttaacccactggtttaattgacgctgttgcggataatcaagctcgttaacctttaaatcgacgacctgctgctcgcccaatacttcaacaaccctttgtggatcaattcgttgacgattgactttcacaaaccgttttgtattaattttaaccaaattaggcaacattgcattcaaacaggtcaccctaaaggaaaaggttttctccgccaaccatgctgataaatcaattaattcttgatttaagaaaggctctggttcaagaagtgaaataatattttttaattccatcggggaaccttgccgattttctccaatcacaaacccttggaccggtcttcccgcttgaccaaagggaacgattacgcgtgaaccaattttaatgtcattttcaattgccacatctgcttggtaagtaaatggtgtgttcgtttgcagagctggtacgttgacgatgacatcaaacttttttgtcattccctaatcccctttacttcaattcttcgctaacaatttttaaaattgcttctgcaatctttactttagattgtttagcaatcaccttagctctttgatccggacgtaaaatagttacggcattatcgtcaacgttaaacccaatctcggggttgcccacgtcgttagccaccaccatattcaggccttttcgctgcattttttccgtagcattttctagtagatcatccgtctccgccgcaaaacccacgacatattttaaccggtccggtcggtccaacgtagctaaaacatctgggttttcgactagttcaagttgtaagccatttttaaaatcatgtttcttcaacttatgcgtgctaaccttagcaactcgataatcagaaaccgcagctgccataattaacacatccgcatttttgagctcctgatctaaagctgcttttaactccgctacgtcttcaatatcaattcttttaattttagaatgggtgtcaaggcttaagttagttggtccagtgattaaagtcactgtcgctccagctgccgcagcttgttgtgcaagtgcaaaacccatttttcccgatgaacggttgccaatgaaacggaccggatcaattgcttcacgggttcctccagcagtgaccaccaccttatagcctgccaactgctggctactaccaactggttgacttataaactgattaaccacttccgccgatggaaaacggccctttccggagtaaccttccgccagttctcccactacgggctctagtatttctaccccatccgccttgagttgggtcaggttacgttgaaccgctggattttgccacatgttaacgttcatcgccggcagaacccttttcttagctgaagacgcaagtactaccgtagacgcaaaatcgtccgcaattccaagtgccatttttgcgataaagtttgccgttgccggagccaccacgacttgatccgcccagtcagctaatgctacgtgagcaactggctttcccagatccgatttaaaatcatcataaaccggttcgttggttaacgtggcaaacgtcaatggggtgacgaactcttcagccatcttagtcataacaacttttactgcgttaccagccttcacctggtatcgaaccgcctcaaccaccttatattcggcaattccgccggtaattacaaataatattttcattggcaaacaccttcctagttttatattctaccagtctcctgtacctaatcccatctaaaataatggaatgacaatcacgtaaaaaagctagaaaaaatcatttcagatttttcctagcctcgctttacacttagtatcgtttggtagattttccagtgacgggttctacttaaccttaagtactgattaattataggtctttttcgttaggatcaataactacgtcgcccgcaacaatttcttctaaagctttcccaacgtttttatgagaactatagtggtcaagcaattctggtgcgccctcatctaattggtgtgcgcgcttgcttgctaacataattaatgaataacgagaatcaactcgttcaagcagtttatcaactgaaggatataaaatcattttacaactctcctaacatttcttggtattcagggtaaacgcgtgaaacgcgtaaatgttctcccttaataatatttttaattgattcaacggcattttcgaccttatcattaacgattgcataatcataatcatgcatcgttttaatttcatcgaccgccttttccattcgtttattaatcgtttcaatgtcttcggttccccgattaataatccgttgttttaattccatcaaatctggcggtgttaaaaacaaaaagacgccgtccggcattttttcacggacttgacgagctccgttaacttcaatttctaaaaaaacgtcccgaccagagtctaaagtctggttgacatattttaacggggtgccgtagtaattgtcaacatatttggcatactctagcatttgaccttcttcgatgtttttctcaaattcagctttagaaacaaagtaataatcctcgccattaacttcaccttcacgaggttttctagtagtcattgacactgaatattggaaatcatttccaccttgatcaaagattgcttttctaaccgttcccttacctacaccggaaggtcccgaaagaacaatcaacattcctcttttcgccatttccaaactccctcaaatatatgtatgtaattactattttgcactttttttacttatttttcaactgtattccgcatgtcaaggcaaagtaattccgcttttgagcacctttatttaaaactacttgcaaaactgaacgtttgttcgtataataaaaacacaaacaaacgttcgatggaggcaattatggaaagtcgtaaactaagtccgcttaaattatttaacttttcgctcgcagcaattcgtagtacttatgaaaatttattcgtggttcctgaagaccgcggacttaacattgttgaccaagcgatgtccttaactcaaatcaacgatacgattgcgtttgctatccaaaaccaagttcccgttcagatgcaaatcaatttaacggcttcgcgggtggtcgagctacgtggccacctattattaaaccgttcgggaaggctttgtattcaagaccaaaatacaaataccacccagacattagaagatgcagaaattcgcagcatcgcgctaatataatattttcttttacaagttcaacgtggcttgtaaccccccaatccattatttgtcgtagtaggagcgcgaaaaccattaaaaatcgcgactgagaaaaactaaaaatcgaccatcatggactaggctctgtcaaattgacagacaaaataatatagaattaggtagcttactaaacggcttcattccagtattcatctggaatgaggccatttcttgttgttgattaaaatattcaattccatttttaactaacttaattagcacttgataggctttaaggatctcatgtcgttccagccaacgtagtttaaattcaattataaaagctaaatttttctaatgctgtgtacttaaatctagacattcaaaaatccctccatgattgtcaaatgaaatatcataattcatctgacagtcatggagggattattacattatgccaaatccaagcatgatgattagtttcttattaatgctcaaaaattaccaaacttttatcccacgctcactttttacgtatcttattactcaggcttgttcatgttccatctgcaacagctcgcgtgcgtgctctaaactcaattcagttaggtctaccccagctaacattttagcgatttcattaacccgcccctcatcatcaagagcggttaaattagtcatcgtccgtcccttaaccacttttttagccacgtgcaactggtagtctgcccgggcggctacttgtggaaggtgggaaatacataacacttgcgagtgatttgaaatttcatgaattttatccgcaattgcctgagctactcgaccactgactccagtgtcaacctcgtcaaaaataatgctggtaaccccctcattacgagcaaaaatagttttcaaagctaacatgatccgtgaaagctccccaccagacgcaatttttgccaatggtttcaagtcttcaccaggattgggttggattaaaaattcaacgttatcaagtccgtcgagttccggaacctttttagaattgaactgtaccttaaactgtgttttttccatgtacaatcccgccaactgatcccgaactgcttgttctagtttcaaagccattttctggcgtaaattggttaactgcgtacctaattgcttggtttcttgcaaacgtttttccacttccacagccaaatcatctagattttgacccgccccagtcatttctgccaattcgttttcaattctcgataagtatttcagaatttcagtaatcgaattgccgtacttcttttttaactgccggattgtttctaaccgttgttcgacttcatccagttcagcagggttccactccatcgagtcaatcgccaagcgaactcgattagtaacatcttctaaagaatagtaggcattttgaacctcatcggcaatctgctcgtattcttcatcatagtcagcaattccttgcatttcttgcattacatttccaatttgatcggttgcagaaactccttcttcactttccaaaacttgaaaactagttgctaacgcatctgaaatactttgaaaattaaccaactgatcacgccgcttttctaactcttcatcttcaccttcgataaggtttgcagccttaatttcatcaacttgaaactgcagcatatctacccgctgattccattcatgttcattttttagactttggtttaaacgccggtttaatttagtgtacgccttaaaagcagcttggtaccgttgcttggtgtcggctaccgtagcgtaatcaaactgttctaacaagcgtaaatgcttatcgctatccatcaattcttggtgttcattttgtccgtgaatatcaattaaagtttgtccaatcttttttagactgttcaaattaacgatggttccgttaactcgacaaacgctacgccccgtcttaagtaattccctagtaatcacgaggtcgttagtcggttcaattcctaattcttctaaaaccgtcttagtattggcaatttcagcaatatcaaaaacgccttgcaagacggccttatccgcgccagttcgtacaaagtctacggatccgcgacccccagctagcaatccgacggcatcaatgataatcgattttccggcaccggtttccccagttaatacggtcatcccttgccgaaaactagcatctagtttttcgataattgcaaaatccttgattgataattccaataacatgataatctctcctaggtataggctatcgctttggtgatcctttttcttaactgtatagcgcgctcattgtctttgcaaactaccagcactccgtcatcatcagcaatcacagcaaacacaaaactatagttaacttgcttcaaagttgccgcaacgctgggaccgttcccgggctttaaatcgatgtaaactaattggtcttgtgccttgatcgtaattaaagacgtcgctagtaaattaaagaaacgctgttcaatttgtgaactatccgtctttggtaacgcatagcgaagacggccatccaccgtggcgaccttaactagctgcaattccttaatgtcacgagaaattgttgcttgggtaacttgaattccttgcttttgcagaatttcaacaatatcttcttggcgcccaacctgatgattattgatgatttgtttaatgagggcgtgtcgttgatttttacgcattatctcacctacgaatttaaattagaatatgctcgatcaattacttcattaatatttaccttcgaactaatgctgcctaattcagcatccgtactagatagccatgccaaaaactcaatattaccttcgccacccttgattggcgaataatctagccccaatacgtcgaatccttccgcattagccatggtcaaaacattcttaagtacttcttcatgcactttacgatcccggacgattccatgtttaccaaccttttcacgccctgcctcgaattgtggcttgatcaagctaactaccgagcctccagtttttaaaatctgtttaaggaccggtaaaattagttttaaggaaatgaaggaaacgtcaatagaggcaaattctggttgaccgctggtaaagtctgctaacttactatagcgaaaattagtattttccatcactactactcgggggtcttcccgtaatttccaaaccagctggttagtccccacatcaagggcataacttaatttagcaccattttggagcattacatcggtaaaaccgcctgtagaagagccaatgtctaaaactaccagtccactcacgtcaatgtcaaaaacatctagggccttagcaagttttaaaccaccccggctcacgtagggcatcggttttccctttaagtgtaatttagtgttcgggtcaattttaacccctggtttatccaaccgttcttcattatctcctagaatttcaccagccatcactgctcgtttggccttttcgcgggtgtcaaataacccttgcttaactaataaaacatctactcgttcttttgccattaccttgtctccattattttaaatacgctaaaaaaccgcgaagcagtgaaacttcgtaaccccgttcaactaaggggatcaacgcctcttcgcatgcattaagaaccgtcgataaccgttcttttgcagaacccagtcctaataaattaacgtacgtgtttttatttagcgcttgatccttaccagccgttttgcctagttcaacactactttccgttacgtcaatgatatcatcatgaatttggaaagctaagccaaaattttgtacaaaccgtaatattgccgtagccaccgtggtttcgcacttagcaataagtaaagctgctttagctggaaaaatcaacatttgtcccgtttttaattcgtgcaatttttttaattgctcaattgtatagcgttggtgattgccttcaatgtcttgtagctgcccagcaatcatcccttctggccccgctgcctgcgccaagtcaccaatcaccgtggctttgacttcagctgtaaacccagtcgctgctaaccattgaaaagcaatcgttaatagggcgtcccccgtcaaaattgcttccgcttccccgaattgtttatgactagttggacggcctcgccgaagatcatcattgtccatcgccggtaaatcgtcgtgaatcaacgaataggtgtgtacggcttctaacgcgacggcgaccgttagcacatcaggattgatgggctctcccagcacctctaaaacggctagtaatattaacgggcggacgcgcttgcctccagcgttgaacgaatacgccatcatccgcgccagctggggttggtgtttttcaaccttctccatcagttctgcaaaatgatcgttgattaatggtgtacttcttcgaacaaactcgttgaattctttattcattagtttcatctgtttctaaatcaagatcactttcttcaccattgtctttcatcactttggtaagtgtcttttcagcatttttcagggtatcttgtaattgtgaactcaattgaattcctttttgaaattcactcaatgctttttcaagagggatatcaccctgttcgaggttatttactacatcttgtaattcttgtaaattttcttcaaacgttttttctttttccattatttttcctcgttattaattgttttaattatggcatcagcactgccgtcgctaaagttcaacttaattgcgtcattaacggataacttttctacggaattaaccacttgttcgtctttagtaacgtaagtatatcctcgactcataatccgtaagggactaaggttatctaaagctgcaactaatttttgcatttgtgtttgtgattgggtaaatcgcctagtaattacgctaagcaattgttcccgcaaatatcccaccttttgcgtagctaagtcaacctgattttgcggattgtttactaacaagcggtgctgtaatttaactaattctgcagagcggtcagctaaatactgtttctgtgcattacgcaaccgctccgttaattgatcaacgttttgtacgtagccttcataaagtcgttgaggttcttgaaaaatatacgaattttctaattgacgcgcttgttgttgcttaattttcaatatatttttgaaagcgttgataactcttagctccgttttttgtaaatctgtcaaaacatccgtcaaaactggggtcgccagttccgccgccgcagttggggttgccgcgcgaacgtcggcaactaaatcagcaatcgtcgtgtccgtttcgtgtcctaccgatgaaattgtcgggatccggctttcaaaaattgcccgtgccactacttcttcattaaagggccacaaatcttcaattgaacctccgccccgacccaaaatgatggtatcaaaatcgggtaaagtgttaatgaatttaatttgggcggcaatattaggggcagcttcgttaccttgcaccgctacaggaaaaagcactagttgtacaatcggataacggcgcttcaccgtagtaataatatcgcgaattaccgctcccgaacgactggtcactaccgcaatttttttcggaaatcggggaattgcctgtttaggggccttaaataagccttccttatctagtttagccttcaactgctcgtaagcttgatataaagcgcccacaccgtccggttgcattgaatcgacgtacaattgataactgccgtttccgggatagacgctaatccgaccgctcacaataacgcgcattccttcttcaggttgaaatttaaccttcgcaaacgccgacttaaacataattacgttaattttagcctgttcgtctttaatactaaaatattggtggccgttaacgcgcaaacggaaattagaaatttcaccaaccacgtaaacccgatgcaaatatggatcaacgtcaaattttcgtttgatatattgagttaacgccgaaaccgttaaatattgatcatttgtcattaaatactccactttgtcaaatcagttgtttgcctcattagcatggtaatggtcattggaccaacccctttcgggaccggggtaataaacgaagcttttggagatacctccgcaaaatcaacatcaccagttaatttgccattttgatcccggttcatccctacgtcgattactacggcgccatcctttacttggtcagctttgataaagtgcgcaatccccgtagctacaactaaaatatcggcttgcttggttagttcgcttaaatttttagtatgactatgtgctaccgttaccgttgcgttagcgtttagtaacaatgcagccattggcttaccgacgatcatgctccgtccaatcaccacggctttcttaccttctggattaatgttgtatttatgcagcatttgcataattcctcggggggtacaagccaccggggtacgatcagttttattttgtaaaagccgccccatattcaccggatgaaaaccgtctgcatcttttcgcggatcaattgctaacgtcaccttaaattcatcgatttgtggcggcagtggcatctgaaccaaaattgcgtgaaccgaggcatcgtggtttaagcggtcaatttcttttaataatgttgcttccgttacgctacttggaaattggcaaaccgtcgattggattccaagcttttccgcccgtctttttttattacgaacgtaaatgtggctagctggatcatcacccactagtaccactgctaaatgcggaacgattccccgttcctttaattgcataacttctgccttagtctgtaagtcgatttcagccgctaaggctttcccatcaatgatttgtcccaagcacaacgcctccagttttgaataattacacactttaaatgataacacatgacctcataaaataatttgtaaaataaaagagttacgaatgtcagtttccatccgtaactctacataacctagtctttagcaacgttcgataaaacaccgttaataaacttacgtgccttttcgtccgtatacttcttagctaactcaagtgcttcattaattgctacgctattaggcacttcagtatgtttaatttcatacgtaccaatttgtaaaatcacccggtcagggtttgccaaacgatttaccgtccaaccagctttaagttctttaccaatcgtttcattaattgacgaaacgttttcttgaactccagtaactagattgtccagaaacggatcagcaacgtcggcttcatgaaattcttccaaaacttgtttttttaattcttcggggtccgcgtccggatttacgctctgggcaaaaatcatcttaaaggcgctttcccgcatttgatgtcgatttaaactcacttttgatcaccattattttctgaaaaaatatcgttagggtcaatatcagacgtggttttgtccggaaccattccactaactactacgttaacttcatcaataacgatgccggtcataaatagtagttgttgttgaatccgatcctgaatcttggtggcaacttggggtacagatacgccaaaatcaagcatcacattgaccctgattaccaatccgcgttcatcttcaatcaacttagtaccagcgccaactgcgtcacgacctaaaatggtgttaaagccctttgagatattgttgctaatcaaatggacaccgtcaatttgatcgaccgtaatccccgcaatggattcaaccacgtcaggtgcaatcgcgattccgccgctttttgaactggaatccttcaattccaagtatttcgtatctgccataactatgcctcccaaaaaattaagcccgtgaaatataagttccgtcttgggtgttaatgttgagggtatctccttcgtttacaaagaaaggtacttgtaccactaaacctgtttccatcgttgctggctttgaaccaccgcttgcagtattacccttaatacttggctcagtcgattcaaccttcaaagcaatgttctttggtagttcaacccctaaagtttcggaaccaaagaaggaaatgcttacttccatattttcaattaagtagtttttctcttcttcgagacgttcttctggaatttcaacttgttcatacgtattgttatccatgaatacgtagtttgccccatcgttatacaagtattgcatcttgcgagtttcgatgttagcttgttccatcttttcaccagcccggaaagtcttttcttgtaccgcgccagttcttaagtttttcaacttagtccgtacaaatgcactacctttacccggcttaacatgttgaaattcaacaatccgccaaatgttatcttcaacttcgatagttaatccattatgaaaatctgacgttgaaattgtgctcataaaagattcctccaattattataagttcataatatcaatcgctcgtctatttaacaagaaattcattaaaaaaggccggaacaagatgatttgtcccgacctgaattgcttatcgcttattcagcatctgctactggatatacagaaacttgacgcttgtcgcgacctttacgttcgaaacgaacgattccgtctgcaagtgcgaacaatgtatcatcgtttccgcgaccaacatttacaccagggtaaatatgtgttccacgttgacgatataaaatcataccagccttagcagcttgtccgtcagcacgcttagttccaaggcgacgaccagctgagtcacgaccattggatgtggaacctccccctttatgatgagagaagaattgtaagttcatttccatggtaaatacacctccgaatgtaagttaattcattactaagtacttgtcataggttttactaatatcccgtaatcctaattcaaaagaagccaataagacttgcgccttttgttccgcttcccgatccttactttcggggacattaactgataaaaatccaccgttatcatcatctgaatcaaccagtggcattaccgaggcgatttgttcgatactattcacggtattaatagctaaaacagaaactgcggcacaaacaatatccttgccgtactcaccagcatccgcgtgcccggtcagcttgaacccgctaatacggtcggcttcccgataaatccatgcttgtatcatcactcctcacccttccaactgactaagcgttgattgaatcaatcttaacctttgtatatggttgacgatgacccttcttagtgtgttgacccttcttagccttgtacttgaaagtagtaatcttcttttgcttgccttgtttttcaacagtacctgcaactgaagcaccttcaacgactggagaaccaatctttgttgattcaccaccaacaaaaagtacttgatcaaatgttaccttttcgccttcagcagcgtttagcttctcaacgtatacagattgtccttcttcaaccttgagttgcttgccaccagttttaataattgcgtacacaacgtgcacctccttattcatctcagactcgccaaagtaagtgccatgcttaaaactcactctgtgcggttgtagcgtggagaccacaccaacattagtactatacttgattattgttaattagtcaacgttaaaccacaaaaaaatcagtcaactttaaattgtttgccttgacactttctttgctatcaaggacctgttttgctgcgtttgccatgtaatgcggcgtgtacatcattcctttttccaaccaaaccttgatcattccgacaattccgtttacataaaaggagctcaatacttcgaagggaaacccgcctaaatcaatttcgtcatcgtaataatctgcgaacttttcaaactcttccattaagcgtttttttaacgtctggttgaaactaggtagtcgatcgcttcccattactactgtgtaagcttggtaattttcagctacgtggttaaaaatttcagtcaacgaaagcacatttgcctgatgggcgttttcgtgcttcgtctcttccacataatccgcggagtcctttagggatggttttagcaattcttgaattaggctttccatagtaaactcaaggaattcttttttgtctgaaaaatgagagtaaaaagccccccgcgtgaccccggcttcgtcactaatttgacggacgttaatgtcactaacatcgtaagtctttaataacattacaaacgccttttccagtttattgattgttttaataattcttggatcatttttcataattaagcacctcatagagttcgcaaatttagtcattcaaaaatttgtatcgcccttaatattctataccatacattaatagcgaacttttatcatctacatgttcatgatagcttaccaaacccaacaaatgaaccgctaacagtccagtttccgtctcctttttttcgcttattttaaaaaaagtggcatagtagacaaacatccctcaccgaagcggtaacaagttaagttattcccgtaaacataacaataaataatggcgccctgtattttggttttaagaaaagatactacatcgtttaaagcaaattaattggtatacttcgcactaattggacccgtcttataaagatgtttctcggtgattaattaatacctttttcaaccttgagattaaaaaagcgcctctcaaaaacttaaaattcttgagaagcacttttgatttttcaccttcaatagcattaaaacgcaggttatcatcccttgggtttcaaacgattcccaaattagacagtacggttaccttagcgtagccgctaatttatttatattataacccaaaagcgaccgattttcttttgcctcgctatggcttacatcagcacttattcgttaccgccaatccggtataacttccgatcagcctgggtatcttttaacatttgtttgtaaattttattttgttcatcctgatgtttagtaaccccatgcgggaggagtttaattgctttaagcatgttattgcggattcgctcgcttagatcatcgtcaaagccacgctggtggtcataagcatttttgacaatccctttaactccggtaggcgtgtcccctaatagttgtttaaactgcgcccgatcctgtttattaaggtgccgttgcccctttttaataagggtgttcaaagttttaattaccttctgctctgattcaggattctcggaattaaatttttctaaaccctttattgagtcttcgatcatcgtcttatccgccgagatctgtttgtatttttcaggtgtgactactacagtcccataaaccttgttatgtgtacaagctcctaaaacgaccgtcaccataattaatgacaataaaattgcaaaaaattttttcatcgtccgtcaccctctaatgatttcttttacctaatgataacggatatttaacttttattaaagtaatttgcgcccttaactgatttttaaaataaaaaaagcaaccactatattagcagttgcttctttacctagaagataaaaatcatcatcaaaatccagttaaaaaacggaaaagcactcaaccttaattgaaagattgagtgctttttctttgcttggtgagcgtttggtgagcgctccttcttcaaaagcctatattacagggcttccagccaatataagtatgattcgggtgagacttgaactcacgaccgtccgcttagaaggcggatgctctatccagctgagctaccgaaccgtacctgtttattatatttaaaaaatcccaatgtgtcaataaactttcgggccagataacctaatctatccagattaaaagggcgcgaagattcatcaagaatcccctcgccctacacattacttatcactcgtctcaaaaacatcccaatagttatctggtggagtgtccttagaacttaacttccagtgcgcagatcccttatgagtagattcaggatgctctttcaaacattcgaagcggcgatgcttttcatcttcaataatgaaaacacgtcgaaactcatcttttttactgacgatggtggcattttcgtgcttaaaaccatagatatcagtatacgtcattacatacatcgcttccttataaacgcaaaattcgccaaacgtacttcggcctcacattaccattattccacaaacagagtctttagtaaaatatcttgcttctttgaagcacctatacgtcttaaacgtcgctcccaaatcatcaataattgttttcttgacgctgataattaatttggtttttcgcaaaataagccttttccaattcctcaggagtaaatcctaagccttgtatcccaaattttatgaataagtgccaagcatgttgaaaatccgtcccccgattataagaatacgttgaaaacagcattttcttaatatttaaatacatcaaagaaaggtccaaatcacgctgatcactttgataatttgctaattgctcatcaccaatcacaatcaaatggttccactggtttaaattagccatcaacaaaaagaaatcaatggcatccacaaactcgtttaaaacggtttgatgaactgataattctccgtcgcgctttccgcggtgagtcttccaaactttaaaccattccgcagcattggcgatttcagccaattccacatccaatgaaatatacgcttcttggattcgatccgccaaactgttttgtaaattatgcttaatccgaatgtcacggtcaaggttaaccgaggcctgtaacatttttgcccaatccatcttattaatcaccttaaagtatcatttttaattttaaatcgccaatgttattgacataccaatcatttaagaaggcgtagtctttcaaaacatcaaataaagagtattgctcttcttgatcttgaacgcgcatcgcccactgatggtcggaggcactcatttcaaaaatagttagcattacgttagatttcaaacgcaagaatgcgcctaaaaattcatccgcattgtataaaatgtaatgattctgtgccgcagatacaaacaattcatcaagaatactactgtccaaaccggtaccttcaaaaacgtaaatcttttcgttgcgagcatcaaacatgttgaagtcaacttggaaattataatccctttcaaggagttggccaaacttaataaaagaagcaacctgttttttcaacgcggactgcgaatcagtttcagaaccggataagaagtataaattattaatggtttcggtatcaaagctcatggtctgcttttctaagttcaacctaaaaataatttggtggctagtttgttcaacatacgctaagtgctcaccatttttttcaaaccggaaagtctgttcagtgcctggccattgatggtgcataaccggatgcccaccagcctcagtcattacggaacgaaattggttcgtcaatccgtttagctcaagcaagcgtgacataaaaatcaggtagtagtcactagctgcaaacttttttggaaagactaccgctgccgtatccacttcaaaactagctaattgccgcgttgcactcagtaactcttctggatcggtagtggtagttaacacttgcattaactccgcatagtgttgacccttcttgagtccttcgtttaattcgtcttgaacctttaacatgttctgtttgaattcgttagtggctttggtattggttggttgtgttttttgcttatccattagactttacctgcccttcgtctaatagatccataaggtagttatggtaaagattttgcgttaattcatggaattctttaaaactcgtaaagctcttctttaaagccgccgtctccaatccaagcatggtgtcttctttggacaatgccaaaatttgtttttgttgttcccgaatcttacttggagcttggttagcagtttgaatttcttcttcgaccttagctaagtcgtcttttaattgttgccgctcttcttttacctttgctgactcaaataagccacccttttcagccaggtcactttgttgttgcatcaactcttcttttttcttctctaattcagcttggccatcaattaatttttgtaacctaacgttgtcagcagaaagttcagcaatttggtcgccgtttaaactttcgccagcttcttcagcttgtaacgctttttccaattgactcaacttatcttcatccagtgccaattcaatgtttaaagaatcgagcgtcccaatttggcgccggtcccaccaatttccaaagaagacgataaattgccccttttctacctcacgatagtagaaaaatggaaacttttgaatcaggtaatcaattaaattatcacttaggtaatgcgctagttcagcacgttgatcccgaacaagttcaaacggatgctccccatacttcaaatcgaagccctggtcaatttcttctcgataacgtactggctctaaaagttggtaaacctgtaaatcatcatgttgatcaatcgcttgcgctaagtcgtttatgtattgatcctttacccttagttgggaaattaaaatctccccactagattgcccgtggttcttacgttcatctgccatgatatccgctccattctctatttctgtcttaatgttacaaaaaaatttcaaataaataaagcgtttagtcaccaaatttaaacaaacttcaaaaataagttttaaaaccgtttcatacgagaaaacagtgccttaaccaaaataaaaattgcagtaaataaaaaatcgcccaagaatttaagaattcttaggcaatctcttagttcgttatcgatgaaacaaaagccagaatgctggttacaaattaacttaaagcctgcgattccgcattgactttgttccattagtcaggtatggcaatcaaacggttattttaattgatttttagaacatttccaaatactgatcccgttcccattgggtaacttcttgacgatacgaagcccattctaatttcttagcttccaagaaactttggaaaatatggtcgcccagcgcctttctcatcacatcgtctttttcaaattccttaagagcgttatgcaatgtagaaggtaaatcttgaatgtgttcttcgtgacgttcttgaacgttcatccggtagatgtttcgatcaaccgaatcatctggttcaatttggttgcgaattccgtccagtcccgcttcgaggacggcagcaatcgccaagtacgggttagctgacggatcaacgctacgtacttcaaagcgtgtcgatagtcccttgctggaaggaactcgaatcaatggggagcggttagaacctgaccaagccacgtaaacgggagcttcatagccaggtactaaacgtttgtacgaattaacgatggggttgcaaactgccgtgtaactccgagcgtgttttaacagtcctcctaagaaccagtaggccttttgggaaagctgcaactcacccttttcatcataaaaggcgttgccttctttattgaaaagcgacatgtttaaatgcattcccgaaccgttgatcccgtcgagtggtttaggcataaaggttgcgtgtaaattatacttccgtgcgaccgtcttaaccactaacttgaaggtttgaatgttatctgccgcagttagcgcatcggcatacttaaaatcgatttcgtgttggccgggtgccacttcgtgatgggaagcttccacatcaaatcccatattttcaagttctagcacgatatcccgccgacagttttctcctaagtcaaccggcgccaagtcaaagtaacttccttggtcattgaggtgcgtcgttggtttaccattttcgtctaacttcaagaggaagaactctggttcaggtccgatgttaaaatcggtaaaaccttcgtccttcatgtcttggagggcgcggatcaagttattacgcggatccccagcaaacggtttacgatcgcttgtatacacttcgcaaatgattcgagcaacttttccgtgttcacttccccatggaaagaccatccaggtagaaaggtctgggtacaagtacatgtcactttcttcaatccgtacaaagccatcaattgaagagccgtcaaacattaacttattttccagcaatttgtctaactggctaattggaacttcgacgtttttaatcaccccgaagagatccgtgaacattaaccgcaaaaattgtacgttgttatcctttgccatctgtcgtatatctgctggtgtgtaatttttctttgccataattgtatgtccgccccacttatttttttattaaattcgtttaattgggaaagttgggccatcatcgtcggtcaagcgccccgtttgcaataattcgtcgcgcaaaattttgcgcatctggctatccgaaatcgaacgcttccgcgcttcggcttgccgagcaaactgttcttttacttcagcgatgtttaaaccgtctgccaggtaatccttaatttccagcaaacgatccacatcgtttaaggaaaataatcgccgattgccttcgctccggtccggaaataccagttggtgttgttcgtaataccgaatttgtcgcgcagttagcgatgtcagtttcataactgtaccaattggtaaaactgacagtgaacgacggagctctttttcactcataccaataactcctttaatattgagcttattctaccaattgaaaatctgcccgtcaagaatcatgtcaggttttctaacatcaactaaaaaaagttgcttccacggcctttgcaatcgccacttttacgtgtgcgtaggttaacccaccttgtaaatataacgtatatggcgctcgtaacgggccatccgcagaaaattcaatgctagctccctgtacaaaggttcccgctgccataatcaccttatcttcgtagccggccattacggatggttctggatcaacgtaagaatcaattggggaattcttttgaatttgtttagcaaatttgatcattggttctggctttccaaaattaatggtctgaatcaagtctgtccgcgcatcattccactttggatccacttggagaccacacttttcaagaatggcactttcaaaaatagcacctttaatggctgccccagtgaccgccggagccatgaaaaatccttggaacattcgtcgcaagttttctaaggtcgccccttcttctttgcccgatccaacgttagtaagccggctagcaattttttcaatgaggtccctgcgcccaactacgtatccaccagtttgcgcgatgccgcctccggcatttttaattagcgaccccaccattacgtctaccccgacttcggttggctcgatagtttcagaaaattccccataacagttatctacaaagatggttacgtctggagcgactttacgaacctgtttaaccattgcttcaatttcggtaaccgtgaaacttgctcggctatcatatccacgggaacgttggatggccactactttgacgtcgggagtcaatttcgaccgcattccctcaaagtcaacttttccgtcagctaacaatggcacgtaatcaaaatcaatttgaaaatctttcaacgaaccccggccagcttcaccagtaattccaattacttcttgaatggtgtcataaggcattccagttaagtacaataatttatcattaggtcgcagcattccaaaaaaggccgtactaattgtgtgggttcccgaaacaaattgtggccgaactaaggcatcctcagtcttgaatacgtctgcataaacctggtctaaagcgtcccgacccatatcgttataaccgtaaccggtagccccgtttaaattctcctcagcaacccgttctttttgaaaagcgttcaaaactttttgctgattgtaagtcacttgatcatcaatttcatttaatttaggctgaatttgttgttcaactttggtaattaatttttgtacttccggtttatattggtctttccaactcttcattttactaaccactcctcaatttcttgattaattatttgtttttcatttgggttttgaataatgtcgaaccaatttacgtccatctggtttcggaaccaggttaattgtcgtttagcgtaatgtcgcgaatctttttgaatttgagccaccgtagttgagtaaggttgttcacccgcaaaatatgccggccattcacgataaccaattcccttcaccgcctgaggaacctccggctgtttgaacaaccagcgggcttcagcttctaatccttgttccaacattatctccacccgttggttaatccgttcatacagctttgcccgttccgtatttaacccgatcaggaatgcatcataggctaactcaccccgtgatttagtctgttcagaaaatttttgccccgtcgtttggtagacttccaaagccctaatcacccgtcgacgattatttaaatcaatattcgcgtaacttaccgggtcgacctttttcaactgttgccggagtgcatcgtcctcctgttgatttaatgccgcccgaactttttcaacctgttgtcgatcttcattagcggtccccagctgtaagtcgttcaataacgcttgcaaataaaacccggttcccccaacaataattggcaatcggtttcttccgttaatttctttaattaactgcgaagccgtatttttaaaatcagcggcggtaaaacgttcttgaaccgtccgaacgttaattaaatggtgaggaattccctgcatttcttcaggggtaatctttgccgtgccgatatcaagtcgttggtatacctgcattgaatcaccagaaataatttcaccattccagcgtttagccaactcgacggacaggctggttttgccaactgccgtaggacccacaattgctaaaactttttgcatctcatcctccttgaatagttgcccggacttgtaatgcgcgggtcggataatccgtaatcacgcctaaaaagcccttttgaaagcaaaatcttaaatcactttccacgttaattgtccaagggcgtaaacgtcgttttcctagaagaaaacgatgcccccgaacccaagccatactagggtgccaattttgaattaccttacggtgcgtcaacttgcgagctgcctttgcgttaaatttgaacaaactagccatctctacgtctggctgtaaagtatgcattgtaactaatgtttccgggttaaaactcgaatacaccagctcgaacgggtagtcgagatccttaaaaaaactaaacactttttgttcaatcccaggatacttaaatttgtcggtcttcagttctagattaaagattccggtatatcgttccgcaattagtaagtcgaccacttcttgcaatgtagggattttctcgttttggtaccttccgctaaaggagcctccagcgcttagctgctttaactcagctaaagtatggtcaaatacgcggcccgttccgttagtggtgcgatcaacagtctcatcatgaatgatcaccatttcaccatctttagataaatgtacgtccgtttcgattccatcagcaccctcttcaattgcttttttaaaggctgctagtgtattttcaggtcgaacacccttactgccccggtgggcgattacttgcgtcaacataacattctcctagatctatttctggtatttttgggcaattcagcgcataattagggtaacctaaataaggagctgaattacatgggtaaatttgttaagggattcctttttggatccgtatcaactcttggtgccattgcaggtgcagtgtacacctttcataaggtagtcgtggagcctgtcgaagaaatcgaaaaccgtgctgaagaaaatcggcgacgcgcagagcgtaaacggcacgcggcccaaaacggttaattcgttttaaaaacattgctaaccttaagttggcaccagtatacaaaaagagattgggttaattccattttaacccaatctctttttaatatttagcctttttagtttttccatcccaacgttggtaaccatatttcaaaatatatagctgtttaaagccgcgttttgacaaaagcattgctgcccgtccactaaacgtccggccttgatcgtataaataaactggtaaatcagggcgtaactcttgcgtccgacttttcatttgggaataagggatgttccgagcgcctaaaatatgaccggcatcaaactctttcttttcacgcacgtcaatcacttgagccttgcgcatccccgctcgaaaagcttcattatccaattgggttgcaatcttgccccgcttccaatacatatatagttgataaagtaagtaggcaatgattaagataatgattacggtattgatccaaaatccactcgaattacttgctgctgcagctaccatgttttattcatctccaaaattctatatattaagcaaatacccgcgctaatgaagcagcgccgattacccccgcgtcgttacccaaacgagcaagcttcaattgggttgaagaacgcacggtagagaatgcaaatttttcaaagttatcgcgaacccgatctaacaagaattcaccagctgctgaaacgccaccgccaattacaatgctttcaggatttagcgtatttgctaagttaccaagtgccagaccgagcatgtagcaaacgcgatcaactacgcgcaatgctaaaacgtcgccttcctttgccaaatcaaacactagcttagaagtgatgtcttgcccatcatccgtttgacgcttcaattcagaatcgccagaaaattcttcggccatgtcccgagccacatgtacaacaccagtagcactagcgtattgttctaagcaaccgcgcttaccacaagtacataagtagccttctggatcaaccgttacgtgtccgatttctccagctgcgccggccttcccatgtaacagttgaccaccagcgatcaaaccgccaccaattccggtaccaagggtaacaaacgccacgtcgtcaccgttttctccggcacctttccagcgttcacccaagccagccacgtttgcgtcgttgtcaattgcaaacttaatgcccgtgcctttttcaatttcttccttgacgttttgggtttctttccaatttaggttaaatgcgccaattaccgttccgcgttgacgatcaacggttccaggagtacccataccgattccaataaattgatccttgctcatcttgtaaagatcaatgtggtgattaatggattcaataatgtccgggacaatgtgagaaccttcatcaaggacgttcgtttctacgctccatttttgttggatctcgccatcctcagttaaaatagcaaacttgattgttgttccaccaaggtcaaccccaattaatttccgttccattagtctaaaaaacctccatttttttgcttatgatctctaacttcttcaatatggtgctcgtgccgtaaaactaattgagcttttgcaaaagtcggctggtcaattacccccgctttatacaaatttttcagttcaatgctcatcaattcaatatcccacttgcgtttaccaacgtaaacaaagacaccaaattgctttaaaagttgttgcacatcataaagtgttttcataataccatctcaactaatttaccaaattatcgctataatgtaaacgctaatttcacaaatactcccaataaaattagtagaagaaccccgctaccaagtcttttctttaggggtactttgcctaaattagggaagctaaacccgtaacctagtagaaagccagcgactagcccgcctaggtgggcgaaaatatcaatatttgtaccaaacattccgctaacgattcccaacgcactaaaaattagcatttgacggcccattccggctaaaaaaggatagttttggtattgctcagccatcattatccagacaccaataatcccaaaaatcgccccgctagcccctgctgaaatactatttggtgcagcaaacgctaaactaactacgttggcaaaaattccggaaagcaaataaattaatagaaaacgcccgtgaccaattacctgttccagtaagcgtccaataaaataaagcgtgatcatgttaaataacaagtgctcgaaaccgatgtgcacaaacatggaagtaaacaagcttgcccatccagcaccatctttaatcatggctggcaccatggctccgtgagttaccaaaaccggcagatcagttgatccgcctgctaaggttagccataggtaaaccaacacgttcaacgcaactaaagtaatcgtcacgaaaggtccggcaaaaaagtttttcaaattaatttttgttttgtccattctatcttatccgttcgtttttaaattgaaccccttgctcggtaataattagatccatcgtcacgtcaaattgatctaccggccagtgagcagcaggataaacttgctgattaaatgctaacacaattttatgtgcttgcggagcccgttttaaataacggtcgtagtatcctccgccaaatcctaaacgattaccgcctgtttgctcgtaagctagccccgggaccacaatcaagtcaagagctgtgggtgcaaccggaatcccgtccacgggctctaaaatgccaaaggcctggggtgccaactgggtctcggaggttaacgaaacaaactccatccgtcgattttcaaaagttttaggaaccaacactgaaatcttgcgttcttgcaggcgtcggataatgggggccgtgtttagctcaaatttttgacttaacgtaattgctacgttttttgccgtgctgaccgcagtttgttcaaagaaccgttccataatttgctcttctagcctagccttaacatccggagacaactgtcgcaactgttctatctgacgttgccgaaattgttttttatccacgggcctcttcctcctgattcggtgaacttgtaataaaaaagaccagcaacctccaacttggggcccctagccttaattattatttagtttctttgtgtaatgtaaccttgcgttcacgtgggcaatacttgtttaattccaaacgatctggattgttacgcttgttctttgatgacaagtattgacggttatggcattcagtacattctaaagtaatgtgtacacgcattggaatgacctccattaattatatatatttgaattctaaaatccactagcattatacatgctaccacgatttacatattttttccataatgaattcgataaattacccatttaagttttgcgcagccgattctttagtcgccttagttgggttttctaaggaagacttcgattggacgtctttccagtaagcttcataaatcttcttagccgcgttcatgttatcagcttcactagaggtactcaaccctggtaatgccaatgccacgacgacttgcggatcgttagatggtgcaaaagaagctaaggatagcgttaccgttgacttcccattagtagtggtctgcgccgtaccagttttagccgagattcctggtgaaatacttgcaagcggtcccccggttttatatttattggtaccgtgcactaccttatatagtccgtccgtaaccattttcttttcttccttgctcatgtcgatgtaattcaacacttgcggggtggtggtgctttgtactgcccctagcttaccatttgaacgactacttcggatttgttccaccacgtgaggagcaattcgataccctccgttagcaatcgtcgacatgtactgtgcaatttgaattgtggtgtaagcatcgtagttcccaaaggagaggtctaacgccttaccaatgtctgccgcactcgaaggtcctttataacctgccgattcccccggaatatcaattccagtctttactccgaggccaaactgttcaaagtatccccgcattttgttaaacacggtcggattcatcccagctaatcctgcaccttctttgtacttgaaaccgccctccttcatggctaattgcatcatgtaggagtttgaagaaacttctagcgcggtcgatacgtcaaccggcatgttcgcactacccgtactattgaaccacgaactctttgaacccgttcccgccaacttaatgggcttatcaatcagggtattgtcttttggagtaattaccccgtccattaaggctccggaaaccatggcgcctttgaccaccgatcccattacaattggctcgttaatagttccgagggcgttatcggtgattttaccggttgacggatcgcgatctactccggccaaggcaattaccgccccggtcttcggattcattaccaccgcgtaaccgccggttgactcgccgcccgcgttttgggaagcttccttcatgattttttgcacttcttcttggaacttagagttaattgataaaactaggttatcacccttcttaccagcgtacttttgcacccgttttaccacttggttgcccgaactaacttccacagaagtctgggatttagtacccttcagtactggttcataacgtttttcaaggtagctttggccaacgcgatcattgcgggcatagccttccgccaagagggtgttcacttcatcgctaggaagtccgactttggagctgctaaccgttccggcaaacgactttacgtcatcgccagcaggatagtttcgggtccaactagtagtgatcttaactcccggcatctctgacaagtgttccccaatttgagatagttcctcgctggttaaatcagtctccttaatgtaaaccgtcgataactggtaagctccgctaatggttttatagattcgcgcggcattcttttgccgagcagtcagttcaacgtgatcctttttgaccgcggcaatctctttttcttgcaatgccttactagaaaggttttcccggttaggaattttttgcgcgtacgctttactatttttactgtcagctaaaagatagttcgcaatatcagttgaagtaaggtcatttttttcaaccgttaaatacttgcttaacttattagctacgtcgtacatatcctgcggtaggacgttcatattcttagtataagaaaccgcttggtgcgccttatttcccactaaaaccttacccgtggaatcgtaaatcatccctcgttgtacattttcggtttctaccatgttatccgaacggttaacctcggcttggagctttgagccgtacaaaatttgtaaatagcctaattggccaatcaataataacaataacgcaaagacaccaaaaaagattaaatttaaccgaaacggtaattcacttttttgccgccgaaattttttcttcggatttttcatgtccacatattactccttagttaaatcacttcgtttattctaccagaaaatatgccacttcactaactgattagtaaagtcttaaagatgttttatgctatcctaatactattaataaattgcttgggggatctttatgcaaattaataaccaaaaacgtgatttattgctcagtagctgtattcccgctttagtaatgctcacctactttatttaccggggctttgctccatttggtagctcgagcttactaaccgtggatatgggccaacaatacgtcgctttttatgaatattttcggcaaactattttaggacacccgggtcaacttttttactcctttagcaacggccttgggagtgacatgttcggcacctgggcctactatttattaagcccaactaatttaatactgcttttctttaaaaaggaaagtattactgccgggatcctaatcgttaccctagtcaagtatgcttcggcaggcttaaccgcagcactttatttgcatcaccttgcacgaagccttggacgaaatcctaaccggcttagtgtggcgggttttgctacttcctatagtttaatggccttttcaattgcaaaccagctcaaccttttttggcttgatgctccaattttattgccactgattattatgggaatcgaccaaattatcgccgatcgcaagcttaaattgtttgtaattagcatgaccgccatggtaattattaactattactttgcgtacatgattggaatttttacggtgatgtattttctgtggcgcagtccccacctcaattggcgtaaggcgtggtcctttgtgcaggcttggctggcagtgggaatcttttctgcggtgacctggatgccgactttgtgggcacttttgcacggaaaggcgaactacactgaaaacaccttgcagtggaaattcgaatataatccgctcaagatggttttaaagctatttccaggaacctttagttttaaacaaatgtccgagggacttccaaacatttacgtcgggatggtaattttaattgcggtaatcgcctacttctttaaccgccaaattaaactttctcaacgcctaagtgcctcggcaatcaccgcaatcttcttgctgtcattttgctggtcaccactagacttactttggcacgcaatgcagtttccgtggtggtatgcttaccgattcagctttatctttagcttttggatgatgatgcttgccttttgggggatgctttatcctctccaaaataagctattagccccgctggtcactagtctactaggactatgtttaatcctactggcaggtatccagttcttgccaaaatcgcaagactttttatctaacgaccaattaattttaggcggaatccttttcatagctgctttgctactatgggttggcttacagagtacaaattccaatccggcgttgcgttcgattatgcttggattaatggtcctcgacgttggaattaatgccgtttggtctttaaaccgcatcagctacgttagccaaagtgaatttcaaacttatagtgtcgcagcgcggaaagctctccgccaaatccaaaaacatcccgcagattttcagcggattggtactaattacttccgggcaaaaaacgatcccattcagttaggttttaacagtggagctagttttaattctaacttagaaactaattctctagaggccatggcggatttaggccaaccgaccacttcgggaaacattacctatatgaacggaactttactatcagacgcatttttagactttcgttcctggtcgctcgttgacgcccagcctaagaaaaatccgtttttaacccggagcgtccggcacgatattttacagcgttatgattactttgataaaactcggtatgcgaataactaccgtaacccttacgcaattagtttagggacgatgacttcacaaccagttaccaaccagttaccagcctaccgtccgttagagtaccaaaacgcaattatgaccgcgttgggtggccaaagtaaggtcaacctcttcgacgacctcaccagcactgcacaaatttattattccaacgtcagcacctcggctgacgtccggaacgcagtgcttaataaacaaaaactaaataaaggtgcctcggttacttttgaagtggttcctcaaactaacgatccgctctacattaccgttggcagccagatgaactatcataatgccgacattttcgttaataaccaacgcattaccgaagacattgactacgaccatccaattgttttgtcagttgccgaccatagtcgcggcaagcgggtgcgaattcaaattgtgctaaagaaatcgaccctattaatgtctgattttggaatttatcaacttgattttgctaaatttaaacagttagatcacgttgcacaaaataaccagcttacggatgtacaagctaacggcaacgtggttacgggaaagcttaaggcaactacaaagcggccgtacctgtttacctcgatcccatatagtccgggctggcacttaaaagtagatggccacgcggttgctacccaaaaagttgccaaccacttcttgggtagtgcagacaaaatttcgtcaggcacccaccaatggaagctcacttattaccctcctttactaggaatgggaactatcatcacccttctgggttggttaggtttactaatcaaactgtggtggcaaaaatcgcggcgtaaataaataaaacaaaaaataactcaaaggagattagaattcacaaggaccttaatctcccttttattttcctagctaagttaataataaaacactaactaaaaaggactaaatctgagtaacacctcaagatttagtccttttttatcattgatatattgaaagtttaaaaactactccgcactcttaacggtcaaaatcttcaccttcatatcgccgcctggtgtagcgattgtgactacgtcgccaaccttcttacctaacaaagccttagcaattggtgaatcatttgaaatcttaccagacatcggatctgcttcagcagcacccacgatggtgtattcttcgggttcttcatcaggaagttcttggaactctacaacccggcctagggaaacttcgttactatcaatcgcttcgtcatcgataatttcagcatagtgaagcatgtgttcaatcgtgttaattcggctttccaccatactttgttcgtccttagctgattcatattctgagttttcagataaatctccaaagctacgggcgatcttaatccgttcgattacttgtggccgagtttccgtttttaaagtttctaactcttcttctaacttttgcttaccatccaaagtcattggatatcttttttcgtctgccattctttcacctcaaaaattatttattatattgtcggtcgcgacctgcatgtgcaagaatatcgcgaactttggttactaacaaatcaattgctacgctattttccccaccttcgggaacgataagatcagcatagcgtttagttggttcaatgaattgatgatacatcggtttaaccccggttaaatactgggtaatgattgattctagcgagcgtccccgttcctgggtatctcgctcaatacgccgaataatccgaatgtcgtcatccgtatcaacgtaaaccttgatatccagcatgtcacgaatgcgttcgtcgcttaaaatcaaaattccttctaagatgaccacgtccgtaggttcctgatgaatcacctcgggacttcgggttgaaatcgtataatcgtaaaccggaacgtcaatcgcctgccgctgtttgagcattttcaaatgttgatacaacaaatctgaatcaaaagctaacggatggtcatagttaaccgcacgccgctcttccatagtcattcccgcttgatccttataataagaatcctgttggataattgaaattgagtgtccatcaagttgttcaagaattttcttactaacggttgttttcccgcttccagatcctccggttaccccaataataattggactatttttcgtactcattaatctaattcctcactatttaccttccggattgtattttgccacgtcattattaaacttatcaaagtccttatagaacaagacgtcgccaactttatggccaccagtcttcttagttaccgcaaagaagtataggtatccatctttagtatcagcattaattactgacaaaatcgagttttcgcctggattatcaaccggaccaggcatataaccggtgcttacccgggtgttatatgggcttgggtttgctaaatccgatgcagttagattttccgtagccgatttctttacggcatatcgggttgaaacgtcagaaccgagtgtttcaccttgtttaatccggttcaaaaatacgcccgcaatcttagtccggtcgctagctttactaccttccatttctactaatgacgcaatgctcaaggtttgttggacagttaagcccttttccttgattttgccatagtaaggttggagtacggcatcttcttttgcaaccatttgggtgaccacgtcttttagactggtatccttgctaactgaataactagccgggaaaagataaccttccaaacggtaacgaacgccctgcgcatccattgcagaacctaacaacttagggtacttctcagctaactgcttaatgaaactttcatccttcatcagcttcaagaagtcttttttagtaaagtatttcgaatctttggcgattgaatcggcaatttgatcgatattttcgccttctttaattaagatccgcggtccgtttagcgcaattggttcagctgctccgcccttttcaagtttagtagcaatttgctttaaagtcatcgaaggctttaaaacgtagtagccagcttgaaaattattcaacttttgctttttcgtgtaatagttaaagacggctccgcttttaaccacctgcttcttttccaagattgaaccaacttcccgagcggttgaaccaatcggaatgttcacttcaatctgtttattactttgcgggtttaatggtttaagtgaagagctatagtaccggtagcccatgaaggtagtaataataattactaccgccaaaatactaattacccacttgataatttgatgactgtttttattagcgtgactattatcagtccgcctccgccgactttgattagaatcgttgctgttattattcaagatttcattctcctatcgtttacaatactggtaattatacaaaattatcccttaatgtgcattaaagtcaccaagttgtaatccttagcgaattgttgctcctaattgggtttctaattgttcaactaccttcgcaaattcctggttaacggtatcctcttgtaaagtagcatttcgatcttgataggtcaattggtaggcgagcgatttagttcccgcatctaaatgatgtccagcataaacgtcaaacaatttaacgtccgtcaggtatttttgcttggtgccttgaataacgtctaatacttgttcgttagtaacctcttcagccactagtaacgccacgtcacgggtaattgctgggtatttggaaatcacttcgtaatgttgcatttgctttggtgcatcaataattttacttaagttcaattcaaatacgtacgtttcgttgatcttgtattcttgcgcagtggttgggtgaacttgaccaacaaatccaataagctgatcgtctaagtaaatgtccgcagttctacccgggtgcattcccttgcgatcttggtcagcaacgtatttaatctggccttctaacgccatgttttggaggtacttttctacaattcccttggcatcaaagaaggaaacgttttgttgcggttggttccaagtcgttgcttgtaaggatccggtaattgctcctgctaaatgttccacttctcgtggttgagcttgtccttcaactgaataaaagacccgcccttgttcatatagcgccacgtcgtcaacaaagcgcgcgtgattgtaagcaacgtcgtctaacagcccactaactaaattcattcgtaaagcttcgtgatccaaggtcattggccaagctaccttaactggttcagtcgtttgctttaagaagttttgactcttggcaaccgtagttaagccataactcattgcttgagttaaaccaagcccttctaaaatctgccgtgaattccgcatgattttttgcttttcggttaattgacctaccgttggagctccggttggtagcgttacaggcaggttatcataaccgtaaatccgggcgatttcttctagaagatcagcttgtaaatgaatgtcccaacggcgtactggcacggttacttcaaacgtttccgcattttcatcagtggttacgtcaaaaccaagtcgtgcaaaaattgcttcgacttcactaatcgttagagtagttcccaacacccggttaattttagccaacgtaattgctaccttgactggttctttagtggttgcagcgcccacgacttcatccggataggcttggcccttaccaaattcagtaatcaaggcaattgcctcgttcaacgcatccgttacggcgccgtaatcaattccccgttcaaaccgcatcgaagcttcgctgtgcaagttatggaaacgagcggtcttacgaaccttgatcggatcaaaaatagctgcttctagcacaacccgactggtagtaggttccacttccgaagtcaagccgcccattacccctgctaaggcaattggctggccatctgcagttactactaaatcttcgtcacggagctgtcgttcttcgccatcaagggtggtaaatgaggtgtccgcttcagctttagcaacgcccaccgtcttgccttgcaattggtcgaggtcgtatgcatgcaatggttgaccatatttcaacattacgtagttagtaacgtccactacgttattgattggtcgaataccgaccttcattaaaagggtttggagccaaaatgggctgtcagttacctttacttggtcaataccacgcattttatataccggagcaagttgatcatcagcaatctcaactttaatttggtcacttagttttgcatccgtggcgctagttacttcgggaaccgcctcaaactgagccgtttggtctaaaatggccgcgatttcatgcgcgtttccgttcatactgaacatgtccccccggttaggagttacagaagtatcgatgacgtcatcattcatccctaaaacttccatgacagaatcaccaggatgaacgttactatcagctgggaaaacgtaaatgccatctacgtacttcttaggaaccacgctatccggaaaaccaatttcttgcaatgcgcaaatcattccgtttgaagggacaccccgcattttactgcgtttgattttaacgttgtctttaattcgtgaaccgtgtaacgccacgatgacgtcttgatccgcagcaatgttaggcgcaccacaaacaatttggattggttcttcttcaccaacgtcaacttggcaaatatgtaagtggtctgaatctgggtgatcaaccacttccaaagtgtggcccaccacaattttctttaatttataatctaaccgcgtaaccgaatcgacttccacggcagtccgctcaattttttcagctaaatcttgcggttcgatgttgcttaaatccaaatacttggataaccattgatatgaaagtttcattgttaactaacctcgcttgtcaaactgggataaaaatcttacgtcgtttaaatagaagttccgaatgtcgtcaactccataacgcaacattgcaaatcggtcgggtcctaatccaaaggcaaacccaccgtattcttcaggatcgacgccggccatcttaagcacgttaggatgaaccattccggcaccgagcacttcaatccaaccggtatttttgcaaactgaacaacccttgcccatgcagttaaagcacgttacgtctgcttctaccgatggttcggtgaatgggaagtaactaggacgcaggcgaacttcaaaacgatcgccaaatagttcctttgccatcgtaatcaatgtccccttcaaatcacccatggtaatgtttttatcaattaccaatccttcgatttggtggaattgatgcgaatgagttgcatcgtccgtatcccgccggtaaaccacgcctggagaaatcatttttagcggtcccttactaaagtcatgcttttccattgtccgggcttgtactggagaagtttgcgaacgcattaagacttcgtcagtaaggtaaaaagtatcctgcatatcgcgtgccggatggtccttaggtaaatttaacatctcaaagttgtagcgatccaattccacttcgggaccttccacaatctggtaacccatacctaagaagaggtcttccaagttatcaatgatttgttggataacgtgcggttggccctggcgaacgggtgagcctggcaaagttacgtcaagtgtttcgctaactaattgccggtcgagggccgcttgttctaactccgcctttcgagcttcaatttgttcctttaagttatcgcgaatttggttagcgtattggcccactttaggccgttcttccttacttaaatcgcgcatcccccgtaagatttccgtcaacggtcccttttttcctaataagttaacccggattttatttaactttgataactcatccgtgaccttaatttcttgtaggcccttttcttctagttcttttaacttgtcctgtaaacccataatctttccacctttctgcaaagaaaaaacgccccctaaaaaagggacgttttaaacgcggtaccacccttgtttgcaattacttgcacacttggttagccccataagggtggccgacccgcctattctaaaacgaagcgaattcaccgcaactagtatcgaaggttctcagctttcccttcttctctggctactaatctcaaccggctactactcttctagcttgatattgtattcacttagctactttaactaaaatcctcgccgaggtcaatagtcaattagtaccaacaatccgcaaatttatgcgcggcttctaagactggccggagtccttcgccttcttcagttaagcggtactcaattaaggaagaatcctgataggtacatcgttcgaccaatccttcttcttccaaattctttaaccgctcaaccaacacccggtcactgcacttcgttaccgaacgtgataagtcccgaaaacgttgtggaccggcactggtcagcacttctaaaatcaaaccgttccatttctttcctaaaatatcaaataggtgttcaaactttggacaaagttcaaaatcagttggtgttttttggtgtacattttgcatatcaaaaacctctttaactaaatcaacttaatcactttatttttatactctaataatttaagccgcaagtttttccgaacgtggtccgtatattcacttactgcttgggcatcgtctacaagagagacaatgctgctttctgcatacttaggacgagcaattgtagctccccacatatgctttaaaataatgtctttttctttgtcatttaaagtagtaattttttcggcatttcgtaaagcaacccggggatggataaatgcatgggtaccaagcgtaaacttggtcgtccgccaatcatagtaaaacagatcgtgcaataatcccgcccgcgctgtggagcgaacgtctaaatggaatttttttgccaataaataactttcataggatacccggatacaatgatccaaccgggttccgttatgatgctgcgtatagtttttcaatcgttgtacttcgtctgtttcaagtaaatcgccgactaaatctaaatattgtgcatcattttcccaatccaataccttcatctaaagctccttttggctagttagttactctaatattaactgcaaactttttttaatcaagccatttacgcaaattaaccgaaaatgtaaccaaaccttaactaactaaaccaaacattaaaactcccgccgctacggccacgttcaaggactcagcattccccttgatgggaatgtaaaggttgcaatcggtagccttaactaattcagggctcatcccgttcccctcgttacccatgattaaggaaaaatcttttggagcatcgatgtctcggtaactttgggcatgctcgtctaaaatagaaccgtaaacggcttgatgagcttgatggcaagcctcaatccacttttgtaggttaagccgctttaattgtaaatggtactggctgccttgcatagcccgtagaatcttcggattgtaaaagtcagcggttccgctcccaaaaatcacgccagtaaatccggccgcgtcagcagttcgcaccattgtcccaatgtttccaggatcttggacgttatccaacaacagccattgccccgtcgtgtcactaggcatttcgtaaaccgcatcgtccacgtaaccaattaaaaagattccctgctcgtgtaccgtatcggcaatgtgcttagacacttctttagtaaccacaattaacttatcttcgtcaacgttagcttctaagcttgctaggtcaaatccctcctccacaattaaatacttgtactgacgttcttcaacgagcgccgtttctaccggatgacgcccttctaaaaagaaacggcggtacttcttgcgaccattattagtctttagctttacccattcctttaccttggaattttttacagaagaaatcttttctaacattatctaatctccttaccaattgtaagtataacacacttacgccatttttatattatcattaagcttggcaaattgatatacgtgctaataactagcttagctagttgaaaatgataaaattatagttgtaagttaacgacgaaagggatgaacgttatgcaagcagttcacatgcacgtggtcggccgcgttcagggagtcggttttcgttttatgaccaaacaccttgcggatcaaatgaaaattaccggttgggtcaaaaatagcctcgacggttcggtagaaattgaggctcaaggaccaaatgagatcttaaagcaatttattcaaggggttaaagcatctccttctccttctgggcgggtggataaattagtggtcaaggaaattccgtcgtttcaggctcgcgagtttttagttaaatactaaagtacgttgaaaaagcgggcaaaatcaagtatagttacccttgtgtatttctagtatttataagtaagaagggaaccatacgcagattatgaaaaaaataaaacgaatctcgacaattagtttaattgccgggctaggattggtcttaagcggttgtgttcaacgcgacagccatggccacccttatggctttatctatgacaatttagcagttccaatgcaacacttcatggactacctctcccatttagttggcgggagttatggtttggcaatcattttaatcacctttgtagttcggttgattttattaccactgatggttaaccagtcccgtaaggcaaccgttcaacaagaaaagatgtcttacatccaacctcagctaaaagtactccaagagcgtaatcaaactgctaaaacgccggaagaaaaggctgcggtcagccaagaaatgatggctttataccgggataacaacattagcatgactggcgggatcggttgcttgccactgttaattcaattcccagtatttgctgctttatacgccgcaattcaatattctcctgaattgcaccagggaattttcttaggaattgacctttccaaatcaagtttgttattgtccataatttcattcttggtttacctcctgcaaggctggcttggaacacttggggttcctgaagaacaacgcaagacgatgcggtcaatgatggtcattagtccgttaatgattttgttcttcaccttctctacgcccgctgggttaggactttactttgcggttggtggagtattcgcatgtatccaaacattactaatcaacttctaccgtccgcggatccgggctcaaattcatgaagaaatgaaaaagaaccctccaaagattattaaaccagctggtccagtagatttggacgatgcagacgctttggacgcaactaagccaaccgaaactgcaaccacaaagactactactaattcaaccaaaaagaacgttaatcaccagcggaatgctggaaaacaacggcatcatcactaatgggatgtttaaaagaagtcaggtagttcgcaagcattaattgaaaagggaccgttatgccgattcgggcataacggtccttttttggttaaacggaacaaactgactttggctctattaaagccaaactaaccaaatagcttttaagaatccccttaacccccttttttgctagcaatcatccgtcacgcaatgggaattactacgggctgattggccagcaacggaattcgtttgccttggctaattaccgttcccccattacgatcgcacgtgatggtcagttgaccacggcttactttaaaatggacgaggccgtctttaattggcaactggccgtgtaatttttgaaaataagctaggtgaggctggatttcaaatgttgcgtaacccgcttgggtggggcgtaatccgaagaaatagcgtcccagtagataaactggacttgctccccaagcatgacaaagactttttccgaaggggtcgccatacattgcatactgggcatcccccgatacctgcggatcatactcttcccaaacggtggtggcccccttttcaaccattgctccccagtattctttaatggtttgatacacttggtcatattgtcctagcttacacaaagcgtcttgttcaaaaaatttaaagtacggggtggtcaatgccgtaacccgatcgtttaggaggacgcggtccaaaattaactgctgctgtctgcgatcagccaccgcaaaaaggaccgctaaaatattagcatggcgggttacatgtctccgtttagattcataactatcaataaacgccccgcttgcttcatcccaaaaatacttccagacattttgttttagttggtcaaagcgttgctgataatgctgagtatccgcattttttcccaagactttcttagttaccgccattgcttttaacgcttgcaataaaaacatctgttcagcagcaactggcccttctttatcaattggcgaccaatccacaaagatccagtcttgtgatcgaccaataatgaagcctagggaattggtttgtgctagtaagtaatccatcatcttctccatccggggcataatcatttgcaaaaaatcacgatctccagacatttcgtaatggttgtaaatgctaataatccacaacagcgaataatcaacgatggtattaatgtgttggtgaacctcgtcatggccacgtaacgctaaaatggttcgtcggtcaacctcttcgttaaaaaatgaatattggttaataaagttatcttggtaagcatctccgccccagatccagcggtcccgtttaatgccatcgataaagaaaagatcgctgcatagtttgaaagtgcgtaacgaaacttgccaaatttggttaagcaaagggtcgtccgatttaaaaatgccgtgattttgcattggtaagtcgatttgagtcgctacagcttctagttgtccatcgggatagtctggaataaataggtaacggaacgcccgtttagtcagttcttcattttcccttacatcgcgttgctgataataacagttaacggtatctaaagcttcggctactgactctccatagcaaacttggatcgggtggcttaatttagtaaaacgaacggtggcattaatttccctaccaaaatcaattaactttccgccagctcgctcaacaatttgctttggaaaagtttctcgacatcgatatgggatttgattaggatcatccgtgttgctagtaaacattgcactccacccgactggacgttcttgaatataattacttgcaacccaactagcatcggaataaatttccgctcccgcaacgtatacacagggtaagtctttagcactaaatacgtagataacaatttgctgttcccctgcggttaaattaattggttcgtttaacgaatacttctgttcattgaccgttacgtatcccggttgatggctacacaccataaaactagttgcgtttttaagctggtaagtttttaaaaactttacgttccggtaacaatcctctaagtaccagtatgccggccattgcatcccccgttcttcacgagaaaagttctgtagcattccttggtgaattgcaaaatctccaggataccaaatccaataagtttgattcattttatctcccttctaacgcgttttccggcgccgtagcatttgaacaatcccaattgcgaaggcacctgaaattaacgcacaagcaaaaattatccataaaaaattttgtactgaccacgccattaacgtcggtgtaaaaagcgaaaaaattgccgtgcatagccgcacgaatccatatgaaaagccggtaatggaagcgcgaacttctaccggatagaacgtctgggtccaaattttataaattggttcgccacacaaagtgtttgtagcggaataacaaacgtacgcaattgcaaaggcccaccaaacgtcgctccaaactcccgcacagaaaaaagataccgccccaattaaaatagctccttccattactggataccggtacttggtgtccgcaaccttcacgtaaatggaattcgatgccagattaaatacgttagcaattaaggcaaccaaggttgcaaatgcttgggtgcggtgcgaaaccgtcaccaaaaaataatttacgaaagaaccccacgtattagcaggcaggttccaaaataaataaaacatcgttaacgccactagaatctttaagtaagccggattctttaaaatttcgcctagtttaacccgtggctgaccattctgcgaattaaaagtcgctttttggtcgtccaccaacgaatcttccactcttttaaattttggagaaaagacccgaactgaccaattaaccagggcaactaaagcaattacgctaaagattacccgcaccgaaccgaccgtcattgccgaagttaaaaatcctaaaaattgcgataacaaaatgccaaccgtccaaaagatttgggtaatcgtaattgctcggccatacattgcgtcagaagttcgttctgaaattacggctaacgaggtgggcaagtccgcccccgaagctattcccgcaacgattgttcccgttagcaaaattggtaaattaggggcgaatgcaataatgattgcccccaccgccacgaataaaatatctaaattaaacacacggactcgaccaaaccgatcggctagccatccaccaactacggcacccagcgctaccatcaaagttaacaaggtcgaaattaacccggataacaacgggcttaagtgcataattcgagtccaaattggtaaagctactcccaaactaactagcaaactagagtccaaataagacgccgttcccgcaactaaaaccaacgaaaacgttttacgatccatttttggggttacttgttcacccatcctcttcaactcctcaatcaaatctaacccgtttttttaaaagacttagaaacgtttctatggtttatatactgcggccgtttgataacgcttacaatatcgttggcacagctattcgattgcaaaactccaggtctattttgcggtttagttacccgcaaggttcccttagttggttcattaaagccaaaaattgcaacaaaaaagcacccttccaggattttagtaaaatcctggaaaagtgcttagttcgtcatttttaataattttggtcgtagcccgggttttgtagaattggcaattcaattttaaatactgaacccgatcccaccgaactttctaacgaaatcgttccgtggtattcctcaatcagttttttagcaatggacagtcctaggccgttgccgccttgatcccggcttcgagccttatcgatccggtaaaaccggttaaagacgagctttaaatccttttcggagatcccctcgccaaagtcttgcaccgcaatttcaacaaattgcttagtgttggcaatcgacaagtgaatttccttacgttctcgagagtattttacggcattatctagtaaaatcaccagtatttgttctaagtgattacggtaaatttgcacaatcggctccccgatcaactcattgtccatcgtaaactgaaactccggatggatcatcttaaagtcgttaaaaacttggttgacgagccgagccacgttggtcttttcatttgggtaattaatttcgatttggtctgcgcgcgttaagtccagcatttcactgaccaaactcttcatgcgctgagtttcttccaatgaagactcaatcgattcttccagtacctgcggatcgtctttcccccatcgtttaagcatctttaagtggccttccaccacggcaacgggggtccgcaattcgtgagaaacatcctcaacaaactgtcgctgttggtcaatatagcgttgcatccgatcaatcatgctattaaattgttggcttaagtcctccaattcatcgttagtgttcaaaaccggtacccgagattccgtttgcggatccttttctaattcccgcatcgtgacgttaatggagcgcattggccggagcaggtaagacgctaaaccatacccgaaaatcgaaataatcataaagaccagcagcgaggtcaacccaaacaaccaaattaagcggtggtaattgcgtccgtagtccctaagcaggttgacaacttccacatagccaattttttgcttatttcggttaatgatgggagcctgccccacgataattttttgcccgtggtacttttggtgcttaaccacccggtggctgacttttttcatttgcaacggatttcgctggttagaaaaaacggttttcccatttaaatcataaacggtcactgccaaatccttacgcgtcaaattagctagcaaattatcgtcaaaaacccggtgttggtgctccgtagacttttcgttaaaattaggccgaaaaatattggtagtttgataattgataacctgagcactgcggagccggtcgttaacctgactaattgtattttcaacgttatgccgttctacggagtaaagtgagccggttaaaattttaaacaagaaaaacgaaaacaggccaaaaattaccaaaactccgacaccggtgccgatcgcccatttccattttagggaaacccgttgattacgaattgcttgcttcaacatcttaggtcctcatcacgtagccggtgccccgaaccgtttggatgtagctaggctgccctgccacgtcaattttattccgtaaataccggatgtaaacgtccactacattggtttccacgccatcttccaaaccccaaaccttactcaacaaagtttcccgggattgaaccacgtttacgttctccattaaaagtagcaagagctcatattcacgtttggttaaattgattacctcgttatttcgcttaacgacccgattttccttttcaataacgatgtctttaaattctactgtcgtttggtggaaagaagtatcctgttcttcgaggtcaacccgccgaagaaccgcacgcaaacgagctaacaattcttcgatggcaaatggtttaacgatgtaatcatcggcaccgtggtctaatccggacacccgatcaataattgaatcgcgtgccgtcatcataataattggggtaatcttttcccggcgaatccggcgacaaacttcaatcccgttaatttcaggcaacattaagtccaataaaatcgcgtcaaagtcttctgaaagggcggcttctaaaccggtccgaccatttccttggacttcggtttcgtatccttcatgttgtagttctagctctacaaagcgagccaaactcttttcatcttcaattatcaaaattttactcattttttccgctccaaaattaaattattttaatctctatacttctaaattttaacattgtcaactggctttgcctagcagttctctaagttgctgacaagcgtttttgttggaggtatgcatttttctttctggccgtcgcaatagcgaatacgcctattcaaaaccgacccaaaaattaagcagcgactaaaaacatttgtgtgataattttaatgaagtcacaacgtgtgccctaagttagtttttcccacttaaccaaaaatcgacccttatgcccaattgaggcataacgatcgatttccagttactgctcgcaaattccccaactttttactcccaatcttcaaggatatttaagtcaaggctcgcgaacagttctttttaattatctaagtctattgttcttcataccatgagtaatggaaaatgccgtcacggtcaacccgttcgtaggtatgtgcaccgaagtagtcccgttgtgcttgtaataagtttgcgggaagtacttctgagcgataagagtcgtagtaagcaaccgcagctgaaaatgcgggaaccgggatacctgctttaacagcaagggcaactacttcgcgaactgcatcttggtacttctttgcaatttcttggaaataatcatccatcaataagttgcttagttccggattcttgtcaaatgcatcggtgatgttttgcaagaattgggcacggataatgcaaccagcacgccaaatcttagcaatctcaccaaagttaaggttccagtcgtagtgcttagaagctacccgcatttgttcaaatccttgtgcgtagctcataatcttactgaagtaaagcgcttggcgaatcttttcaacgatttcctgcttgtccacatcgagttttggattaggaccagtcaattctttgcttgcagcaatccgttcgtcttttagaaccgagatgtaacgcgcataaactgattccgtaatcaatgattgtggaacccctaattcaagggcgttttgggaactccacttaccagttcccttgttaccacccttgtccatgatcatgtcaacaattggtttgtcgctgccaagatcgtctttccgggttaagatgtctgcagtaatgtcaattaggtaactatccaattcacccttattccattctgcaaagatgtcagcaatttcttcaacggaaagaccaaccattttacgcattaaatcgtaactttcgtcgattaactgttcgtcaccgtattcaattccgttgtggaccatctttacgtaatgaccagccccattaggcccaatgtacgttacgcaaggttcaccatctttagcttttgcagcaatttgttcaaaaattggtgcaacaaggtcgtaagcttccttttgaccacctggcatcattgaaggaccttgtaacgcccctaattcaccaccagaaactccggtaccgataaagttgattccagattcatcaagttgcttgttacggcgcattgtgtcttcaaagtaagtgttgccaccgtcgattaacacgtcacccttatccaaaagcggcaagagttcagcaatcactgcgtcagttggcttaccagccttaaccatcatcataatccgacgaggtttttcaagcgaattaacaaaatcttcaatcgtgtaagaaggaactaacttcttatcactatgatcttccattacttgttttgttttagcagccgtccggttgtagatggcaaccgtgtatccgcggctttcaatgttcaacgcgagattttttcccattacggccattccaatgaccccaatttgtggtttatccatgttgctattcctcctctttgacaacgactctgtcgaattaatactaccaaaaaaatcactttgattaaagaagtttaaaacaaaaaagcaacaaaaggacctaggctccttttgttgctttttaatcattagttagctttcacgtcaataacttgtttgccgttgtagtaaccacaacttgggcaaacacgatgtgaaactcgtaattcaccacagtttgggcatggtgccaaacctggagtagttaacttaatgtgtccacgacgattacgcttacgtgtctttgatgttcttcttgctggaacagccatcaatgagcacctcctttaagagaattacggtctcccgcttattttaaagccttactgatcagaattatctttcaataaatcttttaactttgcaaggcgtggatcaacttgtttatcttgctccgactccgcggctacttccgaaaccacttgccattctgcaccagatggcatagtgcccttctgttcttcatcaggggttaaaacctgcatgggaacttgtaaaactacgttgtcttcaaccaacttatcgacatcgattacgtcatccttgactaacatgaccacttcttcttgtgggaacgtgtcaatcaaactagcactatccacgtaaatttcattgacaaaaaagtcaagctttaagtgaacaggtgttaaggaacgcgacgacggaaccgttaaatcacaactgatctcagcatcaatcataactgaatcccggtcgtttgtcacggtgcctttaaaattgattggtgagcattttaaaactacatctggaaagcgttcgattaaagattgttccaaatccattgtctcatcgaactgaaacggttctttatgcttacgcaattctgtaaaataccattccatagtgaacctccaatgcaacagaaataattataccatctaggatttctttgtcaacgttttttccttgacattcttttctaaaatcggcgtccttccccattcataaggcgccaccatttgatatagctcatccgcgcgcttagttagctgataactggcagtaaaatctgcttttgttaccttagtcatcagaacttcacgaaaatcgtgttcccgcaaataggtttgcccctgagcattaaccgccagcagacgagtcttttgcaacggactcagtgctcgcaggtttaataaaatagcggttaatttgcgttgtaagctagtatagctataccgcttggtttttaaatttgtcattaattccataaaggaactactttgtgccgcttgggcaaggatccgattttcaatgccttcgttaattccacggatttggcgtaattctttagcagaagttgtttttaaccggtactctaagaagggccaaaatgtttgccaatcaaccggcttttgccgttctaacaccttttccattcggtcaggtaccgcttgttgatactgatcatcattccgttgaattgactgacgaatggctgtcgcgctggcaatcgtgcccttgatttcttggtctaggtgccccgcttgcaaccgttccacaggcaataaagttaatttaggtgctagccgcaactgccaataagcatagttaacccctaaaatatcgttagaccggcttaacgaactttccgcaaacagctgactggcgaaactttgattataatcttgctcgctaaaagtccggtcaagtaaccgactttgtgcttgaaaatctaatccaggggtctcacacccaaatgctaacgcatccgctcgaagccactgggcaatctgaactcccgcttgggcaaaatctcgcgcggctgccacagcgtactcagtgggcatttccactactaaatcggcaccactttgcaaggccacggctgcccgttcccacttgtttattaaggccggctctccccgttgcacgaaattaccgctcattatcacgatcatcacgtcggcttgggaagttttccgagccgttttcagcaagtactggtgtccattgtgaaacggattaaactccgcaattaccgcacaagcccgcattctactacctcctgcagctaaaaaaccagcgcgtagtctgttcatctaccggcgcgttaccaaaatctgcaaagtacttcaccgcagaaaagcccgctttctgtaataaaccaacgtacgtatctaactcgtaggttcgttcaaaatgggtctcttccgtccggtaaaacgcgtctgacgttggatcttgcttagtaaagaaggttagatcatgttcaacatggtattgatcttcacccgcatagctagtccaaagaaaagcctgctggtcgtcttgataattaaacatgtatcccggatatacttctcccgtttggtaaggagtaatcacgtcaaaaataaattgaccaccctcctttaagtgatcgtgcacctgcgtaaaggccgtcaataactcaatttcgtttgctaaatagcaaaacgaatcggcgtagcaagaaatcacgtcataggtgggtaattctgctaaatcaagcatattcccctggaccagttctaacggaacttttgcagaatacgcgtgttgttccgctaaagccaacatttcacttgataaatcaaaaccggtcaccttttggcgttgttttgccaacttaaccgccaggcgcccggctccacaagctaactctagccattcgtgggtttgattcaaatcaacttgctgtttggtatattcaaaccaattttggtactgttcttcatcaaacaactggtcataaagcaccgcaaagctctggtaaatcattattcagtaatccaatccgcaatttctacgtttttagcttctgaccataacttttccaagttataaaacttccgttggtcagtttggaaaacgttaattacgatgtcacctaagtcaatgaggatccattcggccgcccggtaaccttcaattcgacgaatttctacgtcgttttcttttgctttttcaataattgcgtctgcaatcgctgctacttgtcgatttgagtccgcgctagtaatcacgaaatagtccgccaaggtgctgatttcgtgtacatctaaggcaataattccctcagcacgtttactatcggctgcttttactactaattctaagctttgtttgttatccactttcattctccttagtcgttaagttttgcaatccacgcgttgtaactgtcaatggtggcggggaataccgggcgattgttggctactaaataagccagcgtattcttcatctgaagcgcaacgccctttggtaaactttgttccgtaatgatgcgcgcttgttgcaccccgtcaaaatcccggccgtcttcaatataatcggccataaagacaatttggtcaattaaagtcatgtatggtgctccaaccgtgtgtcgccgaattgcatttaagatttcttcatcttgaatttttaattcgtttttgacaatttctgctccgacaactccgtgccaaatcgcgttaccataatctaacaaaatcgggtccagttgtaatttattaatgtaaccaataaattcactatcaggccgatttttagcgtaatcgtgcaataaagccgcaatactagctttttccacgtcagcgtcattttgttttgctaactcaatggccttttgttctacgcgtaagatgtggtcaaatcggggaccttgaacgcttttttgtaccgccgcaaccaattcttctcggttcatcggaatataattattttcgtaagtcaactctactttactcatataaatgatgctcccttatataatcttctacagcatcgggtactaaatatttaattgagcaccctttattaaccttttccctaatcatggttgaactcaaatcaaaatggggagtgtccacccaaataatcggatacttcgcatctcgctcgtactctggccggtcgacccccacaaaatgaaccatgcgggctaatttatcgatttcgtgccaagttggcaagtagttgaccatgtcaccaccgataataaagtagtagtcgttttcggggtgcatttcttttaacgccttgaccgtatcgtaagaataactggtccccccgcgattaatttcgattaaatctaaatcaaagttagggttcccctgaattgccaagcgaaccatttcaacccggtgctccgcagcaatcgcttcttttttatccacgtgaggtggcagataatctgggataaacagaattttatccaatcctaattggctagccacctgttctgcaatcattaaatgcgcgaggtgcggcggattaaacgttccgcctaaaatgccaattttcttgccctttgcttgtgttagtggttcttcaaccacctctacttgaactcccgaaacactttttgactttgtcgaaatcaatattaatcaccttaccattatatcttttgaacgttttctgaaatctctcttttatctgggtctgcagaaactttaaacaaaaccaaaacgtgaccgatcgtttggacgacttggatgtcggtttgctgttcaataaactccttaacctcggcagtcgttacgtcggtattttgctgtaaattaatctttaataattcgtggttatctagcgcgccgcctaattgagcaagccaactcttggtcagtccgtttttaccaaccgaaaaaacgggtcggagatggtgtgcttgagcacgtaaataacgtttttgttttcctcttaatttcaaatcaatactccctttatttagttacttaccagcgatggtacttcgtttttagattagagcccgccggattactactgaaataccctttggtgcccaagcggtaaccacgcttcccgcgggaactgcaatccagcctaaaccttcaaagaccacgtcactatcttcctcaatcttaaaatggtggcgtgctaatttaggcaaattggccagattttctgccgcaggtggtgtcaaaagttctccagcgtgttttttataaaaatgatcggcattagctagcttagtgcgatgaatcattagattgttatcaaaataggcagtgaccgagcccgttgaatgttcgtagtcaaagcgcgccaaagcacccgcaaataaagtttgctcatcacctaattggtaaacgcgcggtttaatcgtctttttcggcgaaatgtacttaagatcttccgccgttaacacgtgtgccatctgatcgttatgcacaattcccggtgtatcaatcattttgctgtgatcgtcaaatggaatttcaatccgatctaacgtagttccaggaaaacgggacgtcgtgattacgtctttgatcccgttgcgtaaggcaatcaaactgttaattaaggttgatttaccaacgttggtaacccctacgacgtaaacatcacgtccatcgcggagttgttcaatcttatcaaacaattgttctaccgcaggacgttgtttagcactggtaatcatcacgtctaccggttcaattccgttagcctttgcttgttgccgtagccattcccgcatccggtgccgtttgatcgatttagggaaaacatccgccttattaccaactaaaagaaccggattgtcccctacaaaacggtgcagtccgggaattaagctaccattaaagtcaaacatgtccaccacgtaaaccactagcgaatctgagtcactaatctgactcaatagctttctaaagtcgtcatcactaatgctaactggtgcaatctcattataatgacgcaaccggaagcaacgttgacaatataattgtccgctttctagacctttttttaaggccgacgccggcgtgtaccccggaagctgagcatcttccgtttgtaacgttgccccgcacccaatacaccgaatttcttcttcattcattcttataataactccttatgccaaactaattccggatactttttcttcaaagaccgcttaatgaatagctctaaaaaacggttcaacttggtattccaagcatccgtttcaattaagggcttcactagcactccccgtactccggataaattggccgctaccatgtcagtaaggagttgatctcccaccatgatggtctcggccttttttagacgatattgtcgtaaaactcgtttaatacctaccgttaacggttttaaggctcgggcatcaaactctaaccccaagccagctaccgccttggaaacccgactgtggctattgtttgaaactacaattacccgaataccttcccgtttcaattcactaatccaccgctttaattctggcgtaccatccggattgttccaggcaattaaagtgttatctaggtcggttaacacggtggtgattcccttggcctttaaatctttagcggatagattgtaaattctttcaatcatccacgttggtttaaaaatgttcataatctttctccccatgattactgtctgttcaattataaacgataggaatgctttttgaaaagagaagccaaccttaattctacttcaattctacttccattccggacttttcgttaaattaagacggtaagcggtgattacttggccaacttaatgtgttggcacattttcatccaaattgactcacttcaaaataaaaaggaccgcgctcaccatggagcggacgatcctttttagtagtcacttaattaagtatctaattaaagagcttttttagcttcttcagccaaagccttaaatgcgtcagcatcgtttacggcaaggtcagcaagcatcttacggttcatgtcgataccagcttccttaagaccgtgcattaacttgctgtagctcaaaccgttcattcttgcagcagcgttgatccgtgcaatccaaagacgacggaattcgcccttacggttgcgacggtcacggaatgcgtacaaaccagacttcattacttggtctttagcaaccttaaattgaatatgttttgctccgcgatatcctttagcaagttttaatacgcgcttacgacggcgacgtgttactgttccaccctttactcgtggcataataattcctccttaaatcacccgcaggtcatttacttttctgtttaatttaattacttgatgtttgaaagtaacttcttataacgctttacgttagtactgtccatcatgtctgtaccacgtaattgacgacgttgcttcttagtctttccatggaaacggtgacttgtaaaagcatttgcactctttagaccgccattagcagttttcttaaaacgctttgcagcagcgcggtttgtcttcattttaggcataatctgttcctccagaaatttaaattatttatcagcattaggagccaataccaagaacatgctccgaccgtccatctttgggcgagcttcgatccgagcgatgtcagaagtctcctcagccatccgttcaagcactttacgaccaatgtctttatgggtaattgcccgacccttaaaacgaattgatacccgaactttatctcctttgcctaagaacttcttagcgttcttaagtttagtgttaaagtcgtttgtatcaattgtcggactcaaacggatttctttaatgctgacagtcttttgctttttacgagcttcacgttttttcttttgttgctcgaaacgatatttcccataatccataatcttggctactggtggttttgcctttggggaaactacgacaacgtcaagattggcttcttcagcaatttggattgcttctgcctttgacttaacccctaattgatcaccattaacaccaatcaagcggacttcacgagcccgaatggtttcatttaccattgtatcttttgctatggttcttcacctccaggaaaattatcgagaatgcagaaaagcggatggcacacgccacccgcttttttggatcttcaacatccattcaacgttctttagcccagcaacttctaagttacaaggcgagaagcggtggcctctgctttttctcaacgtttactaagataccaaaataatcagtctctgtcaactaaactaaaaaattatttttacataaagaggtttacgtagattggaactagaatgtccatcgctagtgaaacgattacaaccgctacggatgccattgcaccttcaattgaacctaattgaaccgctttggctgaaccaacggtgtgtccggaaactcccagtcctaatccagttcccactttagagatatttttgagcttaaagattttaattaagaattcggccaacgcgtagataattacggcgttgataatgcagaccatcgccgtaattgccggatcccctccgatcccctttgcaatcggcatggcaattgcggtagttgctgattgaggcagcattgccgcaatcgaaactcgggatagtcccattagcttggagaccatgtgaataccaaatagggaaataaaaccaccgacgaacaaggttaggaatacatctacccagtacttcttaaaaatatcgttccgccgatatagcggaatcgcaaacgccacggtagccgggtttaaaaaccaaaaaatcatgttgccgcctggtaaatagtactttttataaactgcgacagttgtggaaccaattccctttccccaaagaactaagattacaattcctaaaaccattccaactaataacggggtaaataggaagaagcctttgctaactttaaaaagccacattccaattagataaactactaaagaaataaaaattccggtaaacggtgttgctaaagctgcatccattattcatcatccccctttttacccgtaattttttggtgaattcgaatgaaaaatgctcctacgtatgcaattacgaccaggagaataattgtcgaaatgaccaccacgataatatcctggagcccttcccttttcattaaatccaaactaccggctaattgaattcccgatggaacgaataagaaagcaattaagccaatcataaagtcaccaaatttttcaacttgttcgagtttaacaatgtgggtcgccaataaaatatataaaataatcataccaattaacggagtgggaaccacaatgtttgcgggaaatagctgagaaatgatttgcgaaacgaataaaatcgccgcaaaaatcgccatttgaacaaggattggcgtcttctttttctcttgatcttttttcatcagaattcctccttaaaacacttgattcaagggcttttcttcccttgctcaccattaattctaagtgatttcgatcaatttgtaaccgttttcacaatcaattgaccctaattctggatagaataccaactacccgagatgaaatgcccttaataatttcaacataaaaagtgaccacttctctaagcaatttaacctagagttgtgatcactttttaaaaattaaaataactaaaactttatggaataactttaatttccatcaactaagtcacccgaattattactcacttcatccctaagtggcgtttggtttcgttaacgtacgaacggctcaccggaatcttaattccattcgataacgtcaattggtaggtatggttgaaacttggttgtaattcaaaaactgaatcaaggttaaccacgtaactacgatgtacttgcaaaaacttttgcggatccaattctgccaatagttttcggaggggctgcttgctggtaactaatggtaaattggccacgtgaataattaccgtacccctctgcgcttctaaataaataatgttatttttcttaatcacgatcgttcgttcttcattagtaattgacagtcgcggattaagatatttttgctggtaattggcggaatcgcgttgctgccgatccaataattttttgatccggtcaagcgcttcattaatgcgactttgctcaaatggtttgagtacgtagtccactgcctcagcactaaacgcatctaaagcatattggtcgtaagcagtggcaaagatcacgtatggtgaaaccggcattttcttccattttttcgccaaagccattccattaccatcttcaagcttaatatccaaaaataccaaatcgggatgttcatttgctacatactggtcggcctccaccactccatcagcttccgcaacctggtcaacgatggggttttcctccaataagtaatttaattcttggcgagctaatggctcatcgtcaacaatcaatactttcatcacttttgcttcccttcttgaaatggtattttcacggtgattgtcgttccttcagagcttgattgaatatctaaatttgctgcctcaccgtaaagtcccgcaaaccgggcggttaaattttgtaaagccgttccactaccactttgagaatcaaccacctggtgtcctaactgttttaagatatgagggtcaattccgtgcccgttatctgcaaccacgatttttaacgcgttggcaacttgactaacccccaccttaatctgttgatccttcattttgggattaaaggcgtggcgaaccgcattttccactaaaatttggattgtaaacggtgggactagggcattttcggacaccgcgttgctaaacagcacctggtaccttcctggaaaacgagcctgttccaaagataaatatgctcttacgtgtttaaattcttgtgataatggaattaccacctcccggctccccatcaagttagcccggaaataggtacttaattgaatcaacaactcccgtgccttttcactgtcttggcgcatcaccgcgacaatggtattgattgcgttaaagaaaaagtgcgggttcacttgggcatgcaacgatttaatttctgcgtccttaactagctcagtctgcctttccatatcacccagcataatctgcatggccaagatttctccgagccccatccctagttgaatttccaccgggcttaatcgccactgttctttatagtaaacttttaaactgccaataatctgttctttaataaacaacgggaccacaattgccgaatggagcgggcatttgggctctgaacaattaatttcgtgaaaattattggcgatttgtacctctccggattgaatcgccttcaaagacagatcggttcgaatcggctgcccggcaatgtgatggtcgctccccgctccgacgaaggcgaggattttttgcttatccgtaattccgattgcatcaaaattagtgtacttaagcattaaattggcaacttcttgggccgatttgtaattaagtccctggcgaaatgccggtaacgtttttaatgctaactggagcactgaacgagtttgggttgcttgcacatccacttcttgtcgaaaatataatgcaacgattgataaaaacaccgaagtccctagtgcgctgaccgtaatcatgggaatcgcgatataccttaccaatcgccaaccagtgggactaaaaattaggataaaagtcatctgaatggtttccatcaataatccaattaaaaaaccgtgccacggcttcatagtcgcaaaccgatgctgcttttgattagaaaaccatcccgataaaattccaatcaaaattgaacttggaatataaaaaagcgcgtcgttagttaaggattcttgtaaaacacgatgaactccagcaactgcgccgacaatcccaccaaccattggtccgccaatgattccagaaacggtaaccgttaaaatacggatgttagccaccgaatagcctgctggaattcgtaataataacggattaaagtggatcgaattatcaggcgaaagctcaatcccaatcaaattagccgtaatcgtaaagaaagcaaagatgattatcaactgaaatttagcggcgccgtcctgtcgaaagagcaattttcgaaacggcggaaaattaacgagaaaaaaggccaaaataataatcaggcccacccgttcaatcattagtaaggttaaatttagcatttgaatccttctttcgtgcttaagaagttcctttccttcaattatacatgaaacgcctttccttgcttagccgtaaatcgatcttttaaagccatttgggcaactaaaaagagctatgtaaacccacctgatttacatagctcccgaaagctaaaagtttttaatttttgcgactgtagctatcaatgtcagctttaatatcttgcataaattgatctactgaaacagtttgtgagttatcttcaccatagcgacgaacactaaccgcgttagaatccatttcgttgtccccaactactaagatgtatggaatcttttgagtttgtgcttcacggatcttgtaacccatcttttcgttgcggtggtcaacttcaacccggatatcttggtcagccatttgttcacacaacttatctgcgtattcaccatgcaagtcatccttaactgggataatcgttacttgttttggtgctaaccaagttgggaaggcacccttgtacatttcaattaggtaagccgtgaagcgttccatagttgaaactaacccacggtgaatcataactgggcggtgttcttcaccatctgctccgacgtaatgtaagtcgaattgttttggcaacatgaagtctaattggattgttgatagagtttcttcgttaccaagtgccgtctttgtttgtacgtcaagctttggaccgtagaaagcagcttcgccttctgcttcaacgtaatctaaaccaaggtcgtccatcgcagctttaagcattgattgtgagtggttccacatctcgtcatcgtcaaagtacttttcagtattttcaggatcacggtaactaagccggaatgtgtaatccgtaatgtcaaagtcgcgataaacttcaaccatcaattgtagaactttcttgaattcttcttgaatttgatcaggcgcaacgaaagtgtgaccatcgttcaacgtcatttcacgtacccgttgcaaaccagaaagggcaccagatttttcgtaacggtgcatcattccaagttcagcaatccgtaatggtaattcacgatacgaacggatgtggtgcttataaacttgaatatgggatgggcagttcattggccgcaattcaagcatttcgccgtcacccatgtccattggtgggaacatatcttcccgatagtgttgccagtgaccagaagtcttgtatgcatcaaggttcattaatactggtgtgtatacgtgttggtaaccatgttggacttccttgtcgatgatgtaacgttcgattgtccgacggatggttgccccgtttggcatccagtatggtaatccagcgcccacttctggatcaacaaagaagaggtcgaggtcgttaccaattacccggtggtcacgttcacgagcttccttttggcgtgctaattcagcatccaagtctttttggttgaagaacgaagtaccgtaaatccgttgtaacattggattacttgacttaccttcccaataagcacccgcaacggatagcaatttgatggctttcaatcccgaagcatctggtaatgcaacacagtcactgacgattaagctgccatcaacgtcgtatacgttaaccttgccgtctttagcgtttttcttaactatcttagcttggtaagggtcgctatcaaccttagctaaagcatcttcaacgcttaacatctcatgactcaaagcaacctttgcttgaatcatatctttcattttatcttcaatagcggggagttcgtcgaccgaaatttgttgaccttccttatcggtgtcagcataaaaaccgtgttcgatgttaccaatttccccaatccggatttccggataaatgctcttgattgcgcttgtcaatactaaagctgctgaattccagtttaccaattgtccatcttcggaatccttggtaatgatctcaacctttccatcttggtcaagtggttggtccaaattaaccaattcatcattaacttttccagcaacggcgttttttgccaaacttgtaccaattgacttcgcaatttcaagtacggtgacaccagcaccaaaaggttttacactgccatctggaaattcaatcttaatctctgccataattacacgctccctttacaaaaaatagtataaaaaaatccctggtattttcataccagggacgtgttagacgttatttcacgcggttccaccctcgttgcagactactagaacgtaatccaccacttaattaaaccgataacggtggcaacccgaactgatatttcgatcagtctctagtcaagtgggaagtttttagttgctttgcttacagtccatggcgcggctccctgaggttaaaaactacatgtttgactctgatttacaacttcattatatccattcaaaattgcttgtcaaccctgtcgatgattttttccgattaaagtaacctcttcacttaaaaatttgatccgttccattaaccgtttggcctttaaaggttcggcctccccgcgttggttgaccgttaagtgttccttttctagttgctccattgaaaagttagaggtgaaaaacgttggtaactcttcttgcatgcgatattctaagattacgcctaaaatatcgtctcgtacccatgcagaaatactatctgcaccaatgtcgtcaatcactaaaattggcgcctgcttgaccgcgtcaagcttgctttgaatttctttagaatccccaatcgtgttttttaattccaccgctaaactaggaaaatgaacgatggttgtcgagtaattatgcttggctaattcattagccattgcacccatcaagtaggtttttcctaccccaaagctaccggttaagtacaagcctcggtggaattggtccggtgcctgatcataagcggccacaaaatccatcgtcttacttaaagcaatattccggtcaggctcttggtagtaatcactaaaatcagcccgccgaatcatctttggcatactaattgacttcaccagcgcttgccgctgagccacctggcgtctcattatcatttctttagtaggcacatactcgatatcaattaggtggttactgagtactaactggggctcgtaacccggcaaaaaggagggctcgtgccgcgcaatcttcctgcgttcgttaacaaattcgtatagtttggccgctccccgctccaaagcttccgtagttaactccgcttggtgtgtttggcaaaaggccacaacttcggaatcctgataaacagttttcatcaccgactggaaacgttggtcgagtttccgtttattcatcaatccctcaattgcttcgcgaatattttccatttgttactcctcctttcgccgttcacgtaattttttcagttttgcattaatttctgcagtagtcggcaccgcttgagaatcattagcattgttagttgcagttttagtatcttttttggcccaatctggtagggtttcgcgctgaacgaccggcttacgtcttccatacgacttggtagcttgtttttgctttttggcctggcgttcacgcacaaattctaacgccttttgcggagtttttacgccatttttaatccactcgttggcgattgcctcaactaaatttttattcagcgtcgcccggccctgatcaaccaagacatagaaaatcaaaaaattaacgacgctaaccggcagttgacccgtttccactatgccggtaattacccgtttttccgccgtggtggtaaagcccccggtttcttgcttaatctgatcaataaagtctaccggagccaatgcatacgttgacttaatcaccgtttgctcctcggccgtgagcccttctaaattgagctttgtaggcgaagttggcatagccgctgaactagccgttttcttcgcaccttgctgattagcattggcgtatttttgagcgatccgagtcttcaaagttcggctatcaatccgattatcttgaaaattagtggccgacttaatcagttccgccatttcactttccgtaattccgtaaatagtttgttccaccataatgaggtggcgattttcttctaggctttgacgatccacaaagctagtgctaagcatttgagtaagtaagttaaagtcaaaattattattgagcgtttctgaatccgtttgtggctcgtccggctgaatttgcttttgcacggcagagattggccttggtttgtcgaccacgctgctgccaatttggaaatagtcgcctaaatttttagagacatcataaaaatcggcgtgctcaacctggcgtttaattaaccgccgacttaaccgttcaaattcattttcaccaaccgcaccaagcaacaatgcgcttagcgtgtcgtctttgaaaaaggtaatcgggtcagctggcgcttgcaaaacgtacaaaaataacgcccgattatcaacttgtttacgaaaagtttttagcaaacccaaggcttctaaccggcctcgcgcttccataatagctggtaaatcaattcccagccaattcagtaatattgtatgggtaaactgttcatttaaaaccgtcgcttcttcatttagttcccaaagcgtcattgctaaactgtacgcatccgaagataataatggacgatacagcgccgttaatgcccgactttcgtagtcggtcatttgtcgatcagtattcacaataaacgagtcgtttggtgctaagttacccattggttccgtcattacttatgatccttttcttcttcatcttttttgaccatatcctggagttcattcaagaaaacgttcatgtccttaaattgccggtatacgctggcaaaccgaatataagcgatctcatctaaatcaacgagaatattcattacgtattctccaatcacttgactagaaacttcgctttcacccaatgaacgaattttattttcaaccttgtccacaatatcagtcatttgttccatttttaccggtcgcttttctgctgcccggacaatccctttaagaatcttatcgcgatcaaattcttcccgcgaaccatttttcttaatcactaataacggggtggcttccacccgttcaaaagttgtaaaacgaaaaccacagtcttcacattcacgacgacgacgaattacgcggccttcatcagttggtcgactatctactactctcgagccattattaccacaatgtgggcatttcatattatttcacctcgccggtctttccggatgtctggagtaaattttgtttaacaagccattctatcacttgtttttgggtggcttcaatactaccactactatcgatggttacatccgcttttttttgtttaatttcaatcggcatctgagcgtcaattcgtttttgagcatcctcacgagtcaaatgatcccgttccatcagtcgtcggagctgttctgctggagttgttgaaaccaccataatgcaatcgactaaagtctcgtatccttgttcgaacaaaactggtgcatctaaaacgaccacggactccgtcgtaaaactttttaactggcggatgatctcttggcgaattacgggttggacaatttgatttaactcccctagtttttttgactccccaaaaactattttacctaattgcttacgatcaacttgtttttgttcatttaaaattggggtcccaaatgccttaactaattgtaccttaaccgctttaaattccaaaactgcgtgggcaatttcatcagcgtccacaattggaattcctttatctctcaaaaaattactaatggtggactttcccatcgcaattccacctgtcagtccaaggatcttagtcattttctggcgttaaaacttggcaatgcgggcaaaaatgagtactgcgctgagctaccttaatttgttcgatgggagtttggcagcgtggacacggtaatccttggcgatggtaaacgtgcagctggttttggaaactgccggcatgcccagtagcatccaaataagaaaacacggtggttccctttgccgcaatggcttcgtttaattcggcaaaaatactttcccgtaataatttaatttcggcatcggtaagtgaattagaccggcgctgcggatgaattttacttagccataaaacttcatctgcgtaaatattgcccaatcccgcaattaacgactggtctagaagaaagcttttcatcacccgtttacgacttcgaagagccttcgtaaggtagtctaacgtcagcgtttctggcgttggttcgggtccgatcgtcttcaatcccccgacttgcatttcttgccccgtgggggttaaaaccattcgaccaaattttcgggtatcgttatagcgtaaatcctgtccatcatctaattcaaaaataacgtggtcgtgtttgttgtaaggttggtcgcggtctaccaccgcgtactttccttccatccggaggtgggaaaccattgaaagctgattattgaaatcaaaaatcaagtactttcctcgccggcgaattgtttcaattgttttattttttaattctgccgcgaactggtccgcttcaggggtgaccattttaggatatcgcaccaccacccgttgaattgtacggccctctaccagaccgaccaatccgcgtcgtaccgtttctacttcaggcaactcaggcatttattcattcctccgttatttagcgtcgtaccaattatttccccatgaagtttctacttttaacggaacatccaatttaattgcggaatccatcactttaggaactaattctttaataacgctcatttcctcatcaggcacttcaaaaatcaattcatcgtgcacctgtaacaacattctggttttcaactgccgtttttctaactcgttttgcatgttaatcattgcaattttaataatgtcggccgcactaccttgaataggggtgttcatcgcagttcgttctgcaaatgaccgaacgctaaagttcgaagcgtggatgtcaggtaagtaccggcgccggtgggcaatcgtttctacatagcccttctcgcgcgcagtttctaccgaactatctacatatttttttactcccggatattctttaaagtaagtgtcgatgaaccgtttggcatccttacgagaaattccaatattttgggaaagcccgtaatcactaataccataaacaatcccgaagttaaccgcctttgcttggcgccgaatgttaggagtcacttcactagcatccttcaaaccaaaaatccgcaccgcggtactggagtggatatcttcgtctttcttaaacgcttcttgtaaatgatgatcgcccgtaatgtgtgctaacacgcgcaattcaatttgcgaataatcagaagataaaatatgccaaccttcgtgtgacggaacaaaggcttgtcgaatcttcttgccttcttcaatccgaattggaatattttgtaaattcgggtctgttgatgacaaccgcccagtttgtgtcaaggtttgttggtaggtagtgtgcaccttttggtccgtagaatgaatcaccttcaacaaaccgtccacgtacgtcgatttaattttagcgatcgttcggtaatctaaaatgtgatcaataattggcgaataaccgcgcaatttctctaagacgttgaccgctgtcgaatatccggtcttggtctttttaattactggaaattctagtttttcaaataaaatgtgccccaattgtttaggcgagttaatgttaaactcttccccagcctcttgatgaatctggctttccaactcactaagccgttcggtcaattcgctttgcatagcccctaaacgctcgcggtcaaccttaattccgctaatttccatctttgccagcacaatcgataatggtagttcaattttccaatataaatcggcctgttggttgttaatcaactcttcttgcaagcgccgccctagttcaccaattacgtcaattttgtgggcgaggtgctctagtaaaacgtcttttgcgggcaccgcccgtttagctccggtaccgtaaacttctgcatcggttttaatgtcttcaatgtcatgttcgtgagcaagttgccccaaatcattagaattatcgttggtatctaacaggtaggactgtaataaaatatcgtagttaatgctatttaaggtcacgcctagtcgatgtaatcctacgtaagtgcgcttcccatcaaagacgtttacgaccaccttttggttcgctaatatttcagataacgcgggttctcgtaataattcaacgtcgtcgcttacccaaagctctttatcagttccaattgcgaatccgcaaaattcagataggtgataatttttctctggcatttccaaatagaagttaatttctttctcccatttggtaaagtccggtaacgtatccttcgttaatacgtgatacgctaatttttcacttaccttttcttccgttggtttattttgctgtaacgccgctaagaaagtccggaacttcatcttttggtagaactcttgtaaaaaggtgatgttttttccgtcatactttaaatccgccaatccgatttctacgggagcgtcccgcttaatggttgccaacgtcttcgaagtgaaggctgcatctcgatcctcaatcaagtgttccttcattttgcttggtttcaaatcatccaaattgtcgtaaagattctcaattgtcccaaattgcttcaacaacttgagggcggtcttttcaccgaccttagttaccccgggataattatcggaagtgtcacccgctagaccttttaagtcaataatttgctcaggagtgattcccagcttttctttgacgtggcgtggcgtatactcttcgacttcactaaccccttttttagttaccgcaacggtagtttctgcactacttaattgcgttaaatctcggtctccggtaaccaccaccacttcgtaatcgtcacgttccgctgctaacgatagggtaccaataatatcgtcagcttcataattaggtaattcataagttttgataccgtatccggtcagcaactgtttgatataaggcatctgctctgataactctggcggagtttttgagcgacctcccttataatcatcgtacatttccgtccggaaagtcgtttttccagcatcaaaagcaaccaatgccgccgtgggctggtattgttttaaaatgctgtccaacattttattgaacccaaaaattgcgttagtgtgcagtccatccggattcttgaacttttctagcgaattatgcaacgcgaaaaaagaacgaaatgcaatactgttcccatcaattaacaataacttatcttttgccatagcttcctccgttttctatctcccttaatcataccaaaaaccgaaggccaacgtgaataagattgaccttcggttctaaatgaaaattaaatttttgattaatctcgactccaaccaaaaatggttaagaagtactggaataggttaatgaaatcaaggtataaactaaatgccccttgaatggcaagtcccgtttcggaaacccggtcgccatagctcaagtaaagattcttcatcgatgccgtatcaaacattgacaaaccagcaaaaattacaattccaatcaaggaaaagaagaacgttactgcgctgctgtgcaagaagaataggttaatcaccgaaacgaccaccattgcgattaaagcagccagtaaatgcgtccccaaccgcgacaaatcacgtttagtggttaatccgatcacgctcatcacgacgaacacggcagctgccgagaagaacgctcccgcaatcgttccaatgctgaagagcataaacacgctggaaagcgtgattccaaagaatcccgagaacgcaaacaacattaagaaactaaccgttggattttgtagcgccgtcttctgcccaaaaatcatgaaaagaaatagcgcaatgaaaatcagccagattcccatccgcccttggcttagaaaggtcatcaccgctgggcgccatactgtagcgcctaaataagcaatgattccagaaaaagcaaccgcggccgccatccaaccgtacattttagttaaaaatcggtttaagccgattgtattatttattactcttggttgttgatccaaattgatccccccatttaaatctttcccatattgtaacaggaaagcaactaaaaggctatcaatcaaagtcaagaaaggtcaaatttttacttttccttaaccaaggctttataagcgtcttcgtattttaaaatgtcgccagctcccatgaaaactagcaccgcattgtgttggtctgccaacgcagataggtcgtcttcatggataatctttgtgtcatgaccaattaaattagccaaatcttgtgacgaaactttcccgtttgcttcacgaactgaaccaaaaatctcggtcaaaacaacttgatcggcaaggctcaagctcttagcaaagccgtctagcagcgcggctgtccgggtataagtatgtggctgaaatactgcaacaattttcttatctgggaattcttgccgtgccgcatctagggtcgctttaatttctgatgggtggtgagcataatcatcaatcaagatgttatcacctaccgtagatttcgaaaaacggcgtttaactccttggtacgatagtaattcctcttggactagtgccaaatcaatcttttcaaagtaagctactgcaattacggctaacgtattgagaacgttgtgctcgccaaaaaggttgattttaaaatgtccaattggttcaccgcggtgttccacgtcgaattctgatccggtcgtggtccggacgatgtttttcgcctgaaaatcatcattgtctgcagttccatagtaataaaccggaacatcagcatgcaatttccgtaagcttgcatcttcaccccaagcaaaaagtccctttttaacttgactagctgcttgttggaaggcactttcaacgtcggccaaatctttatagtagtcggggtggtcaaaatcaacgttagtcatgatcatatagtccggatggtatgcgatgaagtggcgacgatattcgtcagcttcaaacacgaaaaaccgggcatcgggaacccctttaccagtaccatcgccaattaagtaactagtcttgtctactccgccaagcacgtgagccaataaaccagtggtgctggtttttccatgagtccccgccactccaatactggtgtatgcggctaataattgtcctaaaaattcatgataacgaacgacctttaagcccatttcgcgagcgcgttttatttcaggatggtcatcagtaaaggcgtttcccgcaatcaccgtcaaaccgtcacgtaagttatccgggttgaaaggcaataccttaatgcctgccgcagcaagaccgtcttcggtaaaaacgtagccgtctacgtcagagccctcaacttgataaccttcatcatgtaaaattaatgctaaagagctcattccggaccctttaatcccaataaaataataaattgtatctttatccacctttaccactcccataataaattgttttcagtttaccacaatattaatcatcattttcttctgggtgataaaaaacttcgcgaggcttagaaccccgtgatgccgaaatatatcctgattcctctaactggtcaataatcgttgccgcccggttatatccaattgagaaaacccgttgtaattttgaagttgaaatggtgtcttcttgagcaatgtattcaaggacgtcatccatcaactcgtccgtgctatttagttccgcgctcttttccttcagttcggttgggttgaatgcataatgcggcgccgcctgttcacgaacaaaatcagcaatatcatcaattgcgtcactaataaatgctccttgtaaacgcaccggattgctctttccgttaccaaggaacagcatgtctcctcgtccaagtaaccgttccgctccactttgatccaagatggttcgtgaatctacttgactagaaaccatgaacgccacccgggttggaatgttgtttttaattaaccccgtgaccacgtccacgctaggtcgctgggtagcaatcagcaaatgaattcccgctgcccgcgctttctgggtgatccgcacgatgtaatcttgcacttcagctgccgaaaccatcattaaatcagctaattcatcaataatcaccacaatgtatggcatttggttagcatcgtctcctgcgcgacgggccttttcattaaattgttctaagttacgggctccagcagctgccaagcgttcgtaacgttgatccatttcgttggtgacccacttcaatgcggcagctgccgcttgaggatccgaaatgaccggtgctagtaaatgcggcagccggttatacggtgccatttcaacggccttcggatcaatcagcaacaacttcagcatttgcggagttgccttatatagtaaggataccaatacactgttaatgaacacacttttaccagaaccagtagcaccagcaatcaatccgtgcggcattttccgtaaatcatagacttgcggtttaccaaataaatcgacccctagagcgatcgtaagtggcgatttactttcttgaaatacaggcgatttaataatttcactaagcggaactggccgcggatgcggattaggaatctcaattccaacggtatttttcccaggaattggggcctcgattcgaatatcccgcgccgctaattgcagctttaaatcatccgttaaattagtgattttgttaactttaactccgcgtccaagttcaatttcaaactgagtgacggttggccccaccgtccagttgactactttagcggtaacttcaaaggcgtttaacgcatcatccaaccgctgcgcttggtcggcaacccattggttttcatctccgttttgaacgacaggatccggtagtaggtctaaactcggaaaatggtacccgagcatttgtttagtggtttcttgcgctactggaatttgtggttctttaaccgaacgagcgggttcccatgccgtttgccttgggttagtaacttttttaggtacttccaccggctgagtaaaactcttcgacgttacactagccgtttttgcccgttcgtctaattgttgcgccgaagccggcggaattgctgcagacggagcggtcgattgggtaaccggcttagtttccggtgctcccggagcagcgcttgctaatgaatgactttgctcctcgcgcgaagtcgtagtgtcagaatcgctggccgccgattcatcaagtaccgggtcgtttaactcttggcgactagttagttggcgcttggcttgattcaatctgggtaaaggtcgccgagttaattcgtaattactaattggcaaccggaatcgacgtacaggtcgactatcaaccaaactagttgattcggattccaaacgtgctgaagacctaactgtactattgagatcactcgcttcggtgtcaggggcttgcgtttgcgccaatttttgctgaattgcgggcgtaaatggatgatccgacttcaaccttttcgctgaatccgttggttttctaaccgaatggtcgtccattttgaggccttttttgcgaaaaaaagccggtccatcgtatttaaccatttaaatccttcccttattagtcaaaaatatgatttccctttgcgaaatcaaaagccgttcctacttcaaaatcatctggtaaaattaaggcaccctttttctgaggtgcattttttaagtgcagttctcgtccggaagcaatcatcccgtcactagaaacaccgcgcagttcaccaggccatataatcattccatctggcatcatggcgcctaccttagccactacaactttaatatcagccttcatgttcggcgaaccgctaacaatttgaagtgtttcgccattgtcgacttcggtttcggtaatttgaaggtgatcggaatctgggtgcggcttaaccgttttaacgtacccaaccacgaacttaggactttcgtcagcaaccaattcatctgcaaaacctgcctgccgcaactgttcatttagctttgtaacttgcgcggcagttaaggtaaccggtccgtggccatctaactcgggtaacacgttgctaacttctaagaaattatatccggtggtaacattactatcggcgtcaaaaatccgcactacgttatccttttgctccaccgcctgcttttccgcgtcagggttaaccatggtaattaaaatatctcccattgtttttggattataactagctactaacatctcaattctccttaaatattactttttaattctcaaaccattcccattaatgttagaattaatggaaaaggaagtgttttcatgtcatctaaaacatctgcgttaactgcactaaccatcaccgctttagcttcgttcgccgtaggcacgttggtggcaactcagattaagggacatcgtaaagttcgtccccaagccgcccttgcgcgtgtccggcgttcttttgaagaagaggggcccgttgaaggcgcttggatcgagtccaagccatctccccttaaccggcatggtctaaaggcctccgtatattacggcggcatcaccaaatacgaaaataacgaactaattcaatacgagttcattgccgacgcctacaccggcacaattatcgacatttaccgtcgttaatttcttaatcataaccaaagcaagccgagaaaaattttctcggctatttttgtgtctctgccggtttagttgcctaatctaaaaatgagcaactaacttgtaaattggttggcccttttcactaaacttgtgctcgtattccgtttcaacgttgtcttcgttttcgggactattgtgtaagtctaaccagactccttcaaaaatcatcccgtaattattgagactagtcaatgaatactcaaaaagtccctggttgtctgttttaaactctaatttaccgtgttcgattaaaatttgttcgtaaactttcaaaaagcttttataagttaaccgccgtttttcgtgccgggttttgggccatggatctgaaaagttcaaaaagagctggtctacttcaccatctgcaaaataatcggttaattctgcgccatccgcatgtaaaaattgtaaattagggagttcttctgctaaggcattttttagcgcaatcgccaccactgtcttttgaatttcaatcccaataaaattgtattggggatattttttagccatgttgatgataaactgccctttaccagtccccacttcgatccagagtggttgttgcttagcaaaacgttcatgccactttcctttataagcctgtccattttcaacaaccatttcagggtgctccacaatcaacttgggagcccacggtttatttcttactcgcataattacctcttttatctgtttatttttttaatataacgtggtactaaccactgagttagcaaccaggccgtaatcgcttggactacgattgcccatcctaaaaacgagagcgaccaattagtcacgcagccggccagcgttaataaaatcgcgcttaatagtatgattctttttaagacggataacaagcccttttgtgccatttctgcatcaacggggtacacttgcaccattgaatttgcctgaacgggccggtaaacgtctaccaattgaatcacgattaaatacgtggttaacgcgcccaccatcagtttcaaccattcctgatcactgtacgccacaattagcatgcccacaattaagagccggatcatcaagcttcctaggtcaccgctccggacaatcataattgagtataggtaagaaaacattgatgattttcctgccaaaaattttactaaaccatcggcatagcgacgtcgtttagccttaacgggcaaatttttcacggtggtaaataagctgaagaagcggtataaccgtcccattcgtttttgttctgcatcgaccgccgcctgccaattaaaactgcccttttccatgaggtggtttaggcgctgccattctaatactaaccatcccaacataagcaccgcggctattaaagggaatcttatgattaagctaacaataatcgcgtcaatgagcaacgtgattttccggtcccaccgcggacctgcaaagtaataaccttgataccgaattaatacgttggtaaaactgcctaatataactgttaggacgacccccatcaccaagaataattggtggtaagccaaagctaacagtggaaaaagcaacaggataccgatgccaaccggaattaaaactgaaattaacgtccgacgtaaagatttccttaaataggcagaaatatttttttcctggctcattaaaaataccggatcagcatttttaagcaagagcactggctgcccaggcaaagttagcaaaaaactaactgtcgccactaaaatcaggccataatttggcagaggctgtaaagttttcagccaattagcgtacgctaaccctaagccgcccccgaaaaataacagggctaaaactaaatgatcatttaatacgtattttaaatatttgagaatttcagattggtaagttttagctcgctgctgccacaattcactcatgacgctcaccctttgcaatcgacaaataaatatcgttcaagctagctgtgggagcattaaactgcgtttggaagtcacccagtgtgccaaccgcctttaactgcccttcgttaagcaaagcaaaccggtcacagtatttttctgccgtatcaagcacgtgagtagacattagtaccgctgccccctgtcttttcttttcattaataattcctagcaggtcatcaatggctaacggatccaaccctaaaaaaggttcgtcaatcacaaaaagccgggcgtcagtcatgaacgcacaaacaatcatgaccttttggcgcatcccttttgagaagtttgcaggaaaccattcgagtttatttgccaaacgaaatttttctaaaagttccatggcattcttccacgcgaccttttcatctaggttataagctttaatggtaagttctagatgctcttttagcgttaactcgtcgtacaagaccggcatctcgggaatgtacgccaactgtgctttgtaagctgccggttgctggcttagttggatattattcaaactgatggttccttgcatgggttgcaacaaaccaattacgtgattaatggtggttgactttccggcgccgttcaacccaatcaagccgaccaattcgccttcgtgcacttctaaatttatatctttaatgactggcgtttgcgtgtatccaccggtcaaatgctcaatctttagcgtcaatttataatccccaatcgtattaaaaatctctcatcgattataccacatcccgctcgaaaacccggtcgtcaatccgcacaattacgcaattttcgtgtataattagcctgtataagacaagttttgtattggaggtaattttatggacgaaaattgcgtattttgtaaaatcatcactggcgacattcctagttacaccgtctacgaagacgacgtggtaaaggcttttctagatatttcgcaaggaacccctggtcacacgttggtaatccccaaaaaacacgtgccggatatctttagttacgaccctcagcttgcagccgacgtattttccagaatacctaagattgctagagccgttcgcgacagtaacccagatattaagggaatgaacatcattaacaataatggcaaaattgcttaccaaagtgttttccattcccatttccacctcgttcctcgttataccgaccatgatgattttggcatgcggttcgtggacaacagtagtcactacgatgaagctcaattaaccaaaattcaaaatcaaattaaagataatttaggtgaataacatggcaaaaaacaagcggcacccttggctaaaaggaattgtaggttcttgggtaggttggcaaacggttaaatacgttagccaacatccccacttcttaagggatttaaagcattcggtaaaaaattatgctcaagccattagcgattttggagacgctctccaaagtctacgtttaaacacggctcaaatgaaggttgaactaaaaaagagtgaaaagacccttaacgaaattcagcaatcggttgaccgttttcaatacaaactagaacctcggatggcaaaaatcaacgaactgcaaaaacatctcagtaatgaacttaatcaggtgcaaaaggaagttgttgctaaaaaaagaaaatgagccaaattttttcttaagattatccgaaaaagtttatcgaaaccttaattatgttatgataggtgctgagtttaactaatactattgttaggatgtgtggatttaatgaaaaaagttttacttggattcgctagcattgcgatggcttttaccttagctgcgtgtggtagcaagacggttgccactacttcaggtggtaaaattactcaagatgagtattatagcagtttgaaggacacttcaaacggtaagcaagttttacaagaaatgattgttaataaagttcttgaaaaacaatatggtgataaggttactaagaaagccgttgataaacaatacaatacttataaggatcaatacggttcttccttcaaggatgttttagcttcaaacggcatgaccgaagcttctcttcgcaaacaaattcgttcgaacttgttattgaaggaagccgttaaggacaacgacaagattagtagctcagaccttaagaaggaatggaagtcataccaaccaaaggttactgtagcgcagatcttagtttctaagaaatcaactgccgaagacgttattaaacaacttaacgacggtaaggattttgctaaattagctaagaagtattctacagactcatcaagcaagaataagggtggcaaaattgcgccattcgatgacactaacactactttagattctgactttaagaacgccgcatttaagcttgacgaaggtaagtacactactaaacccgttaagactcaatacggttaccaagtaattaagatgatcgacaaacctgccaagggcaagatgtccgaccatactaaagaactaaaagaacgaatctggaatgaagacatgagcgatagtgctaccctccgcaaagtaatcaccaaggtacttaagaagggcaacgttactatcaaggataaagaccttaagaacgtcttagatgattacttaggtagttcttcatcttcatcgacaagcagtaaatagtttatatacaaggcgtgccccaaacctttagtagtttgggaaccctaacttgaatcggcgactatacctaaatctggcgtagttgccgatttttggttaaagagcctgaactgaaacttaatccgctaaactaaaaacgctcctcaagaatttttaaatttcttgagaagcgttttttacttttggatccactgatcttaattaataagctcggtactatcaaataacccaattacttagtttgtggcttatagaaccgccgtccattcattccaaaaattcgttcactaaaatgaccttcatccgtattctttaaagctcccgagaccatttggatttgggcatctaggtcatctagcgaatgaagcaccactgcttcaagcatgtggggctcgattggtgacccgtattcccgtaatccatggtgggaaactaacagatgacgtaataccactaaagattctccattcggatcaattttcagtgcttgagcagcctccactacctcttcgtcaataattacaatatgccccagaaggttcccttccaccgtatattgagtagcaaccggtccagaaagttcgatggttttacctaaatcatgcaaaattgcgccggcaattaataacgactgatcaatattttcatattgctgtgcaaccgccttggccaatttaacgattgataaagtatggaaagctaatcctccctcaaaagcgtggtgattcgacttagccgccggaaaatcaaagaattgctgatcatacttctttagtaagtaacggaccacccggttccaatccggattattgatttcaaatactaattgcgcaaaggcttcccgcaattcagtcaccgaaaccggagctttttcagtgtacgccgtggggtcggcaggttcttcctcggttgccagacgcattgccataattttaacctggggagctcccttataagtttcacgtttcccctttagaagaaccacccgcccagattgaaattgttcaaaatcagtggcggttgcatcccaataattcccccgaatttcaccagaacggtcttggaaaacgagcgagataaagtctttgccagtcttggtcactcgtttttcggcgtttttaatcaggacaaaaagttccatttcttcgtcattttgaaaatcaattaattttttagtcaaacctgcgttcctcccttatttttcgtttagatcaaccacgttacgttggtctaccagttgataaacttcttttttggccgagaagtaaataatctgggtttgttgagcaatttgcttaagtaaaccaaatgtttccgctaaacgttggtcatcaaaggctacaaaagcgtcatcaataataattggcagatccacggtatccgcaaacgcctgcataaacgcaaaacgaatggaaatatatagttgttccaaagttcctttagacagttcccctaattcataagcttgcccattttgatcaaccacgtgaatagcatcgtcattatcaaattcaatttgatgataacgttggttcgtaattttagcaaagtactcgttggcttgttgaataattaagggcaaccgtcctttggtagccactccaagggtttcatcaacccactttgcccctaattgtagcgttaaccactcatcaattaaatcttttagctcagtttcttcttcggcaagggcttgttgttcatttaaaatatcaatttgattctttaaaccggttaattccccgattcgctgggttcgttcatccactagcgcttgttcttgggcctttaattgctgtaattcggccgttagtttgctttgttgcgcttgtagttcggtaagttccggatacttttgtaattccgtctgaattgcgggatccaccgttttttctaaatcacgtaaccggaccgcttgtttctgtgtttcagttaattgcgccagccattcgtcaaaatgatcatccagtggcggaattgcaaattgcgcaaacttagttcgtaattgttttaattccgcctgctgctcgttcaagttttgcgtcaaaattttctgagtctgcacttggctttgctgttgttgaatttgctgaattcgctcggtcacccatttggtaagttcgtttagcgatggttgggactgggcttcgtcaatttgtaagattggttttgccgtttgccaaaaatcagcaagcttcccccgtaaaaccgcttgccgttgtttaagttcagccaaccgttgttcgagctggcgatagttcaccacttcgttttgtaaaaatacccactccgtcgctggaaccacgtcaaaaccagtttggacaccaatttggcgaagtttttcatcgatttgccgcccatttgcttccgcggtttgcaaatcgtccgccgcattgtctgctggtcgagcaggctgatcaacttgcttaaccaccccgcatgctcccaaaataattacggctagtaaaatcagtttaataattgcgttaaccggtaagaagaagtcaaccgccgctaaaacaactcccacgccccaaatcaggttaccgttagtcgacttgtttgctgacgcagtttgccgtgacggcacactcctcaactggttaaccttagcagccgcttgagcttgttcttgcaaaagttgtttaacttgcttaagggtggcagaatccattggttccacgctacctaagtcgaccgaattattctcttgtaattcggtaagttggttggttaattcggtttgttgctgctgtgctttatctaattcatcccgattgaccttagctaccggtagcttagcttgcagatccattaactgatctaaatcatccgctttctgcgctaaaggcggcaagttttgtagcttttgctgagtccgttggcaattttcctctagtttccgaatttgatccgctagtcgactaatttgtcctaaatccaattgcaaatcagctttagatgccttttgaactctttgccgtaacgtagtgattttttggtagttactccacgcgtctaataatttttgctggtggctagtttgcttggataattgactaatttgctgccggatttcttgtaattctgcgcggttttgatcttctaaagcctttgcactttggtaatccggtaattgatcacggtcatcttgtaaatgctgtttagctttttcataatgcttaatttttttatctagctcgcgggtccgtgaactagccgtatgcattttatcagcatctttttttaaatctttttcaaattgaatccattcttcactacccacggcgcccattcgtaaaatatggcgacgcaaatcgtcccggtttcccaagtcgttaaaatcatctaagtcgctttggttaaaacctagtaaacgttcgtatgtatgttggtcaattgggcccaacatctcacttaagaaatcgttagtaaccgtactttgatcaagtaaatccttgatggttaccgtaccgccattttttcccttcacgcgctcaattcgatacgggtgattttggtagtcaatttcaatagccccgccatatccagccgaaccacgtccttttttaggtacgtatttcaaatatttgttactaccccttccttgggcaaaaccaaagaagacgctgtaaatgaactgtcgcagggttgattttccggcttcattaagcccgtaaaacacttgtaaatcgttttgtaaatcaaacgtcacgttctgccatttaccaaatccatagatttcaattcgcttaattttcatcgtttatcatcccccagcgcattgcgttgttgtagcataatttcaactcgttcgcggagttcttctggattaaaatcggcttggtaagcttcggcgataaaatccaactccattagccgccccagttgcttttgaaccgttttaggagtaaaaacctgttcagcggcctgttgccaataagtacggtccaattcggaaaatactggcgtttgctcatcaaccttcagtaaaatgcggtatacccactcttcagcggagtctaattgcttttgtagctgggatagtcccaggccgttacttaattcttccaaaacttcgggtgccagatggttacttccagctaaactaacactcattaatttaaaagaaggggacgtaatggtgccggccttttgtaagatgttgcccaatacgctctgaaagtccgccccctcttcaacagccaccgtcaagctctgccattccaccacgtcgctacggacaaattctaccttagccttttggttaggttccagagtaacgaggctggcacctttcgccccgatctcattaatgtgtcgtccctgcgtatttccagcataagcgattacgggatcctcgtgcaaaatctggcgcttgtggatgtgtcctaaagcccagtaatcgtaattcttatctaataattggctaagggtaaacggcgcgtaccttgcttcactggcgtgtaacccatccatactcccgtgtaaaagaccaatttgaaaatcaaattgtccgtcattagttgggtactctacaattcgcgaagttacttccgcccgtttggcgtaactaaacccagttaaccccacgatcgttccgtccgtcgtcgttaattttttagtttccacttctggaccaaatattgtgacgttttctggaaagatagttgttggaattttagcgttaaggtaatcgtgatttccgtaactcaaaaagactggtatttgggcttggtttagtatgtctaactggtccactgcaaaactcaacgtgtcaatatcaggacgaggattatcaaatagatcgcccacaatgcaaacaaaatcaactcgttgttcgatggccgtctgcactaacttcgcaaaagccgattttgtcgaattaaccactaccttacgtaagcgttccggtatgtttttaaggccccgaaacgggctacctaaatgtacgtccgctacgtgcataaacttcattttttgtcccccttatcagcattacttttatcaaaaataaggctggaaaaagcatccttaatcaaggaatttcttttccagcctctttttcgttttattatcattaccaattttaaatcggcctactacttacgcagccatttaccgaatgaacaacatcacgttgccgtcccagaattatccttgatacaactcttgaatcggcttcatgatgatttgattaacatcattaatcaactgattaagactccgctctttgtccatcaagtctttaatcaagtccactttttcgatttcaccagcgacttcgtgaacctttttaatttcgtcttcggttaactcttcgccgttcatttgtttttgttgaagcgaactttgaatatcttgaaacttcttatacaaagcacttgcgttctcgtcttgttgaactttttcaaaagattgtttcaaattttggtattcgttggttagacggagctcttgttccattttatttgcggtatcataaatgtttacagtcatagtgcgcctcctctgatttaacagttcaattatatcatttagaactaatttttaatactggaatcactgccccatgataaactttttcgcgtctttgaaaagttcgccagccttttctttaacaccgctagcacctttggaaatactgtctttaatggaagaagttccatcttcaatattatcccaaagatttcctgcactactgttgccattattgtttgctaacgatgacgcagatttaacttggaacgtcgtgcccttggtatttggtagaatttcgctcatttcggctttgaacatgctgttcatccctacaccagttatattttccaaatggtggtctttattggtgtcgtcaaatccttcccaagtagcgaccaccacgtccttagtgtagccaaccatccatttatcccgggtggcttccgaactcccgcttgtatcggcttcggtactaccagttttaccagcaattgtatagccgcttggttccgcgccgtacccagttccagcgctatcaccataaacccccagcatcatgctggtcatctcattagcgaccttcttggaaattacccgtttcttttcaggggtgttattaacgattgtctttccagaagcatccacgattttgcggataaaacgtggtttagacatgtttccatcgttagcgaaggccgtgtatgccgaagcaagttgaattggggatacccctttagtcagccctccaagagccatggcaaggtttttgtcgccctcactcgggttaaggccaaatttcttaacgtaatcgtatcccttatcaaccccgattttattcaatagccaaacggccggcgcatttttactttgctcaagcgcttgatacatcggaatctttccagaatactggttgttgtaattttccggtttatagtggttagtcccgtacgattgcaatttatcttccaaaattgaactgtaccggtaaccactagcgagcgccggcgcgtacaccgcgattggtttcaacgttgagcccggttgccgtttaatttgggttgcccggttataaccccggaagacgtgctcgccacgtcccccaacaatggcttccactccgccatcatcagcattaaccgctaccgaagctgcttgaaccttagtaccgtcggtagcattgcttggaaaattattcgcgttatcaaacgtatcctgcattcccgcttggctaccttgatccaggtaggtgtaaatcttgtaaccgcggttcatgatgtccgattcagtcaggccgtaacggttaattgcttcgtcaatcaccgcatcaaagtagtagggatacttataaccgtcttcattggagtagttattagacgtgacaatcggggtctgcgcatagcttttagcttgagaatccgaaatttttcccgtctctgccatcaagtttaagaccacgtttcgtcgagaaagtgcgtttttagggtggtcatccgggttatatgcactaggattagttagcattcccgctaacacggcggcttgcggaaccgtcaattcggcagcgctctccccaaagtaacgttcagatgcatcctgcactccccaaactccattaccaaagtaggcgttattcaagtacattgccaaaatatcttttttggtataaacattttccacttcaattgataaaaataactctttagcctttcgcgtaaaggtctgctgttgggacaaaaaggcgttctttaccagctgctgggttaacgtgctcccaccaccggaaatgtaattgcgccccaacaccttattcatgccgtacatcacgaaggcccgggcaattcctttcaccgaaaaaccgtattccttataaaaattgcgatcttcggtagcaattaccgcattttggacgttaggtgaaattttatctaaatctacccaagttcccttttgggaatataagctccccgctttttcattatgtttgtcgtaaactaacgttggctgcgataaggccgcttttaaatttttaacgtttgcagttttggcttgatacgttaaaactgcactggtgacaaaaataaccgctaaaacaatcacgataatccagcgggttaattgataacgatgccagtacttgtgtaaaaatgggtgaatcttttgccaaatccagctaaaaaagcccccaattttttgcagaaatactttaatcgcattccaaaaattttccatttaatattacctcattacagattacgatactgttggtattttatcatattctataaggtttcctttacctatggaaggtttttaaactggtcttaataagtaaaaacgagaaagcctctcgttgatcccgttaattagcccgaatcttcatcttaagagtaaattctcttaaagcttgctaatttcaagaatttgagaggttttcccgttgtttagttagtttgcattagttcgtttaatttttgatttaaaacggtagcttcgtcaacgtccgcactgaaaattaccaacgtatcaaatccggcaagcgttccccgaatttcttcaatatcggcatcgtcaatcaccgctgccacccgatttccgtggttaggctcagttttaacaatgttgatgaactggacttgcgtaattttagtcacgctctcttgaaaaatttcccgaataggactattgtccggctcaatttgctctttggagtccatcacccggtacgttagtgcacccgtaatgtcggcctgcttaactaagtgcatttctttaatatctcgcgaaagggttgcttgggttgtcttaatccccgcatccgccagtgcctgcaataattccaattgcgtagaaatcggtttttcgttaattaaatctaaaattttctcgcgtcgtacgtcttttttcataattcatccccgtcctaaatcaaataaacgaaatcaattttcgattataccttatcttattttgttgctgaagttgttttacaaccgtcgtcaccgtttccgtagtggtcccactcaacaccgctaagtcttttaacaaaatttgaaacggaatttgacgcaccgtccctcttttttgtccgtattcagcctttaagccgcttaacacctggcaaactcgttgggtggcgttcgaactcgtagtctgttcaattaagctagttgtacgttcaattagcctttccatccgctggataaacgaaactagacaagcgtagttatgaataattacccgtcggatttccgttaccggaactatgtacacttctaaatcagtgatagcaattgaattataacagtattcttccccattaagaatgcccctcagtggaaaaattgcctgcggcgttaaaaatgataaatatgttaagtctccctccgcattcattgccgtaacttttacgtgaccttccttcaaaaaatacacgtcactaagctcatccctctgatcaaaaatccattgtccccggtgcacccgtttaaaacgcgtagcttcacttagtcgatctaattcctgcatgggtaagtttccaaaatctggttgagccatataaaattttttgatttccgtttggatggttggcgaaatcatagaaaaactcctttttttaaaattgatttgacgcctactatgttagaaaaaaattaccaccccagtaacttgacggtaaaggactaaaatccgcaatttttgttaaaaaaactgtagtttgtccattatattacattttggtgagattgatgtgcttttaattaagagcactcgcccaattttacttcgttttcttccactaaaaaaaccaagcacttgcgcgcttggtttttatattgaatttcagttggttaattttacatttcgtccggtgccttaacgccaagtaagcgtagtgcttcttcaagtactaaactaacactcttaaccaatgccaagcgtgctggcttttcagcatcgtccgccaagatccgagaatttgcgtagtacttattgaaggatttcgccaaactcaaggcgtacttcgcaataactgatggttcatattgggcagctgctcgttgaactacgctcgggaattcttgcaatgcttttaaggtatcccaagcattggcatccgtaatcttcaattgatcggttgtaacttccgtatctgccttccgaagaatgctttctgcccgtgcccgactatattgtacgtatgggccagtttccccttcaaaacggacaacgtcttcaaggttaaagtcaaaggagtttgtccgttcgttcttcaaatcgtggaagactaccgcgccaaccccgacttcttttgcaaccatgtcagcgttagctaaatcagggttcttttcgttgatttgcttcttcgctaaggttaccgcgtcattcaagacttcatccaagagaacaacccgacctgaacgagtagacaatttctttccgttcagcgtaatcaaaccaaattggatatggtggatgtcgtcagaccagtcatagcccatttcttttaatacagcctttaattgcttaaagtggttagtttgttcggcaccaaccacgtatagcgattggacaaagttgtaagtccggtaacggtaaagggctgctgctaagtcccgagtaatgtacagggtagctccgtcagtcttcttaattaaggctggattcaagttgtacttttctaagtcgacaacttgagctccccgactttcctttaagaggtccttatcttccaaaatttggacaatttcatccatcttatcgttatagaaggcttcccctttgtaagaatcaaacgtaatccctaacttatcgtaaatttgcttgaaggattgtaacgaaacttcacggaaccatttccataggttagtagcttcttcgtcaccatcttccagcttcttgaaccagtcccgagcaatgtcgtctagttcaggcttttccttatcttccttatggaaacgaacgtagtattccaaaagtttattgattggatcagcttttacatcttcttcactaccccatagtttatatgcggtaattaatttaccaaattgcgtaccccagtcacctaaatggttaatcttaattgggtgataaccatttttttccataattagagctaaagaattaccaattacggtcgaacgtaagtgacccatggaaattggcttagcaatgttaggcgatgacatatcaattgggacgttcccattttgaccatcgtcgttatcaccataagctgacttttggtcaagaaccgttcttaaaacttcttcaccaaaggtttgcttatctaggaagaagttgatgtaaggacccgcaacttcaactttttcgaagtcgctttggtcaattttttcaactagatcttgggcaatcatttgaggtgctttgcgcaaaaccttagctagcgtaaaggttgggaaagccaaatcacctagcttgctttccttaggcacttcaatcttttcatagatttcgctatccgataggtattcgtttaaaactggttttaatgctgcaacaacttgattcttataatccatatttccgtcctttctgcgaaaaaaaacgccccttacatcgttaaatgtaagagacgagatttcccgcggtaccactctacttgattaaaataatccacttatttatttaatttaatatccgtagaatcacgccttcatctccgccttatatctgactcccatcaactcagactcgctaggataacgctgaagattactactattctacttattactgaatcattataacagagtatgttttgatttgctaattaacttttccggctaattgattaagggcctcaaattcattaggtgccaacgtaatgtacgccgcttgaatgttactttcaaagtgtttaatatttgaggtcccgggaattggtaaaatcacttctgaacgttgtaatagccaagctaacgcaatttgactcggcgttgccaaatgattctgggcaatttggttcaaaatgctattttggtctgaagccaactttccagttgccaacgggaaccacggaataaacgccatgtgttgggattcggcataatcgagaactgcttcgtcacggcggtcaatcaggttataccggttttgtactgaagcaatcttggctatcgcttgtgcacgtttaatttcttccaccgaaacttggctcaaaccaatgtgcttaattttaccttctttttgcatgtctgctaagacaccgacctgttcttcaattgaaaaacgggggtccacccggtgcaattgcatcaagtcaatcgagtccagtcctagagaccataagttcaattctacctgttgccgcaaataattagggtcgccaaccaccgtccacacgtccggtccttgtcgggtgaacccaactttgctggcaatcattttatgtggtccttgatagtcccttaacgcttctttgagatataaatttgcataaaacggtccgtacgcatccgcagtgtcaatgaagttaacttcactatctaacacccgcttcgctacggcaaccgcgttggcttcatcggcactgggcccccagacaccgtgtccaggcaattgcatcgttccgtaccctaaacgatttacccgtaactcatcatcaaattcaaatgtctgttttatcattgttttcctccgttaatgcgatggtttcaaatctattataaccgcgaaaaaataaattggcaccaaaactagtcaattcgcacccgttgaagtagcgagataatcaaactttttgctaacccgttttaccatgtaaattaactaaattctactttacattttttccaaactggactaaaataaattttgcaattgcgaacgtagtttagtggtaaaatccaagcttcccaagcttgtgtcgcgggttcgattcccgtcgttcgctttttagatgttttgggaaccttacggaaataaatcaaaagtgtcacaatcctctgataatactgggattgtggcacttttgtttttgggtagttatccatgagtatcgcagaaagattaccctcctgttcccagtctgtccccaaacgaataatttaaatgttgaacaattttgcatatcaaacgcgtaataaaaaccgtccgaattaatcgagcggttttttactctctatcattgtcctttagtctacgcacattattaaaaataatggtgccctaacttggatcacagagctatttcatttgacgccaattagtgatgtgatctttccagatataatcgaactcaccaatgacttcttcaggtgtcttaggcttatcaccagtcaattcctcaatatcgttcgatttaacatctagcaaaccgtccgcaaccgatttgtcattatcaacaacgtcatttgcgctaaatggtgccggtgattttgaaaagtcaccagacatatcatgaggaatccctaaagcctccaaataatcgtaatattgttctggtgtagctgggacgtattcgattttttgtcctgaacgcttactgatcatttctgcaatttgacgaatagaaactgattctgaacctacaatgttgtagactttgcgagtactttttccaagaagcgaagcagcccctgccttagcgcaatcatttttgtatactaacgtggccttgccttccccggcagttgtgacccaccgattgttagacataaaggctaacatagcccgcattgtcatgaatgtttccatatacaggttgttgcgtaaagcagtatagtcgatgcctgtactttccagatattcttcagtagcagtatggtcaggtgttacaaaaatgtgcttatacgctggatttctcgccccaacaaatgaagtataggtaatgtgtttaacgcccatttcgatagctgcgtcgattgcgttacggtgttgttgaacgcgtttacccacgtcaagaccagaaattaaatagagtcgatctccgcccttaaaggctttaagcatcgattccttatcattatagttagcttcaacgactcgcacccccgcatcttcccaacgtttcaatttatccttgggtacgcgctccattttgtagcaagtgaacgtcagctgatcaccactgacttcttttaacatcaattcagcaactcttccagctaacttcccgtcggcacccgtaacaatatatctcatacttaacaacctttctactttacaagttcattttatcacaatgtttctgcttgtattgtaccctttttagcgtcaagataaatattccgcttatccatatctaaaataataagcccccgatccacaaagatcgggggctttttaagtaggaggtatttcgtataactgtcttttgcttttaaatttcgttaactagtttagtgtaatcaatatttttcaatggggatccaacaaatacacttggaaaaagattgctaacccggcgctaatgatgatgtaaaccacgatgggaaccatccccatttttttgccaccataaaactcaattgcgtacccttgctcaccgccctttaaactatccactccaccaaccccctttttcgataaaatccaagcgaaagtttgatatttatttcacaattaatttaccaaaattctgctaaaaaaactgttcggtacccaacagttccccaaataaaataattatttttatgcctgtactaaaaaatctcttccacagtgggaagagattaattcattattgaataatttttgaagatgattagcgctactctaatgcaaatcgtccgccaaatcacactacttaggagactgcaaccatcgaatttgttccgttgtaaatccagtgtacttaatcgttaattgatagactttccgaacctcacgtaccacttctttcaaggattcaagatcataaggggtcaccctccgcaaaggaatcgaatgtggccgactgttctttttatgaacaatgaaaaagaagttataacaatcgtcaaaccggtcgtcgacaatgttaattgcataatatgtgttcggaatctttttaaaatatcgttgaattcgctgtaaaatcaccctagcatccgcattcattttaaaccagcacttccgcgttgaagactgtaaactggcgaaccaccatttgaccacgttggttaggccgcaccagtgctattaacgctgatccaggacgtgcttcttggaaaaaccgtagcgcgtgcgtatggatcagcatgttgtatttttgctgccgacgatccgtcagctgaaaccgcattaagagtggcgaataactaatgattttaatcgacgaagtaataattccgcttaacttttgcataaccatcaccctcactaatatattgggttaattatacaaacgtacgttcgtatttgtcaaatttttcagcattaaaagtaaggccgttgagtctaaaaaaggcctctcagaatctaaaattcttgagaagcccttattttaaaatcggatccaaagctttcgccaagctaacacagttatcaataactatcagctttattcttaaatcatccgtgatctttatagttcttccttaacttgtcgtttggcaatcattggcataatgacccctaacgcgattaaaacaaacggcgtgatgatgttcattgccaattggaaccaccaagttgttggatttgctgcgtagtcaatcttaggaatcacccctaaaatacatgcaaatgccgtaaataagaagcaccataatccaaaagcaaagccaatcttcgagtttttaacaaagacgtagtcagagttgaacttcttgatttgcttcgacaatagcatgtacgctacgaatacccagagatagcgcattggcattacaaccgagttaaggttcattaaccagttatataaatcattcattccaccgattcccaatgcaggaacgataataatgatcgaaaccaaaattccagttaatttgtaaccgttaatcgcaatgccgttcttatttttccgccgcaaacttgccggcacaaagtttttatcagcgtcatttaaaaagattcgtaacggagcgtcaactgaaatcgcaagcgctgccgaagtcgataaaatattggaaattgcaaaaatccaggtcaacaagttccccacgtggaagtaatttcctaaaatttggaaagccgtatacgacccgttcgccatcaaatcattaggaatgtggtcggcgtcaaaaatcattcccatcgcaaacgaacctaggacagcagaaagtgccaccatgattgcaagtaaaatcattcctagaggaaattctttggaaggatttcgcgtcttattaacgtatggggaaattttttccgctcctccaactgcaaaaactaacatggaaatcgtggtgaagtaattaaaattaaattttggcatataagtgctgacttgatccatgtgtgccgtagcaatcgacgaatgggcaataaacggcgccgccaaacctaaaataatgaagagaatcgacatggtaaacattccaatccctgcaatgcttcccacacgattgagagtagtaacgcccttagtagccatccataagaagattaagaatattactaaacttagtgcttgaacaatgtatgacggagtctggttaacaaagttcccgttactctggaaaagccagctaaatccaattagaattgcttgaggtttttgggctaagtaaggcacatgcacaatccaatatgtccaagctgctaaataagcccaccgactagtggagagttccttcatccaagaagaaacgccaccttccgcatcttggaaagtagctcccaactgaccaaccattaaagtataagggataaaatatagcgccatgatcaataaccaagaaacgatgaccacgaggccttgattagcaaagttattgaccacgttgttcaagccccaaacggccgtaaacgaaatcaaagcaatgttgtaccaacgaaaattgcggttgttacccgtagtttccataaattgtcctccttaaatatttataccctattacaccagaaaacgctgtaaaaataaatagatttccattaaaaagttaattaaattttaattttgtttgctttagcaacgcttaagataaccaaattgacaaaaaagtactgaattcagtaaaataattttggtataataacgctctaaaagcccgttatttggggatttaacccgcgaaaaaatttttttatttattctgcagacttttagcaaaatttgtcatcgctaaaagtactgaattcgataattagaatggaggaattcgatggacctcgtcgaccggatcaaattaaccgcaaagctaaagaaaaattggaatcttaaaaccaccgcgcaacacgctggaattggggttaatagtatttatcgttggaaaacgcaagctccccgagctgacaagttacttcaggttgcggaagctcttgacgtatcccttgattacttaatgggccgctcggaagattcacaaattcaaaaccaccccgtaagtatgactattgaagaagccgtcgacggcattcgctactttaacggcgagccggttaccgattttaaacggcgtggtttaaaagccattgcgaaggcctatttgcggaaggattaatctaatcacggcctaaaagtagcgtgcgccaaatgtcgggtagtttgctctagtcaaaaaagaccgttatgccgaatgcaggcgtaacggtctttttttggttaaacggaacagactggattttggcgaatactttgaccctattgccgccaaaacagcttgttaagaatctttttatccttgaaaatattgctttattttttccagcctcttattttattgactttaccgcgctaagcgtataaagattcgtggggatgtttaaaccaggtgttcagcgatccccattccggccctattgcttaactgcggaaatgaaacgagcaaaggctgccttaccagcttcatcccatttgaaaacgccggcatcagctaaaacccgcgcgaaaacattaccaacggccgtattgaccacttcagtaacgtttgctggcgtaatcgacgtagtttcttttaattgatcagcccaagttttatgcatttctgccatttggttgtcttgatttaacaggtacttttccacttctaccaattccgtctttaaccgagctggtaaaattgcccttcccattacttcaatcaagccaatattttcttttttaatgtgttgtacgtcttggtgcggatggaaaatgccgtctggaaatgctgccgaagtctgattatcccgcaataccacgtccatcacgtagttctccccatctttataggcaatcggagtagttgtatgatgacgcgttccatcggtatacgctctgacatccacactttcatcggaataattcatccaagtattatggattttaacggccgcatccgtcagcgcaaccgaatctttgctggtcaagcgaatggtcgacattggccacttcacgattccagcttctacgccattcacccctaattcaatggttctagcaaccggcgccttcatcattggaaatacatgtcggccaccttgatagtgttcatgtgacaacattgatcccccaacaattggcagatcagcattactgcccacaaaataatgtggtaactgtttaacgatttccaataagttggcaaaggtttgtcggttaatcaccattggtcggtgaacttgatctaagaaaatcgaatgttcgttgaagtacgcgtacggtgagtattggaagccccaagtttcgccgcctaccgtcatccgaataatccggtgattgctgcgggatgggtaacctaacctacctaaatagccctcattttgcatgcatagttgacacaaagggtagccattttgcggttggttacgggccgcggcaatcgccttaggatccttttccggtttcgagagattaatggtaatttcaagttgcccaaagtccgtcttagccggaaaagatacgtttttagcgattgcccgggttttaatgtagtcgttatctttacttaatttaaagaaataatccgtagccgctttaggactcacctgatatttatcccaaaaaagctggtttaaaacggaaggcaacggcgtcaccaagtccattagttggtctgctaaaatgctcttatctgattgagtatcctcaattttaccgttttggatagccgtcttaactaacgcatctaccaaattcgtcaactgtccatcaacggcttcagctggttcaccttcgccaaccaaacctaaaacacgattataaacataaatatggtccaagttggtgtactgcgatggtgaatcgattacggcttggacaaattgttctaaactattcatgatgcttgtcctcctcaatcattgtaacccttgggatgacttactttccaattccaagcggttttaataatttccttaacgtcatcatattgcggttgccaaccgagcactttccgggccttttcgctagcggctactaaggtgctggggtcacctgcacgtctaggtgccataactgcagggatttcttttccggttacttcacgagcggcatccaacatctgcttatttgaaaaaccagttgacgatcctaagttaaatacgtcgctatcatgaccttgtttgagatattccaatgccaagatgtgagcatttgctaagtcaaccacgtgaacgtaatcgcgcacgttagttccgtcagcagttgggtaatcgtccccaaagatttgtaactggtcgcgttcgccagctgccacttgtaaaataattggtactaaatgggtctcgggatggtggtcttcgccaatgctaccgtctggtttagcccccgccacgttgaagtagcgtaacgcgacaaacttaattccgtcggcaatgtctgaccaatgcataattttttccatcgctaacttactttcaccatatggattggtaggcacttggggatccgattcttggatcggcacccgcttaggttcgccataggttgccgcagtagatgaaaatacaatccgtttcaccccgtgcttagccattacttcgagaagcttcaccattccagcagtattgttatcgaagtatttcaaaggatttttcattgattccgggacgactgaaaaggccgcaaagtgaatcacgccttccacatcttctttagtaaaaactgaatccataaattcagtatctcggatatctccttcgtaaaaacgagcctggtcgtttactgctgcgcggtgtccggtaacaaggttgtcaaccaccgccacgtcgtaacccttcgtaattaattgatcaactgtatgtgagccaatataaccagcaccacctaaaactaagacagccattctaattcctcctcaatctctcaatgcgtaatcgtcacttaaaattcgtttagtattaaagttctttaggtccatcggcaacttctgcaatatagaagtcagcgtcatagccgattttatcgcgataaattttgcctacgttttccttaaaagcttctacttggtctttttccacgattgcaataccgcaaccaccaaaaccagcaccggtcatccgagctccaagtacgccgggttgtttccaggctgcttctgccaaagtatctagttccttaccagttacttcgtaatcaaagtgcagtgaaacatgggaagccgtaactaagtcaccaaacgtcttcaaatcgtcgtctgccaacgccttagctgcccgaatggttctttgattttcagaaacggcgtgacgagcacgtttgattaaagtttcatcgttaattaggtaagctgcttcgtcaaattcatcatttgttaagtcacctaaagagttgatgtctagcttagtttgcaaacgacgcaacgcttcttcacattctgaacggcgttcgttgtatttagagtccgcaagttcacggcgtttgttcgtattcataattacgattacgtgattgcctaacttaactggagcgtatgaataatctaaggtattagtgtccagtaaaatcgcttgttcttgcttacccattccaactgcgaattggtccataattccagagttaacccctacgtagttattttcacacttttggccaattttgactaagtctaattggctaacgcctagattaaaagcggtgtttaaaatagctccggtcaataattcaatggaagctgaggaagataaacctgcgccgtctggcatgttgccgtgtacgtaaaggtcaaatccgtggtcaaacttagctcccgttttaaccaattcgttcatcatcccttttggataattcgtccaacccgctgctttatcgtattcgaggttattcacgtcaaacgtaactacccctgaatccggaatgttagccgagtacattctgaccgtactatccgtccggggtgcgtaaacaccataagttccgattgtgattgcgcatgggaatacgtgaccaccattgtagtcagtgtgttcaccaattaagttaatccgtcccggggagaagaaaaccctttcaggtttggtgtcaaaaatttcggaaaattctttctttaagtcggttgcgttcataatatgtaccctccgtgttttactaaaattttattaacttgaatatatagctttaaaggccacttgtcaacaccctcttaaccctttataaacgaaaatggtagcgtttttacgcaaaaacaccaataactccaatttttccgatgaagtcattttttgaaccctaagaaactattatttttggttaaaatttaactaaaactatgtatacaaacttaactttatgttctatcattttgttgtaagcgttttatttttaattacgaaaggagttttattatgcaagcaaacctccaatggcttgatgatcctgaggtctttcgggtgaaccaacttcccgcccacagcgatcatcattactatcgcaatttagctgaacttaatcgcagcagtagctttgtgaaaagccttaacgggacttggcggttccattttgcttcgacgccatccgaacgtccgctccagttctattcacctaattttgatgatgccgactttgataccattcaagtccccggacacatcgaattagcaggttacagccagatccaatatattaataccttgtatccctgggaaggtaaaatatatcggcgcccgccgtacacgcttaaccaagatcaactagaacccggcttatttagtgatgcgagcgacaacagcgttggctcatacctgaaaaaatttgaccttgacgattcttttaaaaatcaccgggttatcattcaatttcaaggggtcgaggaagccctctacgtttggttaaacgggcattttattgggtatgctgaagacagttttaccccttctgaattcgatttaaccccttacgttcaagatcgtgataatctcctggccgtgcgcgtttataaacggagtaccgcttcctttatcgaagaccaagacatgtaccgtttttccgggattttccgggacgttaatttacttgcccttcccgatgcgcacattgttgatttagatcttaaccccgaggtgaacgccgattttaagagtggcatccttacggttaaggctactgtttctggcactaacgctactttagagttaagcgtgactgatcaagatcaacagcttctagcaacgcaaacccaaacgggaactggtaaagtttcatttaaaaagattgccttcgacaacttaaaactctggtcaccaacctcaccgactttatatcaattactgattaaagtttatgatgatcagcaccaactcttagaagtggttccctatcaattcggctttcggaaagtggaattgcgcgaggacaaggttatttacgttaacaaccaccgtctagtgctcaacggagttaaccgtcacgaatggaatgctcacagtggtcgagtcatttcactggacgacatgcgcaaggatattcagattatgctggataacaacatcaatgctgttcgaacctgccattacccggaccagcttccctggtaccacctttgcgacgaagctgggctttacgtgatggcagaaaacaatttggaatcccacggctcctggcaaaaaatgggcgccgtggagccttcttataacgttcccggcgataatccccactggttagcagccgtggttgaccgtgcccgttctaattacgaatggtttaaaaatcatccatcaatcattttctggtccctcggtaacgaatcctttgcgggagaagacattgcagccatgcaaactttctataaagaacacgattcttcgcgtctagttcattacgaaggggtagtccgggcgcccgaatttcgggatcgcatttctgacgtggaaagtcggatgtacgaaaccccggctaacattgcgcgttacctagaaaataacccggataaacccttcctaaactgtgaatacatgcatgatatgggtaattctttgggtggcatgcaatcatataacgacttaattgatcagtatccaatgtaccaaggcgggtttatttgggacttcattgaccaagccctcttggttcacgatccggtaaccaatcaagaagtccttcgttacggcggtgacttcgatgaacgccattctgactatgagttttcgggagatggattattgtttgctgatcgaacacccaaaccagcaatgcaggaggtgaaatactattatggattacacaaatagccaattacgcgtaatatatggtgacggcagtttaggagtggccggccccaattttcactatctttttagctacgagcgcgggggcctcgagtctttagtggttgataataaagaatggctctatcgcaccccaactccgctattctggcgggcaactactgataacgaccgtggaaatggttttgacgttaaggcagctcaatggtacgcagccgaccagttcaccacttgtcaaaaaattgaattagcggttgatggccaggcgctacaacccttgcccatcgcaccgtttaataatcgttacactaaccgggagtacgcaaatgaggttgccttaacctaccatttggtcacgccgaccgtaccaagtacttcggtaacgatcacttacaccgttactagtgacggtaatattaacgcggcggttcatttcaccggtcaggcagatttgcctgaactacccgcgtttggtctacgctttattatgcccacgacagccactagttttgattatacggggctttcgggagaaacctatcccgaccggttagcaggcgcaacgcatgggcattttcacgttgacggattaccagtcaccccctacctggtgcctcaagaatgcgggatgcacatgcaaaccagtcaactaaccgtgacccgctcaaccacccaaaacaatgcagatcccgattttcaaccatttagcttgacttttagccaaaccaaaaagccatttgcctttagttgtttaccgtataccgccgcagaacttgaaaatgccacgcacatcgaagagcttccattaccaaggcgcaccgtgctctccatatacggcgcggtccgcggtgtcggtggggttgacagttggggtgcggatgtcgaacaacgttaccacattcccgctgaccaagacattgatttcgatttcaatatccatttctaaataaaagtcggtagtttgcgaacattaaagtaaaaatagccattatgcccgaaactggcataatggctattttgcagctaaccggaacaaattgacttttgtcccacgtttggtccctaccaaatctatatatcgaaatattttttacagcgtctttgggacatacaaaaaagaacttcctcaaatggagaagttcttcttataactaaaatttaatccggtaattccgtattcgataacttcaaaacgttttcattatcttgaacaaggttgcccatgtctttaagatactcaaattcaggcatttctttgttggtgatgactaccattacggtatcatcaagcccagcttttttaattgccggttgccagaattcaatcaactcttcgccttgtttaacgtgatcgccttcttcaacgtactgaacgaaaccagttcctcgcatgttaacggtaccaattccgatatgaattaaggttagaatcccttgatcagagcgaaggccaattgcgtgccgagttgggaaggttgcaaccacttcgccatcaaacggcgccaaaacccgaccgtccgttggttgaattgcaaatcccttacccatgctaccgctggcaaaggtcttgtctgtaacttcatctaagctgatcagtttcccagcaacgggactatggtaaatggttacttcagagtttgtttcgatttctgcaggagtttcatccgtttccaaatgttttgaccaagttttttcgagttcatcaacgatttgggcgtgcatcttttcatctaacttaactttcttaaagaagatgaatgctccagttaaaatcattactgcaggaactccaagcatcatcaatttaaaaattgcttgtccatgggaagtaacgtcaccagctgttgcgccagcagtcattccagcccaaacagctgttaaaccaacgacaccatttgaaatagctccacctaatttatcaagtaatggccgcacggataacgtcaacgattcatcccggtgaccaaatttcaattgtccgtattcaacagaatcactgagtaccatcaaaacaaccaagaaaatcagtggttgtggaatatagaatagcacggcagcggttaaaatcattggtaatgattgacccgcaaaggcaaacattgccaacgcaattaccataactgaaattgctaagaagaaaaccttccgacggctaaatttctttgccaatggaggaaaggccaatacggcgaagaccccaataatggcatttaacgaaccaagcaacgtaaacttcgaagcgtcgcctaaaatgtaagtaaagtaataaagttcaagtgagttggtaattgccattccggcagtgtaaattccgtaagttaaagataaccacatcaactggtcgttacgggccaacactttgaaaacttctttgaacgtagttttttcagtatttttacgtaattccgaatcgttttctttagttccaatggctaccgcaaaagccgaaattaacgcaactgctgcaatgataatcccgaaagccatccagccacgattatcaccctggccgctgttagccttcgttgaaaacattaaaacgattggcataacgacgacaccaacgatgttttgtccgatattggaaccaacccgagcataggttgccgtcttttcacgttctgccgaatcaaatgaaatggcaggaatcattgaccagaatccaacgtctttgaaggaataaaaaatatccatcgtgatatataaaatagcaaaaacgatcaagtacaaaattgggttggaagtgttcaatcctcctaaactggtaaataaaagcgctaaaacaactgaaccaattgtcccaccaattacaatccacggtttaaaatgcccccagcgtgaattagtattatcaatcgcatttccgatcagcggatcaatggccagttcgacgaaacgcaataccgcgataatcatcgtaatatacgcgatcatctttgtaccttgtgccccactacttttatcaaataaatgggaggttacaaacataataaaatatgtcgaaagtgttgcataaaatgcatcatgaccaaatgcaccaaatgagtaagctagtcgtgaagtgatcttacgacccttactttgtttaacttctgcatccataatctctatcaaatctcctttaattatctatgcactaaatgtaatcgtttccagaagagatgtcaatatatttttagtaaaatttgcttaattattttattagattaatcttgaaatgattttccatcctccattaccaagccttataaaacagcctttccaaccacttcaggtcttaatttcaaaacttttaatatattttgcgtagttttacctcgcgcttttaaacagttttttagggattgactactaaaaatttagcaaaaaaaatagcgagctgtttaagaatttaaccattctcaaactgccccctattaaatttaacggattaaaaatgcaccagataatccgttcctaaaacaataattatttcaaatttaaatgtaactaagacttctgggtaaccaactagaccccgccttaacccaaacgttcatattggtaacgaatcgtgttagtaattggttgacctggacgtaaaataacgttgccaaaatcagaatggttaattgcatctggtaaagtttgtgcttcagtcgccaaagcgttgtactcatgagcagcttctttatctggatcaaatgggttagccgtgtaaataaccaaaccgttgcggtcggaataaagtttaatttgccgtttaccatcagtgtctccaatcattgcaattggagtggtcgcgctcgggttaacttcgtaagcatcatcaaattcaatcccgccgttttcgttttttaattgttgcaaagccttttcaaccgacttaggttggttaaagtcataagcagtgtccttaactgcaatttttttaccggtaggcaccttttcttggtcaaactcaagatgggctgcgctcgtaatttgtaaccattgtttacctaaactttcccggtcgtccgtggtattccagtaaacatgattggtaggattaaacagggtggcagcgtccgtattccccgtgagggcgatcgtaacttgattttggttatctaaagtaaacttaatttctacatcgaggttccccggataattatcgtcagttgttttaatgtgcttcgataaaaccacgctgacactatcggcacttttactaaattttccggcaaaatttaacgtattaaaaccatgattaccgccatgtagcgagtgtgtttgttcattcatatcaacttgatattcttggccatcaattttaaatttagccccgccaatgcgtcccgcaactcgtccaactgattgacaaaggcagtaaccaactcgttgataatccgccatgctatccaatccccaaattaatgggcgctcaacaccattttcattaaccacaaattcttgccacgttccaccatagctcaaaactgaaattcgcgtttgttggtcgttgattaacgtatagcgcattacatcttgaccctcaaattgatcaaatacttcttttttagtttccaatattgtgacacctccaaattaattaaaccgctttcaagttcagtataccaaattgtgctatagattgagtaaatattttagttaaaataaaaagtcccacaattactagatcagcttatctaataacgatgcgacttccacaaatattttccctgaaaagttattttgtactagcccgttcaactagttttgtatcgagttcaacccgttgagtagttgtgcgacccgtcaagcgactcatcactaaattcaccgccgtggcccccattaattcggtatccacattgactgcacttaactcgggataaacatacgttgccagcgaagtattgttaaagctaaaaattttgacccgttttggcacttcaattccattggcctgaagtgctttcaaggcacccgccgccatgggatcattagccacaaaaaaagccgcgggaagttgatcaccaagcgtgtcgattgccttttgcatcattttgaaaccagaatcgctagtatagtcaccttcaaatacaaatttaggctcaaaagcaccccgcttctccattgcggcctggaatcccagcattcgccgatcggtcacggtcaactgatgatcggtagtcatttcagcaccatgaataattccaatgtccttaataccgcgttgccaaaaatagtcgaccactctttctgtcgccaactgaaaatcagtaattacgctatcgaaaccagccgcaaattgatcatcatctacaaaaaccaagtttcccgtaacagcggcaagttctttaacctgtggctcgctaaatttacccaccgcaattactgcatcaaaatccggtcccaattcttggagattgttttggaagattcgggttacttcaaaatgattatcttgtccgcgttgttcaattcccatcctaatcgacatgtaatacaagtcgtcttgttcttccgtttccgaataccactgaacaatcgctaggcgttttctggcggttgaattagtatgccgtttgttttttgaataatgtaatgcctcggcggcgtctaaaattcgttgtctcgtttcattgccgactgaaagtgacgtatctttatttagcactcgtgacacggttgctaacgatactccaactcgatccgcaatatcctttaacgttgctgccatgggctaccccctcttagttactcattttcactatatacaaattatcttctttactaatgtactccaattaatacataaccgcagtaacactcaagtaaaactttatcattaaatattggaattggcgactataaacaagcgttttttaacaactcacgcgtattaatttaaaatttatatacctttatatagtgcattatttttcagctttttctgaaacaaattcaccgaattttctctttgcaaacgctttcttttgtgaaataatgaacctgttaaaacataaaagcacaaaggagatttgttaatatgaaaattaaagcagcagttgttgaaaaacaaaacgcagattttaccatcaaagacgatattgagttagcccccatgggtgcggatgatatccaagtgcacatggttgctagcgggatttgtcactccgacgaagccttgcgagttggcgacgcagtaattgattatccaattattcttggccatgaaggtgccggaattgttgaaaaagttggtccagaagttactcaatttaaacccggcgatcacgtagttttaagtttctacgcttgtggtaattgtgataattgtttgaaaggcatccctacccaatgccgtaattatgctgccaacaatctttctggtgtacgtcccgatggctccgatcatttcactgaaaatggtgaacacgttgcggacatgtttgatcaaagctccttcaccaccaccaccgtggttcgggaacggaacgctgttaaggtcgatgacgaactcgatcttcgtaaattaggcccgcttggttgcggatacgttactggttcaggaaccgtgcttaatactctcaaaccgcggcctggtgatacgattgctgtttttggtaccggggcggttggactggccgccatgatggctggtaaaatttctggatgcactaaggtaatcggaattgatattgtggattctcggctagaattagctaaagaattaggcgctaccgacgtgattaatagccgtaacgtggacgtggttgaagaagttaagaaactcacgaatggccgcggggtgaactgggccgtcgacaccactggaatcacccaagtgatggaacaatctatccaagtgctcacccaaggcggaaccaccgcaaccattgccgtcacgccaaatcacattgacctagacacttggaacgacctttgtgtagatgacaagaagattgtgggggtcaacatgggagactcaatcccacaaatcgacattcctcgtttaattgaattttacaaagctggtatgtttgactttgataaaaccgagaaattctttaagtttgaagatatcaaggaagctaatgaagcatcccgttccggagaagttattaaaccagtcttgattattgattctgactacgttccaggaaaataacctactcaaaattaaagatctcgaaaaaacgagttaaacaaaagtcggacagtttgactttactaaagtcaacgcaccaaggtaatttttttcaaaaaaattttatccttaaaaaaggagttctcagttttaaactgaaaactcctttttaatgctacaaaaaaatttttaattactttaaatattttaattcagcttttcgccgtgccgccacagcatcattgaattcgtcgtaagactcatttaaaaccattttgccattaaccatcatgcgggcgacccatttgtttccagaagagttaagggaaacccctaccacacctgattgattacgtgaactagtcactaccgattgaattggattgccatttggatcccgaaaagcgtccttagctcccatttgagcagatatctttcggttattctttaaacgttcggcggatttctcctttcgtaagcatccgcaactcctaaccttgccatggcggagtaaatagctttctgcatccacttttcggccacaatcacattgacaagcccaataataattacctgaagtacttttacggttggtccgtcccgtcaccactagccgtccaaagcgttttcctgttaaatcgtagtgaacttttgtacaatacccacagcttttggtattgccggtttttaaatgttgcaaatcaacattagtcacccttccacaatcacactggcaatgccactgcaatttaccagtcttaggtgatctaactggatactgagctacaagttttccaaaacgttttccagtgatatcgatacggattctcatcgtaatcctccccaaattttggtatcttattttctgtttgaaagtgtctttttagggtacaccctaaaaagacatcaactatcaacatgtataatcattaaatcgtaactaacttttcaatttattgtacaccaaaacactactacttacataaagtaaatctttgcaggtgttaatttatgacatttcagatttaattcggtaaattagcgtacggctaacacctaattttcttttaattgccataatgctttttccagcttctaagttatcacgaatatcaaaataaatcttacgccggttaggatttttaacgtctgggccatataaaacgggccgtcctttgtataccccgcgtttttttgctaattcaattccttgtcgttgacgaattcgaattcgttgccgttctgattctgcttgaaacttcttggtctcgataaaaatgttttgtagaaagtttcgcatattttcatcatcaatgtcgtcaaaggttggtaaatccaggataatcagtttagcttcccgtaaataaacttccataaaaatatgagttaaaaacttattatttcttcctagccgttccatctctaatacataaagctcgtcgccaggttttaaaacatcaagaactttagcaagttcggggcgttcattaattgctcctgaaatcttttctttgtatattcgattaaccccaacttcttttaacctggctaattgtcgcgcaaggttttgatcttttgagctaactcttgcatacccgtatttcacttttcttcctccttattttttgaacttttagggtgtaccataaaaaagcacttcaacaaaattgttaccattaacaatcgctttaagtgttgatgtaatccccttcttaaccttattattggtatccaattgggttgctaaacctttttatattacccgattgcggtacgattagcaagataattgattaattaaccgattctttttagagcctaattatttaaaataactaatcaacaataccttacaaaacttaaatacggtaaaatttgtctactaaatctaattagtttctcctataattttctacccttactcaattgaagcgttttcattagagtggtaacattaaagtgtacaaagttactaaagcgtacctgaggaggtcctcgtaatgaaagaaaactttgattttttgatgccaagcgtaaacttttttggcgcaggcgtaattaataagatcggtgaacgtgcaaaaatggtgaatatgaaaaagcccctattagtaaccgatcaattcttagaaaaaatggagaacggtcctgtagagcaaaccatcaactcacttaaggatgctcaagtagattttgcgatttacgacggcgttgaacccaatcctaaagtaagaaacattaaggaagctaaacaggtttacttagataaccattgtgacggaatcattaccgttggtggcggttctgctcacgatactggcaaaggaactggcataattttaacgaacggtgatgacatcaccaagttagcgggtatcgaaactttagataatccgctccccccactaattgccgtaaatactaccgcgggaacggcttctgaattaactcggcattgcgtaatcaccaacgaagaaacccatttaaaatttgtcgtagtttcctggcgcaacgttcccctagtttcgtttaacgatccaaaattaatgcttggcgtaccaccaaaattgaccgccgctaccgggatggacacctttgtacaggcgatcgaaccctacgtttcgactaaccataatgatattacggatggtcaatgcctccaagcaattcgcttagttgaagagagtttacgtgaagcagttgctaatggagaaaatctcgaagcgcggacaaagatggttgaagctgaaatgctcggtggaatggcttttaataacgctgaccttggttacgtacacgccatggcacaccagcttggcggacaatacgacgctcctcatggggtctgttgtgctgtattgcttccaatcgtggaacgctttaacattattgcttgcccagaacggtttgccgatttagcggttgcgatgggtgaaaatatcgacgggctttccgttcgggaagctgctgataaagcaattgatgccatgcaacaacttaacgacgacgtaggcatcccgcggagcatcaaggaacttggcgccgatcctaaagatttcgaactgatggccgaaaatgcgttgaaagacggcaatgctttctccaacccacggaaagctactaaagaacaaatcgtcgcgttattccaagctgcatatgacgcaaaataatatattaattaaacgaaaagacgaagctgaattcaactcgaattctaaacttcgcctttttaatttgccatctaaaatttatttttttacgatcatttcaattgctcgcgcaatcttttcatcctgggtttctttatcattcgccggattttctaaacaatcttttaaattttcggcaaccatgatgcccttaattcgatctacgctagactttactgcatttaattggggaataatttccgaacattcttttccatccgtaatcattttttgaattcctcgaatttgcccttccgcccgctttaatcgatttaaaatttgttgatcacacgtagccatttagtcaatatctccttgccaagcattcattccaccttcaacattgattatatcaaacccaagctggtccaaataaccacaagcattagccgaacgcgcacctgattgacaaatgacgtagtaggtctgatttttatctaaacttttagctgtatcttgtaaggtgcttagtggaaagttctttgcggaaggaacatgtcccatcccgaactcaaagctttcccgcacatcaattacgtttaccttcttattttcaattttcttcattaaatcttttgctttaatacttttcaatctgttcaacttcctctttcattatcgttttatacaacccaaacgctccatctaaattttcaactttaaatcctttttgtcgtaaaattcgttctccaacgtagcttcgtaacccgctttggcagtaaagaacgtactcctgatggggatccaaaagatcagtgtgctcccgtaattggtttaaaggtatgttggttgcacccttaatccgaccatcccttacaatttcttttggatcacgcaaatcaagtaattgtttaccctttgctaattcggcagatagctcgtgccattgaatatttttacttaatccttcaaccaggttggttgcaacgtaaccaaccatattaacaacgtcttttgccgtgccaaacggcggtgcataagttaattctagctctggtaaatcaaataccgaaagattccctttgattgctgtcgccaacacgtcaattcgtttatcgacaccgtttgcaccaactgcttgcgcaccataaatttgccccgtctttccgtcaaaaatcagtttgagccacatcgcctgactattaggatagtaggtcgcatggtccgtgccgctcacgtgagcaactaagacgttagcaaattcctgtcgggccgtctgctcacttaacccggtggaagccgcactcaaattgaacgcttgcacaattgccgtgccaatactgccccgatttacgcggcgtaaaccagctaatacatctgcaacttgccgtccttgtcgatttgccggagaagctaacggaattaaagttggttcgtttgtaatctgctgcttagtcaccgctacgtcaccaactgcataaacatgcttcacgctcgtttcataattttcatccaccataatgccctttttcaagcctaactgaagtccagcattttctgcgagagcactattgggctgaactccaacggataagattgttaggtcggagttaatctgagttccgtcatctaaaacaaggcgagttccattacccttgatttcagcaactgccttagaaagttggagatctacgttattttttaacaactcttcttccacaaaagctgccatttcagcatccaagttaggcaaaacgtgggttgctttttctaccaaagtaacgtggatcccccgcttatgtaaattttcaaccatttccacaccgataaatcccgctcctactatcgttgcgttttgtactccttgctccaactggtttaaaatctcgtccatatcgggaatgttccttaaggtatgcacatttttagcctgcgcaagcccctcaatttgcggaataattgcgctagctccggtcgctaatattaattcatcgtaactttcttggaaaaccttccctcgatgctgtacttccactattttttcttgagggtgaatactaataacttcgtggttaggtcgtgcgtcaattctgaaccgggcccataatgcttccggactttgaaccattagtgacgttctttctggaatcgttcctgaaaggtggtacggcaatccgcaattggcaaacgagacgtacggccccttctcaaaaacgataatctcagcatcttctgctaaccggcgtaaccgagttgctgctgacatgccaccagcaaccccgccaacaataactactttactcattttacttcccctttcttaccggaccatcccattggttcattcctccacgaacacttttggcattatagccttggttacgcaaaaatttagccgcccgcttactgcgcatccccgattggcaaatcacataaacgggttgatcttttctgccagaaaatcgattaattttatctaagggaacgttctttgcataattaatgtgtccgctccgaaattcaacaggtgtacgtacgtcaattagttcgaaatcctctttacgttctgcaattgcactaatattaatagtattatgtccccaaaatggtagtttcatcctttaaaatacctccatgggtatattaaactatattgctatttttaagtcaaatttaagctgcgaaaaattatttacctttatatattgctaatataaaagaatttaaatacccataatagtattttagttacataaaaaagacaaaatcactatggatttcatcttcttagataaataatcaacttgtaattactttgaatatatttttaaattaggataatcttgttcttttataaagaccctacccaactacgaaaaatcgtaattagatagggtcttcgatttacagaattagcttacgatgtctgagttatttctcaaaagaggagttttacatcactacgccttttcgcaaaatcaaattgccatacagtgctttttcgcccgtctgtacaatggcaaagcattggtgcgaatattcgtaaaaggcggatcgttcaatttgttttaccgtataatttttaaagctttttccaatgctatcccggtacttctcccaaatcggtggggtaccattaggaacgttctgatctccaggtacaacttgcatgaaaattgcctggtaatcagaatagctatctaacggcatcaattttaaaattgaatcaagtaattctggaatcattaagccatctgctcgaataatttttttgttattggacaccgcaggataattggcatccgccaacaagatttcatccccgtgtcccatttccattagcgtctttattagctccggcgatagatttttaggtactcgatttaacattctcattccttctttcttgattcccaataggcttcaatttcttctaacgaccgtcctttagtttctaaaacatacttatggatgtaccaaaccgaaaaggcggataaaaatgcgaagaaatagaaaatatttatgccaacaatacttaggcaaattgggaagatcaacgagaaaatggcatttaaaagatattgagtaaaggtgattactcccatccctaaagcacgcgcttttaaaggtaggatttctggaacatatgaccaaaacaccggtccaagaccgaaaccgaacataaacacgtacagaaaaatcgaaataaccgcgataattacgttatctgaccaaatacatagcgcaatcgctggtaggacttgaccacccaaactgatttctaataatttttttcgtcccaacttgtcaatgaagggcaaagaaacgaaggtcgagactactaaagcaattcccaccccaaaatcagcgacgatgctagaatttgccattcctaaattatgaaaaattcccggtgcatagtaaacggcggcattaattccggtaaaaacctgaaaaatagttaaaataattagtaacgtaagggctggccgaaatgtgccaaatagttcgcttaaccccgcttcttttgttttcagactattttgaatatctttaatttcagattccacttctgtactggtgaaccggactttagtcaaaacttttcgtgctcgttcaactttgccatcccggattagccaccgaggactttggggactcattaccatcccgattgtcagtatcagggctggcaccacccctagtcctaaagtccaccgccaatcatcttggggtaaattgtatgctccaaccgcataagcaactaggattcccacgttaacacttaattggtaaagtgaagacattaaccctcgaatgtgagcaggtgctagctctgataaataaatcagaccgtacatatttgcaattccggccgcaattcctaaaacgaaacgtgccatcatcaagaaaactgttcccgtcgcaattgcacttagcaagctccccgctaagaatactaccccagcgacaatcaaaacgttgcgtcgttcaattttcttttctaacgcggtaaatacgacgattgaaggcaacgcgccgaaaagaagaaagctaaccaccagccccttttgaaccgaatccaatccaaaagccgtagtaatcgatggtaacgccaacgaaatagcccctgagtcatacccgtaaagtaacccggcaaatcctcctaaaatagcaaataggtaaacaatccccttcgtttttggtttagtagatagattttcttccataattattttccttccgtattatttgcagctaatatcctcataaattgggcatacttctgttctaaaccaggaatttcagttggattaaaatcttgtacatcaaccgtatttgctaaaacatctagtttaaccgggtcagttatcttaccgagaatctttaattgggcgactacatttcccaaaacactggcttcgactggtccggtaaccaccttgcgctgtgtaaaatctgcggttagttgaactaataactggttttgaatacctccgccgaacatatgaactttttgcaaggttgttccagtaagtttttctaacttttcaatcacctgtcggtaggaaaaagctaaactttctaataccactcggatcaactgtccccgatttttcggtaaagtttgatgggtttctttaagaaaggctacaatcttttcttccatttgcccaggttcggcaaaacgcacgtctgctaagtcaataaaggaattgattgagtacgcttttgcagcttcatcctgcatcttagcaaagcttatctctgcacccgtatacgtccattctttttgtagttcttgaattacccacaagccggtaatgttttttaacacccggttagaaccatcaaaacaaccttcattcgttaaccccatttcaaaagccgcttcgctaatgattggctggtcattttgtaatcccacaatcgaccatgttccgcaactaataaatgcggtttgtttacgttccgcttcgtttagtggcaatgccattaaggctgctgctgtatcatgaccaacacctgaaataacccgcatttcagcagaaaccttaatctcttcactaattgcttgacgaatcggtcctaaatcggctcccccaataacaacgtctgcaaaccattctgctggaatttccagcctatttagaacttttgtattccaattcttagttcgcacgtcgaggagtcccgtagtactggcaatggtaaattcattttgtttgatcccgctaaaaaagtattcaatcaaactaggcatcattaacaactggtcaaccgttcgttttaaaaagggggcccgttgcaggtctgcgaaaacttgcagattggtattgatccgatctggagtgtttccagtcattctgaacaattgcttagctggaagtctttctgcaaattctgcttcataaggggccgtgcggctatcccgataacaatgaggagcaaaaagtacttctccttccttagtcaacaagccataatcgacgccccaagtatctacgctcaaactatctagatgtcctaggtctcgcattgttaacgctaaaccacgttttacttcctgaaaaatctttaaataatcccaattaagtcggtcattaatctcgacggggtgattggaaaatcggtactgctcctttagtttaatttgttttccatcaaactgaccggaaattacgcgaccagaactcgcccctaaatctactgcaattacattcactttttccatatttcatcacacgctatttatataaaggacctaaaatttgacaagcattaaagtctgctgcttcttgattttccgttccaatcaatgaccatacccgtggacggaaaatcttatcttcggacacgttatgcatgttaactgggatccgtaacatggatgctaacgtaattaaatctgcaccaatatgtccataactgattgcaccatgatttgctccccagttatccattacgtcataaacactcttaaacgctccgtgcccggttaaaattggcgcaaagaatgttgaaggccagcctttatcagtccgttcgttaatcacgttaaagacttgttcaggtaaatcaattgcataaccctccgcaatttgaagaactggtcctacacccttaactaaattaatccgtgacatcgttacgggcatgccttgactaccacctttagtaagatagttgctagagaagccgccaccccggaagtaaccaatatttgcaggaatccaacgtgttttttctagactacgttttgcttcatcttcggtaacttgccagaacggtttaatggcagggttgccatccactttttcctcgccagtcgcgtccaaggtttgcgcgccagagttactgagatgaaggaaaccatcttttcctaatccggttaactcggttccagtaacccgtttgattgcttcgggactccagaaggtccgtacgtcggcaaaaatttgaggtgtgttagtcagtaagtagttaagcaacatcgaagctccatttaagctatcgttctccgttgcaaatacgtgtggcgcatggatgccattccagtcgaattgagagttcaaaaaggcctccatgtaatcgccgtttggaaaatgatcggtccattgccgttgtccttggaatcccgcagcaattgcattatgtccgtcagcttcttcaacaaatcctttttcagctaacttcgggttcccttccattaagtctcgagcaatgatggccatcttaacgcaatcggccaactgtgctttcttttctttgtctgtaaatcgattaggatcatcactattatatagatctggtccgattggagtatgtttttcagcccatttcatggctttttcaaactcttccttgtcataaattccttcatcccaacgccgaactatttcagtcatgtccacatattcgtttcgcatacctaaatagttttggaagaaatcggcgttaaccattgaaccaccaattcccattgctacgttaccaatcgataagtaagatttattgcgcataatgccaactgcaagtattcctttagcaaaacgaataagcttcttggcaacgtcatctggaattgatttatcatcagcatcacagacgtccgctccgtaaatcccaaaagcaggaatccctttttgcgcatgcgctgctaaaactgctgctaagtatactgccccaggacgttcagttccgttaaatccccaaatcgcgtgaggaatgtcagcggtcatgtccattgtttcgcttccatagcaccagcaaggggttaccgtgatggttccacaaacattttccttatcaaatttttctttcgaagctgctgcctcttttactcccccaatagttgagtcagaaatcacggtttttaccggcgtgccatcaggataaaataattttgattccaacagttcagcaaccgctttagccatatccatggtttgcgtctctaacgattcccgaatccccttacgccgtccgtcgatagttggacgaattccaattttgggataattaatttttaacatgtcctaacctcctaaagtatttaaactgtttgttaaaagaaatacataatttcttttcgtcctcatagtaaccgcttccataagtgtttggaaggtgtttcacgtcttctgaaagttcttcatattttttgcatctttttgttcaaaagcattcatcattttcattcatttaacaaaaaaaccgggaacatcccggctacaaaattatttaaatttttaatacaaaacctccacgtttttatgggaccaaaccgccataatttcttccggtggctgttgatccatgataataacatcaaagtcatttacatcgcacaaccggtaatatcctttcacgttaaactttgaatgatcacatagcaaaattttcttttcagcattttccatcattcttcgtttaactcccgattgttcttcactagacatataaacgtcgttagcattaattgaagaacacgataaaaacactaagtctgctcgaaaatcactaaagaaatctagcgaaatatcgcccaaaattgaacccgtccctgagcggagtcgtccgccagcaatgaaagtttttaccgccggaatttcatccaatttgattgccaattttaggctattggtaactaccactaagttggttaatccttcaaaaaaaggagctaaaaaggacgtagtgctgctggaatccacaaaaatggcctcgttgtcccctaaaaacgtacttgcaatttcagcgatgtatttttttgattcactattttcttgttggcgaaataaaaaggacaactcaatattatctgccttaactaattcgacccgcccaaattttcgggtaaccttacccatcttttccaacgcaattaggtctcgccgaattgtcgaatcactaacaaaaagttctttttgtagatctttgattcgcataaccttctttttttgtagcaaatctaaaatagtcaaaaaacgttcgttcttaaacattgctttcctcctcgattttcattattttattgaaaatgaagacttttgaagcattctgaatgaaattcctcaattattttgaaggcatttcataaatcaaagccagccctaattttcaatacatttgtcagtataatgaggccatagagtgatttaacaccttgaaatttaggaggaatttaattatgaaaatgatgtttgaagaagaacgcattgacttagcccataccgtacaaaaaatgtttgatcgtaaaaataccaacgtagcaggtggcaacatgtcgatcaaagtttttgaccaaaaaatgcacccttatattatcatgactcccacctttatgtcagaaacctattattccgaacttcatgctgcacaaattttggtgattgatgaagaaactggtgaaaaaattgacggagttggagatgttactcgggaaattaacatgcataaagaagcttacaaagctcacccaggaattcgatgtgtctaccattcccacgccgaagaatcgatgttttggactactgctggtttagacatgcctaacgtgaccgaagcaacgcgggaattaggacaaattaaagtattacccttcgcccctgccactagccaagctttagcggatatcgtattcaaaaaccttcaagcaattggagacaaggctatggaaaacgtctttttattaaatagtcacggcgtagttatcaccacgaccgatttgcacgttgctgctcgtattctagaaactctagaatggaatgccaaaatagcttaccaacaagccctttttattaaacttggtctgctatccgattatcgttcttgcggcgctagttataaagaggcccttcctagtgttccaccaattgccatgcctgaggtcccaataactgccatacccgcaaagttcccgccccaccctcaacggccggcaaacctaatgtaacttatcaatattgttgcattgataacaatattttgttcaccacgccgttaagtaccttccaacaaaaaaagttggggattgatttctccaacttttttactgttataaaattcaaaattttatttatcaagagcattggtagcagctgaaattaattgattttgaggatccaatgatagttcccataacatcagccctcctagtcgctgttgttgaacatacttaactttactttccatagacttttcgtcatcaaaggacctgaatacctgttcatcaaagtaatatggcgcttttgctttttcatcccaaaaatagcattgtggtttttgagcaattaattgactaattttttggtaaggagtagtttgggtccccttttctttagcaagcgcccctactagggatggggcctgctggtccactcctcgccaatcgcggctgtaagctgcactgccaattactattttatctgttggaacttgcttagcgattagatacttaaccgtggtatcgatactaagctcaccttctatggcatcgtaaggaaataggttagtttggtggcccgtaatgttagtccaacttccccgtaaatcataggtcattacgttaaggtaatctaggtactctgctatgctgagtttttcaccgtttgtcaaactagttaataaactgggatctcccgctattgcagcagagatttcatgttcatcactacaacttgccaatttttctcgcaacacctttaaaaaggcataaaaattttctgcatcttgagtgcgagatttaattcctcctaatgcagaaccaggatattcccaatcaaagtcaactccatctatgccatattgctgtataaaattaattatattggttgcaaatttatttcggctatctgcgtttaaaacggcatccgaaaagccttctgcgccccatccaccaatgctaatgttaacctttaaatttggaaaatgttgctttattgttgcaatttgtttaaagtgggcccctttatccactaaattaagcccctcgattttcgcaaacgcatagtttatatgtgttaacttttctccaggaatttgtttaattttccaattttgtcttccatgtaaatatcccattattaccgtcacgtgaatccctccgatcctgttaaagaaagcgcttgcaaaaatattttaatccattatactactcttgaatcgattcacatttatttttttcactatttttgaaaagaggtgcagcccgtgcttaccaaatacattaccaaatggttaatccccgtagctactaaagtgtccgaatcacgccacttagttgccatccgggatgcctttattgatattatgccaatcattatggttaattcgcttttcattttacttaactcgttagtttttactaacgcaactgtcgtaaaagctttcccctatgcgactaagttagtagacattggtaccatggtaaaccaaggaactatgggaattatgaccattctagtttcatttttgattggttaccgactcactaatttttacattgctaacggccgaattgattctaaagaagttaacccgcttcatgccggaatcttgagtttagcaactactttaatcatgtttcctctatacaatgacgttattcccgtgggggccactaagcccgtccaagtcgctggtatttatgcccaaacgttaacttcttctggaggaatgtttgtaggaattatcgcggctctattaagtaccgagctactagtttggatttctagtaaaaagaagtttcaaattaagatgccagattcagtacctcccgcagttgctcaatctttcaacactttaatccctgaatcattagtaattatcttatttgccattctaacttttacctatactcaaattgcggggcaaaacgtaccacaattaattaccgacgtaatctccttgcctttacaagttgctttggaatctccactaggtctctttgtagttcaaattttaacccaaatcttatggttctttggattacatgggcaaaacattgtttcttccgtaacctctccttcgatgttagttgccattcaacaaaatatcgacgcatttaacgctggccatgccgttcctaacattgttactaacccttggattggcatgtatacattattgggaggaaccggggcaattttgcctttcttaatcgccattttctggggttctaagcgaaaagactaccgcaacgttgctaaactcggactgctgcctagtttctttaatatttctgagccaattatgtttggaatgcccgtcgtaatgaatccctttttcgcagttccgtttttatttgtacctatcattaatttagcaattgcctatcccttaactgccttaggccttgttgctaaaagcgtggtaattccaccatggacgttaccgccaatattaactgcttgggtaaccactgcaggagacttacctgccaccttactatccgcatttttatttattttagatattttcttgtatttaccattcgttattgctagcaaccgtagcaaaaaaatttaatgtaggttatatgaaatgaaaaaaattcgtcaggatatcgttgaaaaccaaaaaaccgctgttgaagaatacgcttcgcttactaattcccaaaagcaacaacttcgctggtttcaagaccagaaaattggagtcatctttcattggggactttattcagcagctggaattgtcgaatcatggcaactctcgaaagaagatacctgggctcgcaaaaagccttggagaaaagaccttaccacccttcgccatgattattggaacttagccaaagcgtttaacccagctaaatttgatcccgaaaaatgggctactgaagttcaaaaggctggctttcgttacgcaatttttaccactaaacaccatgacggtttcaatatgtacgctacccagcagtctgattttaacgtaactcattacactgggagggacttatttcacgaatttgccaaaagcttgactgcccataacgttgcggtaggtgcctattattctaaagctgattggcattgcccttattattggacacctggatccgaccctcgcggacgttatgcctcatatgatcccctttctaatccgcaactgtggaagaaatttaacaactttgttaaaaaacaattattggaaatcacccgaaattacggcaaaattgatattctctggttagatggtggttgggtaaatagcgaacaccatgaatttttagatatggacaggattgtctcccaaatcaaacaaacccagccacaaatcctagtcgttgaccgaaccatcggtggtaaatatgaagattacgtaactcctgagcgcaaaattccggatgtaattccgcataaggtttgggaaagtaaccttcccttagccaaaaactggggttacgttcctaatgacgtttacaaaacatttccagaaatcttacattatcttgtaaagattgtttcactaggtgggaacgtcatcttaggtattggccctaaacccgatggcactttaccaacccctgccttgaaactgattcgccaattaggaaagtggttagcaacttatggagacggcatatacggaactcgcgccctccccaacttaaaacaaaccaactggtactttaccgcgaaagaccattttctttacgcttttgccgaaaaaaaatactttcgtcctcaagatttacaattaggaatttttacgcctcacgtgcttaatcgccaagatctgtccatgcagaatccagatgacccaatccttggtttaaaaattactatggacaaaaatgtcaccgaactgacttagatataaaaaagcgtttgaactcttcatgtagtggcccccaaaaaattttaattttttgggggagcagcacatcattgttaagggttctaaacgctttttgtattctcattttagttatctaacttaaatactttctcattaagtacactggtgtacaactccaagcatggcaatagctattaaccattgcactaccatatggggagtaacttggatcattgggatcaaatgcttcccaaaacgtgtcggcacctaattcaatcatcttcccccagtaatctttcaatagttgaattcctgcatccaacaatcctgcttcaaaaagtgcttgggttacgtgatgatacatatacggagttgcaatccctttaattgggaatagttttttaactgcgttgctcattaattggtgattttcttccggagtcattacttgagctaaaaccatccaaacttgactagcaatgttaatttcatgatcaggaccagaaataaataatcctctttcttcgttatagaggttttgcttggcataatttgtaatttgggccaattctttttggtagtaatcaatcgtgtccaatttttgaagccgtgataaatggataaactgtttcaaagcgtatattataatggcaactccagccgtatctttattaaattcattagaccaatccacaaaaaccgggtaatcctcatcaaatataattttgccattactctgaaccatatttttcataacgtaatcaatttgctttttctccactggatataagtcttcaagtactgtgtaatcatccgtgtgttgaaaataatcatctaagatactaacaaaaaacaaactatagtcgagcaagaatgtgtcatctggcgtataagttggcttaacaaatacgttggcaggaattcgcccatctttggctgccaatgcaccaaataaatataaacatctcttaattaaggtttggttgtcataggtttgataatccgctaaagcttgtaagcgtaagtccccgatccaaagccgtcgatctcgtttaggtccgtcttcaaaaacgtcttgcatacagtccgcaagcgtcttcagccccacctgatcaattttttgtaaaagtttatcatcagtatgaaatggggttggcgctccttgtgccgcactttctgcaattaaggctggttcaaagaaactaacttgccacttaggagaagtatccaccactttaatttcaacataacgaaaactgtaacgtcttggtaagcacaagttggcaggcaattcgtccaaatgaacagtttcttcttgcatccatgaacggcttaaccagccttgataatcttgactatcttggtttaactcagtaggaagctcggcaaatttcaatttaagcgttaagggcgcatccattggtgatccgactgatttaattcgaattgtaaagtgcccaacgtaatgattgccaaaatctaaaatcaaccgatcgtcccggccaaatttcatttgactaagctgtgtagtatcagccgctttttttgttccaacattatctagtaaatttttatcgatcaccgtttcaactacctgcaccggagttactactcgttttgttaattccggaatgttgtcatctgctttttttagtaactgtttgtcatgattaaattctacatcatcattaatttgaaatgtaaatgccatcgccactcactcctcaacgttaatctggtaccttttttgtaatcgaatcattaccaatcccgcaattagacatacggcaacaattccagcgaacccaaacatagtcattcggatgtggcttggtaaaactaaagtaggggtaatgaatgcaagaatcccacataagaaacgggaaaagccactaataaaaccttgaactgaagcccggctatcaattgggaatgactcttgggtccaaaccttatacatagcttcgccagcaatgttattacctaggttataaaaaccaatggcaataacaattggccacaatgcatggctgcttaatgctaagcctagcatggctagtagctcgataactgaacctaccacaaaaaatttgttgcggtaccgactacctgctactgaggcaaatgatattgacgcaattaaagccactacatttaatactaatcctgctcctgtagcaaaactttggctcgcgtgtgcttgtaccaaagtaaaagtttgaaattggccaaatgtattcgctaacaaattccagcaacaataaaaaatcatgatccaaataaagaataacccatactggtgattttggcgcaaaattttaaatagcgaaccagattcagaagttctttgagactgcatttggtcaatccgttgattggcttcacgatgaaattctttaaaacgaccagaaaaagtgcgccaaataaaagtgatggcagcacatactgctaaaatcgtaaaaacaattcgtgccccagttgccccagtcattttagaaactacaaaggcacaaccataagagaaaaacaccccaatttgccaaaaaacttgggtgaaggacactaaccgagccgttgctttgtcatcaggaacatcatgagaaataatcgttaagctaactggtaaatccgctccagaagctaatcctgcaataatcactcctgttaataaaaagccatagctgttagctaacacacaaattagtgcacctaccgcatagcctaaatttaaccagttaaatgaacgggttaatccccaatttttggttaaccatccggcaactaacgaaccaattgcaaaagttaatgctcctgaaatcaccccaacttgggtgttagataatgctaacccctgttgccacaccgtaattgttgctgataatccaacaatgatccccgaacctaaaattgagccgattccagctgcaatagctagaggacggtattttttcactaaattatcactttgattttgcataaatctctcctccttaactatcctcattgtaagcgcttaaaacaagtgctacaatatctccagtccacccgaatccttgcaaaactacaggtaggatcattaaaaaggagcagctaatgataaattttattaccttggataaaaaaatacgtagtctaaattatgtagagaacactcagcgaaaaaatcacgctaattacaattatatgaagctcaattttaaggaaagccccatccctaaaatgccaaaatacaatttttttaaacatggcgatttaaccattgttaaaggaaatcgtttttcttacgttcccgcgcatactcatgatttcatcgaacttaactacatgtattcaggtagttgtattcaatcgctaaataacgagcaatttgagtttacagaaggtcaactacttttaatggataagaatactgttcaaaaaattggctatactggggaaaatgacgtcatcattaacattttgttaaaaaactctctaactatcactaaaatattggacttactttctggtcaatccaacgccgtaacggactttttgcaaaattgtaacttaaaaactaccaaccataatttcatgatttttgatttacctgcacaatcattgtcgcgtagtctgattatggacttattattcgcagcctttgaatctgcccataaaaataataaccaagtgctaaaattgctcttttcaaccttgattacgcaattaccaccgttagttagccatcaccatctaaattttgcggcagacaacaatgctgaattattggcaattttaaagtacatcgaacagcattattcaaccactaatttgcaatatacaagtaaacattttggatacaacatgaattatctcagtaataagatcaaagcagcgactgggcaaacgtttaaagaattaattgaacaacgccgtctatatgcagcccaagaacttttatttcaaactaacctatcgcttgaccaaatttccttgcgaattggttataaaaatccttcttccctaaaccgattgtttaaaaaatatgtaaatactacccccattaactataaaaatgaattgattaagaatcgcgatgatttatattgattaacaaaaagcggtcgtcaggattacccaaaatcctaacggccactttaattattaagaaaaattagttgaaagttttatccaaccgccccttaacacttttagacgactatataacaccaagcctatcttttgaatcacaaatttggatccatcttaaaggttagcttcgataattccgcaccctgcttggttaacttagctaaaagtttcttggtttctttattataatgttgcgcaataaggtgattttgttcagtaagatattttgtcaattcttttcccgacatcttcttagctacttggtcaacttcttcaatcttggtccgtgcccattgcgacaactctttttggtaatccaaatcgtcctgaataaattcagcgtagtgagattccactaccattgctaaagtttcatacaaccagtatgcactatctaatgacatctcttccggtaattcccggtaggaaacgtcagtatcattagcattggtaaagaatggtacgtgtgggcaaaaacttggtacgccaaagccaatccactgaactccagccgcttcattttcatgactattccgcatttgcaaaatatgtgaattggctgttcgagataaggaaattgcccggtacgtcttccgatcgtgttcgctaccacttcctaatgggtcgtacttagtttcgttatagtgcgacttcagaatatattgaatatcttcaaccgaaatctttcgactagctttccgaataaacggtagatctggtgattcaggatcttgttcaatctccgggtttaagtaacgttgagcaaaccaaacccgaggagtattgtaatgatgatccttttccgtatccgttccaaagatgtgccggaaattccagcgatcttcgtcaggattcaaaccatgcttttcgacaaattcttgaataccatccgcccacatgtaattgtcaggatcattgaagtcaatgtcttcaatcgcgatttggttagcagccacggcatagcaatcgtccggaatccgaacggcaacccattgatggcccgtaacaatctccatgtaccacacttcgtcagcatcattaaattggacgccattaccttctgctgaaccgtactttttcaccaattcgcctaggtaacgaaccccatcccgagcagaattaatgaatggtaatactaacgtagtcatggaatcttctgctaaaccatttttaacaaatggatcgtacgctaaaactcgttcgttagcgtaaacactttccgtggcactttcaccaacgtttttttcgttaaaaccgtcttcttcattaggcccttcgctctcatcagcgttaggtgttgaagtataccgatagccactttcaggcaacggtacagttaatccgttatatggtgatttataaatttcttgtcggccggagacggctggttgaaccaagaagcgttttggatgaatagctactaaccggtcttcatttctggaaatgtaggttgcaccatcgagcgaaaccttttttccaaccattactgaagtacatgctgacatttcaattctatctgtcatgataaatcctccttttaaatttctttaaactcgttcaataatttgttcgttaacctctagctgcttcaaatacaataataatcgactatacaaatagtcattggcttcctcgaactgttcgcctaaattctgaccaatctcatacgcgctgcgttgcccatcaatttgttgaaatacaaaactaccgtattcatctaaatctaggtaagtaaactctggaattttaaaatgcaactttcgtaaaaattgttgaatccaatggttttgagcacgaataatggtcacctgtttaccttcaactttataattaacccgcggattcttcttaaaaactaattcttttagatcagcatccgtcagtttaggtgacttactcacgttcttcagccttcccttgattttcagattttttaatcatatataacggaattacaatcgctcccgccatagctgctagtagtattaatcccattgcgttgcttgctaaaaagccacttggtgcactattacccagcaatccggtaacgtggaaaataattccaacaaggccaatgattgaaccaccggcaattagtccagaagaaaggctgacaccgctttgtacccgtttgtcacgtaactctttgtctttagtagtcttattgatcaaaagttttaataatgcccctactaaaataattgaagtagttgaaattggtaagtaaaaacctaacgcaaccgtcataattggtaagtctagcatccagaaaactaacgccattacaatcccgacaatgatcataatccatggtaaatctccagacatgatgccagacgttaaagttgcaattaagttagcttgtggcagtccaaatggcgggttagaacccgtgatccgcaattgtggttccaaaagtaccgtagttccaattacggtgagcacccccacaaagccagcaatcatgtagtacttcatcatttccttgtttgagccaccaatcatgtagttaactttttgggtttgcatatatccgccaccgactgaaaccgtagtaacgataaataccccaaacaaaagcaaaatttctgtgtaatttttggtagtccagcccatcaatacgaaggccaaagtcatgattactagcgatgcaatggtcatccctgacactggttcgttagaacaaccaatcgtcccggctagtcgtgcagaaacaattacaaacaacaacgataaaattagcgttaagaccccgccaagcaaggcaacgataaccgatcccgaaatgataaagccagcaataaaaatggcgattaccgatgctaataaggcaattaaccccaaagcatttttatcttcagtagtactattccgcgcattaagtacttttttgattgaagtccaaattactggtatcaatttaactgcaccaataattccgccacaaagcatcattcctgcgccaatatacttaacatacgagcctgcaacatcgtcaacgctcatttgggagatgcttagcgcggcatcattccaaacgtgtgcaccgcttcctgccatttgtgcaaagtaactaactaaaggcaccacggcaaagtttgacaggattgaccccgcaaacatggtcattgcaacttctaaaccaaccacaaaaccaattccggctagcataggattaacttctgtcgacatcttccatcgataaaacgagttcccggtgaaagtgatcatgctatttacccaaccaaaaacttgagaagtaaataaagtaattaatcccccgattccaaaacctacccctaggaattttaatgaatctccaccgctttccgaagcgactaacgcttcggtaatcgccatggattctgggtaagcgaggcgcccatgttcctcaacaatcaggtaattttgaactaatgatgcgctcccaatggcaaacattactgccaaagcaccaaccattaccccagtgaaaaaattaacgtgtccgccaatcaagataattgctggaaggacgtaaatcatcccactcgcaacggcttctccaccactagacattccttgcaaaatatttttgccaagaatcccctttttcttagcaaaaagacttactaaacccgaaccaatgattgacccaggaatcccagctgctaccgttagtccagctttcatccccgagtatgctgttgacgctccaaagattacggctaaaataattcccataatcaaaatagcaatacttccgccatgcccctttttagtaacgtaaggaacgtacttgctcttaccattaccaccataatctttcttagaaacattttgtgccatccaattcaatccctttctttaacaaccactaatacctaacttttgtgaatcaattatcatatgtttaataatagcgcttccacctattcttatcaagtaacgctactgcctaaccattgtctactaaaaaaggcagaaagcctccctgactgggatagttttctgccatttcaaacacaaaattatttttcactcttaaaattttctggatacttattttttaaataatagtagaaaataacccctactgcggtagctacaatcccaatcgctgtcgtagtaaattgtgtgaagagcgtgttaaccaaaatgaaaactcctcctacaagagcaattgccggaattactggataaagcgggaccttatacggtcgatttgcatttggtgtccgttttctcaaaacaaataccgccacaaaagccatgcagtagaagaaccaaattacgaaaattagcatattggtaattgcatcaaattgaccagaaagcatcattaagcaagcaatcaagtattggataactccagctgcccaaggcacccccgcttcatttaatttagcaaaaacatctccgaatggtagtttatgttctttacccattacgtaaggaattctcattcctgtcatagtgtatccattgagtccaccatacactgaaatcaagataccgattgtaacaaatttaccgccgataccgccaaaaataacctttgcaacgtcagaagcaatgttcaaatttccagcaacgtgattaactggagcaatgtagaggaatacggcattaaccaacaggtaaaccaccataatcagtccgattccaagagcaatcgctttaggtagatccttacgcggatttttcatttcaccggcaatgttaccaacgtgaatccatccatcataagcaaacatggtcgctaataatccattccctaaagctgtccaaaatgcgcgatgtgggccagctacaactgggaatagtgagaagttaaccgaactactgtggaaaaatcctaacaaaacaattacggctaacgggatcagcttaaccactaaagctaccgatgttacccaaccaccaaattttgcgctaatgcagttaactaacaataatgaaagtgcagtaatgattgctacaggaactatccatgtttgcgaaagattaaataagttcgtgaactgggttccaaacgcaatcgcaatggccgctacgttagcaggaaaataaataattgcttgtgcccaacctgctaaaaatccccaaaagtgaccataagtatgttcaatgtaacgagtcagccccccagtttcagggaacatcgccgctagctcagcaccagtcaacccagcgcaaatactaattagtccacccaatagccacgcgaaaagggccattgagaccgtcccagtatattcggttaccgcggctgccttaaagaatacgccggtaccaataactgttcccataaccgttgctaacgccgggaaaaaaccaattgtcttttttagagatgtactattatcattcattgataatcactcctcattgttccaattttaattattttaaaaaagggacgctgcaattcatgcagcatcccttagattttcaatctgcaattgcttgcctaatcattctatccaatcccaactttgtgtgtatcaactggggagaagaagtgatcaataatttgtgaaacacgttgaaggtcaacattaccaccggatactagggcaacgactttcttaccttcgatccatttcttatcaatcttgcctgcttcaagtgcagcagttggtaatgcgccagcaccttctgcaacaatcttggtgcgttgcatcaagtccttcattgccttagaaatttcttcttcactaactagaacaatttcgtcaactaacttagaaacaattccgtaagtgatgtccccaggaacagctacatcagtgccgtcagcaagcgtaaagtcgtcgtgatgctttacaatcttaccagcatctactgaagctttcattccgtgaacgttttcggattgaaccccaactacgtgaatggaagggttgattgacttaactgctgtggcaattcctgaaatcaacccaccaccaccaactggtacaatgatggtttctacatcaaccaagtcttcaagaatttctagaccgatggttccttgaccagcacaaacgagggaatcgttaaatgggtcaacgatagtctttccttccttttcagctctttcatgcatccagtcgtgagcatcatcgaaagttgctccgtgaatatcaacttcagcaccgtaaccccgcgtagcatcacgcttcatttgaggagcttcgtccggcattacaaccgtggtgtcaattccagaaagtttaccagttaaagcaactccttgcgcatggttcccagctgaagctgtaattactccatgctttttttcttcatcagacaagtggttaattttattattagctcctctgaatttgaatgaaccagtaagttgcatattttcaagttttagatatacatccgcatgagcaacattgttacttaaaaacattgactgaactaatggcgtccgacgtgcgtatttaccaattactttacgcgcttcttcaatttgatctaagtttaataaatcgtaggtttgagcaactacttcatttcttggttcgttatttttcatgattttcacctcataatttaaacgcaaatttaaaagttcgaacgcctatttatacatctagttcagtgtaaggaaggtctaacgaatctgcaagacccttgttagttaccttaccttcgtagaggttgaccccagatgctaaagctttatcttccttgattgctccttcaattcccttatcggcaatttccaaaatataatcaaggttaccagctgctaacgccatcgtagcagtccgtggaacggcaccaggttggtttggtacagcgtagtggattacttcatccttaatgaagacagggtcatcaatagtggttgggtgatcaatggtttctactgttccaccttgatcgatcgcaatatcagcgattacagagcccttcttcatgctttttaccatgtattctttaaccaacttcggtggcttggaacctgggattaaaattgtggatacaaaaatatcagcatctttaatttcttttgcaagattttcttcgtttgatttaactacgcgaacgtctttacccttatattgttcttccaattgagcaatcctgtcgtcgtttaactcaataattactactgagcatcctaaacctaaagcagtgtctgcagcgcctgtcgcggcgttaccaccaccgaaaatcactacatgtccagcagggataactcctggaattccagaaactaaaataccttccccttgatgttgtgcttcaaggtaataagctcccatgattactgaacgacgtcccgcaatttggctcattggtgctaacaactctaatttaccatccttaacgatggtttccccaccgattgcagtaactccggccttcatcattgcttcaacagttggtttggaagatgcaaggtgttggaatccccaaataattttacctttatcaaagtattggtattcttcagcatcaggttctttaaccttaatgcacaattctgctttccatgcatcttcatgagaaacgatcttcccaccagctttttcaaattcttcgttagaaaagcctgcaccgattccggcatccttttcaactaagacttcattaccggcatcaaccatcttttgaacattttccggcgtggccgctacacgaccttccccttctttttgttctttaataacagcaatttgcataaagacacttccttgtgatttatttaactacaagtatattattgcacactttaatcaaagaagtaaagcggttgcataattaaaatccaattaatttatttagatttaattataaaaatattattaaaaattttaaatattacgaaaaagcgttgagataacaatatattaaatctaatccaattcaaatttttatctagttatgatactcatattattaaaaaaaacaaaataatggattcacattcacaaaaaataagtacttaattaagctcctaatcacgtaatgttgacttcttttcctagcttatttttctacccttatttttaaccctttatcgaatcataataaaagaaccgatcaatcaaattgatcagttcttttagaaatatttatcttagtaaacaattatttaatattaacgtatgtcaatccaaacatgttgctgaggtcttgtaattgttcagcatccacgttgaaggaaagtacggtatgatggccaccaccaagtgtgagccagccttcagcacccttcttccaaccttgttttggagtccagagttgtttagcaactggaagatgtggtgtttctttttcaggcttgttgccttgaacatcgtaagacatgagcttgaattcatcgccgtagtcagccatcgtaacgtcaaccgcgtcgccttccataccagtgaagacaaagcgtgcagggtcatccttgccaccgatgtcaagtgggtgaacttcgacccgtggagtgtcactagctaacgttgggtcaacttctagcatgtgtgagccaaggattgcttcgtgtcccttacgaaggtcaagggtgtaatcttccatgaaggcagtgtgttggttatgcgcaatgatcttcattaagcgatccaaagcagcggtcttccagtccccttcaccagcgaagccatagccttcagccatcaacatttgaacagccaatcctggaagttgttccaaaccagctaagtcttcaaagttagttgtgaatgcggtgtatccgcgatcgtccatgaatttcttcaatgcaaagtattcacgaatttggtacttagtattgtgttcgaatttttctgaagaattttctccttcaacgaagttgtattccttcttcatttcttcgtacttattgttgatgtcgtcttcagcaacggcgttaacttcctcaactaagtccgcaactccccagtaatcgacggtccagccaaatttaatttgtgcttcaatcttgtcaccgtcagtaaccgctacgttacgcatcttgtcagcaaaggttactaccttgataccaaatgattcattgtagccaacggctgcgtccatccatttagcgatttgtttttgaatgtcttcatcaccccagtaaccagtgatgatcttgttgttcttacgcaagcgtgcattaataaatgcatattcacggtcaccatgagcagattgatttaagttcatgtagtcaaaatcaatggtgtcatatggaatgtggttcaagaattgggttgctaagtgaagcaatggtttttgcaataacttagtaccgcggatccagtttttagctggtgagaaggtgtgcatccaggtaattaccccggcaactttgtcgttatagttagcatccttcattacttgagtgatgttttcagcagtagttgctaccaacttgaatttaactggataaggtaagttcttggattcatttaacttatcaacgatttcgcgagcgtccttttctactgaacgaagggtttcttcaccatataggaattgactacctgtaataaaccaaaattcataatcttgcatttttttcatgttaaagcgctccttttctaattaaaaatatttttattttctttgtgcgtgttctttagatttggcattattttgcccatagtaagcattcttcccgtgtttacggtagtagtgcttatctaataagtattgaggaacttcgatattccgccgggtcatttgtaaagcgtgatagtcgatttcagcagcgacttccaatactttagcgttgtaaaccgctttgtccggtgtggcaccccaggtaaatggtccgtgttggctaaccaatacagcaggaaccgcattgtggtccaaatttcgttccttaaattctcgaacgattaccttaccggtattttcttcgtaggcttcttcaatctcttgtttagttaaggccggagttaccggtacgtcaccgtagaatgtgtcagcatgggtcgtacttaaagctggcacgtcaatttcggccgctgcaaacgataccgcccatggagaatgggtatgcacgattcctccaatgtccggaaattcgttatataaaacggtgtgggtcggtgtatcgctagaaggattcatatccccttcaacaacctcaccctttaaattaactaccaccatatcttcgggtttcatttcttcgtacgaaactcccgaaggtttaataacaaataatcccttttcgcggtcgatcccggagacgttcccccaggtaaacgtaactaaatccagcttgggtagctgcatattagcttcgtagacttcctgtttaagtttttctagcatcaaatttccccttcctaaattacttcaccggcgcgtgcttcaactggcaaaccagcttcgtagtgcttagtaaattcattgtaagcagccactccctctggctcaggactaagcgtcatgctttctggattattaaagacgttgtagtctaaataatcacttaagctttgtccttgattatcggcagcgtacattgccaaaattgccattccccaaggtccgccttcaccagcattactcattacggtaattggggtgttgagggcgtctgatagaacttgctgtgcaattacggctgtccggaacaacccgccttgtgcgatcattacgtcggttttaatattttcttccttgctcaaaatatccatgccgatttttagtggcgcaaatgcagaataaagctgggtttgcatgaagtttggcaagttaaagtggctgtctggcttccggacaaacaatggccggcccgccttgatattggtgatattttcaccagactggtaactgtagttgaccaatccgccaaggtcgtgatccgccttagccgcctctaagaacagtgcttcgtacaacttatccggcgtcaaattaatccctagtcgagtcgcaaattcgttaaaaatttgggcccaggcgttaatatctgaggaacagttgttaacgtgaaccatggctactgcagccccgtctggcgtcatcactacgtcaatatcccggtgcactgatttcaatggtttttctaatacaaccattgagaaagcagaagtaccaaccgaaatatttccggtccgtttgcggacactattagtcccgaccattccggttccagcatccccttctggtggtgccatcaaactacctgcttgcaaatttcccgtaatatctagtagcttagcgccctgcgcggataattgccccgcgttttcgccggcctttttaacgcttggcaagacgtgcttgatgtcccagctaaatggtttaacttcaggcaagttagcaaaagttgctaacatattttctgaataattccccgtctgttcatcaattggaaatactccagaagcatccccaactcctaataccttttcacctgataatttccagtgtacgtaaccggccaaggtagtaacaaaatccaagttttcaacgtggtcttcaccatttaagatagcttgataaaggtgagcaattgtccaacgctgagggatgttgaagttaaaggcttcagttagtttggctgccgactcttcggtgatgttattccgccacgtccggaacggcactaataggtcgccgctttggtcaaaagccaagtagccgtgcatcattgcactaattccaatcgacttaattttggtcaacggtttgtgatacttacttttgacttcggccgccatttttgaataactggtttgaattcccttccaaacatcttcaagcgaatacgtccaaatgttgtctttgtattggttttcccaaacaaaactaccagaagcaatcgtcttatagtcgttagtgatcaaaaccgttttaatccgggtagaacctaactcaattccaagggcgacgtttccttgttcaatttggtttgatatttctacaatattcattttcaaaatctccaaattcttattttctaagtccctgttcttcaatttcttctagactgtgacccttcgtttcgggtacccgagttctgataaacaatacacctaataaacaaatgattccgaagattgcaaacactgcttcttgcggcatgtttgccgtcataattgggaataataaaccaactaagaatgaaccgatccagttgaatgatgatgcaaccccggatgctttaccacgaatggctaacgggaagatttccccaacaattacccaagtaagtggtgcccaggtaaaggagtaaaacgctacgtaaatacataagaagattacgatcatcatcggattcatatctttaataaacatgtttaagattgctgggaggataaaggatagtcccataatggtgccacccattgtcaaaagtgtccgccgtttgaatttatcggcaatccataagaatactaacgagcccagtaccaagataaccccttgaataatcggccacattaatgctgaactagcagcattcccggtagctttttcaacaatcaatggaatgtaatagaaaatcgcgttagcaccttggaattgttggaaagcagccaccccgactccggcaattactaggtaacgatatttaccatttagcaattgtgcaaaggaagatttttcgttggcacttgcttcttctgcggcagtctcttgaatcgttttcaattcaggttctacttccgcttcgttacgaatgtaagttagcgtccgccgtgcaccttcaacatcgttgctcttaactaagaaacgaggtgattctggtaaacgcaaaaccccaaagtaaaggatgattgcgggaaccgcagccaatccaagcatcaaacgccatgccattgtttcaggcaaatctttaagtaagaaatcaacaatgtaagataacagcatcccagaaacaatcatggtttggttgattccggataggcggccccgcaaacgagcaggagccatctcagacatgtacgctggtaccagcgctgaggctgcccctaccgctagtcctaagaagatccgaacaattatcagataaatttgaccatcgtgcggcgataatgcggataatagcgaaccaattacgaaaattaatgatgaaatcaaaatcattttccgccgacctagtcgatctgataagttgccagctaaagcgcctccaaaaatagctccaaacattactgcactagtaatccaaccgattacaccggcgtcaccatataaattccaatcgtgttgtaagaacgggagtgccccggtcattaccccaatgtcataaccaaacaaaattcctccaaatgaaccgaagaagtaaataaatccacttggaatcttcttttccttgcccatgctattcctccttaaaccgtttccatttctttgaaaacgtattcattaacttgctttcatcttagaatatttatacggacaagtcaacatgaatttttaaaatttattagcataaatttatcttatggacactaaaaaagaggtgtaataccaaagattggtactacacctctaaatttatctaatcaattgactgttacgatagttccttaattgactctcggtagatgatttcaggttcgtaaattttattttgaatatccgtctttccatcaatcatgtcaaaaatcatcttggctgcgtcccgccctaatttttctttcggtgttctacagaacttagctgtggagacatatactttgatagcttatagttatcaaagccaaagatggaaatgtcatccggcatacgtaagcctaaggatcgcactagtgccatcacttgaatggcaatttggtcatggtaacaaataatcgcagttggccgttcatttggcgaacggctcagaatttgttcgattttcgtaaataccgaccgcatgttatccgaagtttggtacatcacaatttcactttgataaactaagtcttggtgttccttataggccttaataaaaccattcattcggtgaacaccttgttggtcatcaactttaaaaacgcctaaaatcttttgatgtcccatactaatcaatttattagtaatgattttctctgcccgggtatcagccatttccgcgtatgggaaatctaattcagggtaatgcgcgttaataaacacggtaggcagtttcgactctttaattttctcgtacaaatcacgattagggttgcctaaagcgctctgggtgggctcgacaatcaaacctgataaattactatccatcattttttggacgctctttctttctcgagcaggatcattttgcgtattgctaatgaggattgaataaccacgtgaggaaatcaaccggtcaatgcctgtaataatgtacggaaagatatactccgcaatgtgggtggtgatgacgccaatcaccttattttctaccttttggtttacgtatttctgccagtcgtcgacaaacattcccccgccttgcacccggtagatgtagtgatcattttctaaatcgccaaccgcgcgtcggattgtataacgactcacgtcatatttttccattaattctgattcagttggcaatttatcgttaattgaataactccccgataaaatttcttcctttaaatcttgtttaaccagttcgtacttcttttcgatgattgctcctcctctactacagcaaatttattatacgataagtaaaatgttatcacttatttttaaatgataaatctctaataccgattcttttttaattctatgcattcgtcgttaaaatcattgacatttatccggacaaattttaggattaaggataatgataacggtttcaaacatggaggtacataaatatgcacattgatatacttaagttcgatcaatttcgcggccaccaggtcgaaaaaattcgcttaactaatgaccacgatgtttccgttggggtgctcaccatgggaaccatcctaaacgaattttcggtcccccaagctgatggccgaaaaaatctcgtacttagttttgaccaaactaaaaagtattacgataaccccttttacattggaatggcaatcggtcgaaccgcgggacgcattaaggacggaaccatgccgttagcaaaaggggcggttcatttaccaccaaacgaaaataataatactcaccacggcggtccccacggtttctttgattacctctgggactaccatctgcaaaagggtgaagactttttgtccgtcacctttactcatcaaatcaaagaaagcgacgacggctatccaggaaacattgctgttgccattacgtttaaactcactaacgacgaccaagttatcattacttatcaaggaactgctgatcaaccaacgcttttcaacccaacttgtcatgcatactttaacttaagcaatcgtgaccatgtattgaaccaccagttgacgattgctagtgcacagtatttagccgtcgatcagcaaaaggtccccacgggggagttacttgccaccgcaagtactgcctatgatttccgtcaaccggtaaagctacaagacgccattgccgccttgcagagctccccagaaaaaggcctcgatgacatttttaaaattaacgaaaacgccgctcccatcgcgaaactacaagacttagatagtaacgatgctctcgaaatttattctaaacgtaatggtctagtggtttacaccgctaacgccctcgacgataccttaagctttactaggggaccggggcggcctcaaatggggatcgctatggaagctcaaactctgccagacacccataaccatcccggttttggcgatatcactttatcagctaatgaaccccactcttacaccatcacttatcgctatttaaaaggtaattaatttttgaaccacaaatttccgtagttattagatttttttctaataattacgggtttttatttaccaaataaagattttacattctattcattaaaatgggtaacaatttgattggcaaaaaccagtctcttcccactatacaggagcccctttaaaaagcaagcgttttcctagtctcgaagccagctcatttcatttccaataaacacgaactataaaaacaaaaattacgttaaaagttcttttattgctaattataacgtgttaaactcaaaacatagttaagattcaggaaggagtgctttgaatgaaacgttccgtcgatgattattcatccctttggcagcgccttaaaaatgaaaagaaaatttacctaattagtttgatactagtgttaattgccgatgggattggcgaggtcacccttaaaattggcaacggagtgattattttcttccccgttttctacgcaattgttttaggaattatgctcggtccccaggttttaaaattaatccggcctgtcgaaactacggctgccggaaaacttgttttagtcgggatctgtccctttatcgttaaactcggtatcaccgcaggagccaaccttcatttaattttaaatgccggcccggccctgttactacacggttttgggagtctccttggtccaattttggctcttccgattgcgatgttacttggcctacatcgcgaaaccatcggggcttgtagctccttaaaccgtgaataccacttagccgtgattaataacgcgtacggtgcggaatctgccgaaagtaacggcagcttagccctttacatcgttggcggcatgatcggagcaatttactttggcatcatggcttccttaattgccactaccggttggtttacccctcaagcactcggaatggcttccggagtcggcgccggaatcttcatggcaagtgcaagcgctagtttagccaacgccttccctgcccacgccgcagtcattaccacaatggcttcagctagtaacacaattgctggaattaccggaatttacatcaccatgtggcttgccctccccctaaccgaaaagtattacgacttactttgcaaaattttccgtttacaaactcaacgtcatcttaaattgaaccgaggttaaagcatgcgttatcgagaatggacttttctattaattgtatgtgggattggtactggattagccaattggattggttacggtatctcatttcaaaaaagccttaacggcatcatcgcattgaccgtgatcacgcttttagcggtgctttgcgtaaaatacctaccccttaaacttccgctaattgcctactgttcaattttaggactattgggagcggcgcccttttcgcccgttcacgcgtggctaattagcagtgcaaacgccattgaatttgcagccccatttaccatcgtgggttcctttgccggaatcgccattagtgaccagttgcagcgttttgttagccagggctggaaatatgttatcgttggaattctagttatgaccggaactttcttaggttcttgtttatgggactccttcacgttgggcttaaccaaattactttagcgaggttcttattaacgatgtctgatattctaatcaaaaatgctaccattttaaaacaagctggacaaattaataccaagcaatcgattttgattcatgacggtcatatccaacaggtgggtgattttccctgtcctattaaattcacgggtgagattgtcgacggagccgaccgcctttatcttcccggattaattgacagccacttacatactggacagcaacttttgcggggacgcgtacttgatgctaaaccagtaatttggacccggattatgctacctttcgaaagtcaactaaccgcgtcccagatgaaactaagtgcagaattagctgctttagaaatgatcactggcggaaccaccggttttgtagaagctggcagctaccacatggaaagtgctgcagaagtttacgctcgtagtggtttgcgtggcgcgttgactgcctccaccatggacgatccccagctaccagcgtcaattaaaatgagcgcccgcgaagccgtcgcccaaaccacccaactatatcagcaattccatcaccaaggtcgtttacaagtttactactcgctacgggccctcaccgcttgttccgatgaattaattgaccttactgctgaggctgctcaaacacaccacacttttttaaccgcgcacatgaacgaataccccaccgaaatactcaacattattcaacgaaccgggttacgcccttatgaatggttagctaagcgtcacttactcagtaaccattttttaggtgcccatagcctcttcctatctaaccacgaaaaggaactcattaaaaaataccgggttaaactttgtcattgcccgtttagtaacgctgggaaaggaatccccgtcacccccgagttacttcaaaatcaaattcccgttgggttaggaaccgatggcgccgctcacggtggtttaagcctttggaacgaaattaaaatttttcgctccttaatggtcgctacccacggtcttcgattacggcaacctaacgtcatgcccgctgctcaaatttttcgaatgctcttagaaggtggcgccgccgcattaaaccacgctgggcagttaggtaaaattcaacccggttacaaagccgacttaattgcaattgaccttaatcagccccacctttacccttccggcaactggcaaaataccctgttagagtgtgtcaacgctaacgatgtcacggatacgatggttgacggacagttcttgatgcgaaatcggcaagtactcaccctcgatcaagaacgcattatcgccgaagctcgcaattacgcgtgccaccattgaattacatactattccaatacaaaaagaggttggaaaaaaactaaaaaatccttttcaaggatgaaaaggtccttgaaaagttgttttgatgttttgatttcaataaagctaaagcgtgtactaaaagtcagtttgttccccttaaccaaaaattgaccattatgccaaattcaggcatcatgatcaattttcagttaatgctcgcaaactatccgactttttacccactctctttttcaattaatttttaagaaagttgtttagctgcctttttgcccgctctgatttttaaaatagcaataatcaaaacggaaaccgcggtacctgttaagattgcgataataaacaatcctaaattattagttgccccaagcacaccgacaattgggccgccatgaggaaccgcgtccgtaattttaaaaatcatcccggtggcgccggcaactgctgaaccgatgatgattcccggaaatacttgtcctggccgggtcgttgccagtgggatggctccttccgtaataccaatcagtgccattaacatagcggagattcccgccgaccgttcttcttcattgacgtttagatctgggcgaattaaggtcgcaagtcccgaagaaagtggtggaaccgaaactgaacaagccacggcacccataatcatgggattccctgcggtaattgatgctaccccaaacaggaaggctaccttgttaattggaccacccatgtcaatcgctaccatcgcgcccaaaatcaatccaagtaataccgaagttgacgggcttgccgatagcgtatcaagcatgttttgcagtaacgtcatcaacgcagaaattggaccacccagtaggtaaataaacgctgccgaaattatcgcggtacctaaaagcggaatcacaaaaattggcatgacggaccgcaagtttttcgggattggccaggagttcatccatttaactaagtatcccgctgcaaaaccaactagaatggctcctaagaatccggttcccgccttggttcccaaaatatctggcgaattggcaaccatggcaccaatcatggcgggggctaacgcagcccgccccgcaattgcatgagccgtaaatcctgcaagaattggaatcattaaggtgaagcctaaggttccgatttgattcattgaactccaaatggtcccgggagtaaccaccattccggcattggcagttggatggccacctaaagcaatcgaaagggcgatgaacaatccaccgacaactacaaacggaatcatgtgcgaaaccccgtttaacaactgtttgattgctggattttgccccttggcattgtccgtagtttgcgttgaggctgccgaggtttttccggcgtagtataccggagcatcggtaactttctcaactagcgctgccgaatccttaatggccgccaaagttttgctgaataaaacctttttcccgttaaatcgttccatcccgtcaattgctacgtcaaccgctaagattacgtaatcggcagcgtcaatttcggcctgggttaacggattttcggttcccgaagcgccctgcgtttcgaccttagcctcgtatccagctgcttcggccgctgcctttaacttttcggccgccatgtacgtatgggcaattcccaccggacacttggttacgccaacaatttttttcattttactaccttctttccataaacgtttattctgctaaagcttgttgaacctgtttggtaagttgtgcagcatcgtgcgcggaccgacgaagcccttctgcataatcataatcgactaatttacgagccaacttggaaagcaaccgcaaatgaacttgatctgccttagtgggtacgatcaacgcaatcgcaagtgaaaccggttgttcatcaatcgccgcccactcaactgggtcagcgtacgttaaaattcccactaccggagcttctaacccagaaacctttgcatggggaatcgcaattccatccccgaatcctgtcgaactttccgcctcccggttaacaaagctggcatacaattctttaccatcaatcgaccactggtttgctaatagttcggccgtagtcgctaacgccgcctctttttgcggtgctacctttacgtcaataaaagctgcgcattttacatctgaatccattactcaatctccctctttctgtataaatttttgaatatgttccatcgctttggaggccgtcgctacttgagccaattgctgacaaaaagctgtgttttcgaccatccgatttaaaattttataaacttcccgacttgcagcaacctgttcacgcgtgagggccaaaaagataaccacgtacaccgtgttccccaaccactgcactccttgcggcactaaccatagcgcgatggctgatttttgcacgtaattaggcgcaatgtggggaattgcaactacattaagcgcggttgacgccatcttttcgcgttccaccagcatttccaaaattttaggattatttaccaaaatgttttgtttagtgagtgagcccacaatttcttcgagtaccgttacgtaactctttttcactgaatcgatttgaattagctgcggatccaacaaattgaaaaatgaatttgaatgattgttcttagttaggctaataattgcatgattgatttgttggatatcctcggggggcagaagcgggctaactaagattaccggttgtttcagtccataaatgggaatcgtactaaccaccattttttctgctaaattagtcttcatcaccgttgccaagtctaaaatccgggtaactttcaaactgttattgaaacgttcctccaaccgttgcgccagcaattgcgatgctccgaccccagcagaactgaccaccaccgtttcaattggagcatgcaggtggcaacgttcaaaaaaggcttcaaaatggagggctaaataccctaattctgcgtcgtgaagttgaactaggtactgggtttcgattgcctcccctaactggattgccacatcaaaagcaatcggtaagttcattttgatttcatccgtatacgggttatcaatcacaatgcccttctttaaacggtcgaccgcggtcgccaagtgaatcgctaaatcccgtagcagtacttcatcaggctctaattctgctaatctatccagtaaaaactgataatactgtttttcggtttgggctacgtcagaagtttggtaactatttttttgacgggcaacaattacttcaaggtaccggttcaccctttgaagtcccgtagcagaaaaattaatagtccgctgttttttaatggcgtttagcaattggctagtttcggggaggagatccgggcccaaactttttacgtcgttggttactttgtcatccgtattaatgattaaatgaatcgctaaagactgaagatcgtagtcggttaattctaagcgactggtcaccataaaatccgtaattccggccaaaactgcttggacaaggtcggcaggaaaaaaatttagtaaataatccggcaatttaagggtggaagcaatttgtccattagcgtcctggatcacggaaatattttggccccaatacgttttcaaaatttttgccattaaccgctcgcgttgttcgccagaagcccgaatggcaattccattcgccccccgcttgatcttgacgtgatgctcattaaagaattcccgaatctgcttgaaatcactttccaaagtgcttcggctaacgtataggtcatcggccagctcgtttagcgtatagcttcggtccgcatccagcaatttgattagtagatagcgaatccgcgcttccttcgaagtaaaaccgctatgtaactttaacgccgctaagaaatcttgtttattgcgcaactgtccgtttaaataaattcccacgtttggctttcttgttaacttcaagttaaagggctgagcgtcattttcgataatatctaggtaatttgcaatacttcttttcgacaacttggtcgctttagcgatttgttcgtaatggaccactccgtgatgaattaaaaattcgacaatttccgcttcccgatcatgcattatttcggttcacctcctttcaatatgtactatacgtgcttatcgtctcgcggaaaacgttttctattgcatgattaatgttgcaacttctgtaaaggacttatttttgtataggaactaaaaagtacttctcaagaattttcactttcttgagaagtactcatggttagccgcttttaaaacacaaaaaatttatcgccagcgttaaacccccttaatagctattcacttaaaaaatccaccaacttagcataggtttcctgggcttctttattactaaagtcaaattgatactcgtgattcaacttggcggttttcttcggataactcactttagtcacctgtccgttatggtcgctaattgccttagcagtggcattcatttgctttgtaaaggtattcgtgttgccatcagtcaaaaaagtcttcggcgcccaatctttaacgttgctgataattgataagtcacgaatggacttctttttttcaaaatgcttgtcggcaaaatacgcccagccgcatttagcatataggaagctagatgtacggtcactaacctgggtaaacttttggggttctagtaatcccgatagcgacacaaactttttaacttgctgactttttaaaaccggctgcacttgatccattttacgaatctttttattttgcaaagctaaaacatattcactgcttatttgcgccccagctgaatctccgccaatggtgacattggaccaatcaatttgttttccgtatttttgcttggttgcctgaacggcttggttgagctgtctaactggtgtcgcatgatgcctttctggtgcaagagcgtagttaatattcaccacgacttgattagtatccgcgctcaaaagttttagataatcctgacaatcgcgtttatccccgccgacataggcaccgccatgcatccagaaaagcacgggccttttactagcatggggcggtaaatacacgtccatgacactcttgctcaagtgctttccgtacttaacgtttttttgcaccgttagcccagccgttttttgcttgaactttttgggccgggggtacacttgatgttttttggatgtatcaaattgttgccgggttaataaactgattggtcggggcgttaacgcgttaattagcattgctccgccaattaataaaattaccaaagctggtattatgattaacaatcgttttatccatcgcataattagtatcttccattttcactaggattattctcttaaacgtcgttattgatcaccgcaactaattcatcccgcatttgcttaaaatcgttcgtagtttgcctaaacaattttggcgctgcacaatgactatcttccatccatttctgaggagctgtttcttccaaaaaatgttctaggatcgccgtggtccgtttttcatccgtagcctttgcagacttgattaaactaaagtcctcgaccgcccgttccaactgcttatagcgcaacgacaataataaatgcccattttctcctgggtacaccaaacaattatccccgatcggcaacgaactggtgttgtaacgaatatcctcgcgggcgttgcttggccagcagttaaatgcccaccgcagtaagccatttaccggtaagaatgctgtcaacgtaccttgcaaccgggtttccaataacgggctgtgcaaaaaggtattgggatggtctgggtaattgcaaatatagtactggacttccccaggatggctggcttgcaattgactgccgaattggctagtacaataaaacgaagttgccaaggtatctactagcggagctaattcgtttaggatcggttccttatcaaaagcaaccttaaccttgagatctggcaccatctgtttcaacgcagataatgcgtccttaaattcttttaactgtgcttgtttgggctcgtctgcaattagccgaactttttcccaaacttgcaaatcttttagatgatcgcaaagtgctttaacgtagttcgttaaatccgctacgttatcgataaattgcatcgtttcggtagtttcgtctaggtaacgaaccactaaattttctggataatctttaatggttacttgtggaaagaatggtggcttccaaactcctagtaggccaaaaatttcaatctcttggtcaattccccgtttagcaaagctagcgaggtaacgatccaaaatggtaaagtcacatttcaacttacctgtggaatctttactaacctggaccattgaatattcgtataggtttgcggggtagtccttgacaatgtagttaaaccatcccttccaaggaatttcaccagcaatcaccgttactgttttttgtccaatttgcgctagtttttcagccatttcatcaattaacgcaaagtgctggtcgccccacatgggtacgtggaacgtgcgggctaaattagagggctgctgccagacgtcaaggtgaaaatccttcgttggttcgggtgttagtgcaaaatcagccaccataatttggacttctttttcggccaccaaaacttctgctccagttagactactttggtaaattttgatttttacagggtagttacccgttttcaccatttgactaaccggaatttctacataaatcggggcccattggtttcctggataggtatgactggcctcgcttaaaagtttatcggcataggcgacgtcatccttccccaaataatattccacaaaattagttgtcaaaggcaactcagtttcaaacgcaacccggtacatcggagtttccaaatcgtctggaattgaaaactgggtgcctaacgtatagtgattgcggtgtccgtcgttaagcaacagcataaatgctgccttactgtttttgaaactgtgcacttgtgcaatggacggcggaagcggttggttaagcgcggtcgttggccgccaactttcgtcggtgatgatacttttcattattaatttgctccttcccccatcgttaatttactttgtagttgttgcagaatcgttgcattaaaaatttgcggcgccacctcgtgaagttccgtaaggttaaacttacgaacgattttataccggctacgatcttgccaaactggaaaatactctaagagaatttttttattagctacgttacgcattagttcgccgaccggcatggctaaaacatccggatactccgccggcttagacgtcttctgccaattaatttccatccactcgcagcataagtcaaaccactgggcaaaccgcgggtcattttttcccactgccggagtccccaacgaaagcccatgcttaccttcttgaaaaatgtgggcctcaaacaaaacgtcgtgctcctctaaagctcgcagatatagcaacgaattttccaccggtaccacattatcttgaaaggtggtaaataaaaaggttggcggagtcgttgcggtaacttgctggtctaaggaaggggcttgcacccgcattacctcggcaaacgaatctaaaattgccggatagcctaaaacacataggctgggcttttcgcttagcattgtcgacatcgccgccgctaaatgcccacctgcagaaaagcccactaccgcaattttatccacctcaattgcagcgtttgaagcaatttgtttaatttgctgtaaagccagttgaccatcattcaaagctgcttgaaaatcgcgaaattctcccacgtgataacgtaataccgcggcatggtagccttttgccaaaaaagctaaggccaccggttcagcttcccgttcactacaaaaattgtaaccgcctcccggaattattaaaattagcggccggggagcacttaaatccgtttgtaaatacaccgtcattcccgtattggctgactcgtcaaatacgtaattactttttttgataatcggaacccccttccttaaactagtcaactattccattatgttcaattacccgttggtaccaattaaagctatcctttttataacgcgctaaatctttaagctcgtcgtcggtccggttaacgtaaataaagccgtaacgtttctgcatcccttcgtgcgtgctaattaaatcaattgcactccaaggacaatatccaatcacttcaacgccgtcttggatagctaattccatttgttgaatgtgctgttttagataatcaattcgatactgatcatgaatttgatggtcttccgtaagttcatcatgcgcgccgattccattttcggtaattaacactggcaaatggtagcgagagtagatttcgttcagggtaaaccggaatccttgaggatcgattggccacccaaattcagtcagtggtaaatgttcgttggtgaccgtttggaaaaatcctggaatcccaaaccccgattgttggtcaattttattttctttagcaaagtatgccgcaaccgtcatggtgttgtagtagttaaaggcaatgtagtcgcacgtccccgtcgctaaaatttcccggtcggtttccgtaaccactggcgcagctccaatactttctaaaatatgccaagcattgtggttgtagcgtccgtaaactgccacgtctaagaacagccagttgcgtaacgcactcatgttaagtgctgccaactggtccgctggacggtcagaagcagcatagacactagcaatgttgggtgccggcccgattttccctggatacccgtgttcatgatagtgtttggttactaacgcttgagcaacgagcatgtgatgattttcctggaatttttcacgcatacttttttggctagtcccaattaccgaaccagcaagtgccattacgttttgctcgtttatcgtctgccagtacttaacgtcttggccaaagttttcaaataagacgtcgcagtagtccgcgaattgctgaatggtctcccgattttcccatccgccagctcggtcaatttccgcaggtaaatcaaaatgaaataccgtaacaattggttcaatctgattttccttaagcaaattaattaggttacggtaaaatttaatgccttctggattcactttaccgttaggcatgacccggctccacgcgattgaaaagcggtaggcctttaaccctaattctttaaaaagctttacgtcttcagcaaaccggtgatagtggtccaccgcgaccttaaaatcagtggttcccgctggaatgtcctttacatcttgaacggaaggcccctttccatcggcgttccacccgccttcaacttgataagcactggtggaagctccccacaagaaattttttggaaatgttttagccataattaattacctccgcagccccaattaagttggcatccgccttaaaaaaagcgtccgtgatgtcaatttgcttaaccgtcttcttaataattggggatgtatttaaaatttgttggtacgcttcctgaaccttttcgattaataggggctgactgctaatgccgccaccgatgacgattttgtctaagtcgagtacagtttgtaaattgaaacaaatttgtgcgaccccaaagcaatagtccgcaaaacgttggttagcgtccgcgttagcttgctggttcaactgggtaaatacggtagctccgtcagcttcggtgtttaaaatgcttgctagatcttccactaggttaacggcggataagccaattccaacaaacgagtcgcctgattgaacgcgccgatcccgcatcatgaaacttaattcgcctgcttggtgatgactacctttatacaaggagccattcaaacaaattcctaatccaaccccggttcctaaaatgagtgcggccccattacgaattttccgcaagttaccccggcgcatttcacctaaggttgccgccttagcgtcattttcgatcgtgaccggtaacccagacattttgttcacaaccgtctttagattaatctggtcaagatatgggattgccccgccaaaccggacggttccatcattttcaacggtgcccggaacggcaaccgcaattaattcaaaatcatctaccgtccggtaccgtttgataaggtcttcaagtaatattttaaaatctaaataggtgttgggggtcgaaaatttttgacggtcactaaccgtaccgtcggctacaatccccgctttaatgctggatcccccaatatcaatacttaactttttcatttgttttccccacgtttgtacactattcagtaactgctttcgcttctttttccgctgcagtttcagtctgttcttttttagcgagttccatttctaagcggtattctttgttgtcagcaaccttaatgaatgggtaccacattaaaattccaattgccatacaaattaccattaggatggtgtagtttagtcccccggaaaacggcatcttaatgaaagttggcgtagtccatgggagtagcgacatcgttgggttaagtgaaattggtaaaatagtggtcgttaagccccaggttacaaagcccgcaattaattgcgtaaatacttgcggaataaagaagagcggattcaaaataattggcatcccaaacataatcggttctgaaatattaaacagtgatggaataaatgctaatttacctaattgcttcatcttagttgacttactgcgaatcattacaaaggtaactaagcccatgaatcccgctgcgtacattcccatgtaaattacggaaggtaacaagtatggtaatttttggccatgttggaaagcagtgatgttaccaacgatcatggtcatgctaactgcgcctaaaggtccttgtaaaacagcgttgtggattccaaagaaccagaaaattgctaagagttccattatcaagataattgaaagcggactagcaactaatgaattcaacggagcgttgattgcgtcaacgaagaattggaagatagttcccgaaggagtcaaaccaaacaatacccggacaatgaatactagtacgaagatgatggtaaccacgaacactggagataaagattgggtaaccattggcggaacgctttctggaagcttgatcatcaagttctttttggagagagctgcgtaaagtcgagtgattaccaatgctaaaatcattccaataaatagtccctgtccgcctaagtaatcaagttttaatgctccaattgcttggctagtcgcgtggccgctcttcattaccgtggtggtaaccgattgcggcattaacatgatgaaactggctaacgaaattaatgaagcattccgttcgttagttttcaattgcttcgcgtaagaaaaggctaaactatacactacgtatagcgagaaaactccggtagccccgttagtaatcgcttcgacatgttggaaaattccaatcttagttaaaaattgagtccaacctggaaccggaaagtttccgataatggtgattaacgcaattcccaacgtaattggactggtccgaataaacccttccattaacgctgctagaattttatttttctgtaatctttctgagattggcaataatttgtcatttaaaaatttctctaaattgttcatttttgatactcctttacctaattttaatttagtttcaagttaatttctgaggtttcccctaaaatatcgagttggaactggtactcaatgtgctcgagatgtttttcaccctggttgtcaaagtatgctaattctgccaccggtatttcgacatcaattacttgcttaccagctcccgtaaactgaaccttaacggccttaactaaccgtttgattggttggacaatctccgccgggaattgattgagataaatctgaaccaccgtcgctgcggctcggtcacttaaattttccacttcaaatttgccctttaaagtcgttgtagcttggtgcaattcttgccaacgtcccgtgaaccttgcataactaagtccgctgccaaatggatataatggctcgttactttcatcaatgtatttggaaacgaaccggtccgaatggttgctttctcccagcggacggccggttggggtgcgagcttgataaattggcaattgtccttcactccgtggaagagtcattgataaccgcgctgaagggcttgccttaccagatagtaaattagcaattccggttccacccatagttccagggaaccaaaccaataacaaactatcaaagtacggttctacatcagttaacactagtggccgaccggtatagacgatgcccacaatcggtttcccctgcttagcaactgcttgaataagtcgcttttgcttagccggcagggtcaaatgtgctttagctgccccttctccactttctaaaaagttttctccaatggtcaagaccactacgtccgccgcggccgcctgtttttcagcttgttgtaagagtaagttttcgtcctcaattgggccattaaccatttcaatcccctgttttaagggtccaaaaggctcataagaatcaaacaagttatatcctcgactaaacgataactgtgcgggattaaattctgcttgtagtccctcttttaaaggaactacgtcggtagatttaccgcttactgaagcccagaagcccagggtaagtttactttccccatacggtccaatcacagcgattttttggtcttgtcggagtggtaaagcgcttttatttttcaataaaacgctgctttcctcaaccaattgggcagctaaagctcgatcttcctcagcaagaatcttaccagttgctggttcatccaatccacgaaaaggattttcaaatagtcccaacttattctttaaaactaggatacgccaaactgcctcatccaataattgacgcatctcaggatttttaagcaccttcggtaatccattggcataaaccgccgtcatcatatccaagtctactcccgcacgcaacgctttctgagcggcttcttgggaattggctgcgtagccgtgatttactaattctgcaattgcagaataatctgcatccaacactccctcaaatccaaatcgatctcgaagaacttcccgatttaaccaccggttcccagttgctggtacaccatttaaaagattgaaggcagtcattactagttgagcttttgcttcaattgcggcttggtatggttgcaaatactcattatagagtttttggtaagacaactccaccgcattgtactcgcgaccgctttctggagcaccgtaagccgcaaaatgcttgatgcaagctgcaacgtggttacggataatttttccgtcagccaagtccccttggtacccgcggacgacgtgtcgtccaaattctttggcagtgtatacatcttctccaggtgattccattactcgtccccaacgcggatcgcgcaccaaatcgagcatgggcgaaaaaactacgtgaagaccattttggtaactttcttttgcagttaccgctgccgctcgttgaattaaatcaaaattatacgagcctgcttgcgctaacggcatcggaaaaatcgtccgaaatccataaataatatctgacatgaataatagcggtatccgatgacgactcttttccaatacttccgtttgcagttttttcaacttgcgatggtcgttaacgttataaattgacccgatttcataataattaaaatcagctggtaatcctaaatccgtttttggtccagtactcatcaccccactttccacaaaaaggtctccattcaattgaacagtctggcttaccttctctgcatcacttaaatcattaaacaattttcttaactttgtttcttccaagtaactcccccctctttgagtaatcgctttcaatcctcttacaactgcagtataaaatatttaactcttaaaatatatcaataaaatagtgtttataacaaaaacgttcaaaaaccaaaaactatgtttccacgctcttcaaatattcattttatttactaaaaaatacctgccgctagcgatagataccacctaccactaactacaggtatttttttaaacttgtatttttcttctaaccgttgaacgaataactcttcttaactttaaagtcgacgattattcttcatcgtgacgtttacgcttcttaccaagaccgaagagtccaagtaatccaccaactaagccaactgtaccagctgcacgagctgcacgagcactagcgttatcttcctcaccagtttgtggtaagcgttctgcgctatttgttccgccattagaactatttgcgccgtcgccaccattaccttgggtaaggtcgacactaccgtcactttggccgttgcctggttgatatccagtatctactaggccagctccgccgttgccggtattgccattgccgccgttagtaccgttaccagctccgccattccaggttccatcacctgagccattcgaaccattgccttggtcagttccgtgattatttccagaaccgttattcgagttgtcgccagcaccattgttggaaccgccgttgttcgaatcagaacctgagccattgttcgagccgccgttatcggagtcggaatcggatccgttattcgaaccaccgttgttcgagtcggagtcggatccgttattcgaaccgccgttgttcgagtcggagctagaatcgctatcatgcttgtccgatgctgagcgggattcgctatcgttcttatccgatgccgaacgcgattcactatcttgtttatccgaagtggaacgcgattcactatcatccttatcagatgccgagcgggattcactatcttgtttatcggaaattgaagtcgaacgtgaatcgctatcttctttatccgattgtgaaattgaacgagagtcactatcccgggaatcttggttatctgatgttgatgcggaacgggaatcactatcattcttatccgatgtcgaacgcgattcactatcttgtttatcagatgctgagatcgattcgctgtcttgcttatcggaggttggctgacttcgattcgctttctaccttatcggattctgattttgattcactttcttgcttatcagacgtcgacttcgattcgctgtcatctttgtccgattgtgaagcggagcgtgattcactgtcttgtttgtcagatgtcgaggttgagcgactttggctatcacgggaatcttgactatccgacttcgaagcggagcgtgattcactgtcttgtttatcagatgttgattttgattcgctgtcgtccttgtcggattgcgaaatcgaacgggattcactatcacgggaatcttggttgtccgagttcgatgccgaaattgattcactttcatgcttatcggacgtcgacttcgattcactgtcttctttatcagattgtgaaattgaacgcgattcgctatcctgtgaattttgattgtctgagttcgaggctgacttcgattcactttcttgcttgtcggaagttgacttcgattcactttcctccttatccgattgcgaaattgaacgcgattcactatcttgtgaattttggttgtcggatgttgatgccgaacggctttcactgtcgtgcttatccgaatcggacgcggacttcgactcactttcatgtttaacggattctgacttcgattcactttcgtgcttatcggacgtcgacttcgattcgctgtcatctttgtccgattgggaagctgacttcgattcactgttatctttgtctgattgtgatgtcgaacggctttgactatcacgggaatcttggctatctgacttcgaagccgagcgcgattcactttcgtgcttatccgaatctgatttcgattcactatcgtgcttgtcagacgtcgacttcgattcactgtcttctttatccgattgggaaatcgaacgggattcactatcccgggagtcttggttatctgatgtcgaggctgacttcgattcactgtcttgcttatccgattgcgaaatcgaacgcgattcactatcttgtgaattttggttgtcggatgttgatgccgaacggctttcgctgtcgtgcttatccgaatcggacgctgacttcgactcactttcatgcttatcagattctgatttcgattcactttcgtgtttatcggattccgacttcgattcactatcgtgcttgtcggacgttgacttcgattcactgtcttgtttgtcagaggttgaagctgacttcgattcactgtcgtgtttgtcagaggtcgatgtcgaacggctttgactatcgcgggaatcttgactatctgacttcgaagccgagcgcgattcactgtcgtgtttatcggaatcggacttcgattcactatcgtgcttatcagattcggacttcgactcactatcgtccttatccgattgggaaatcgaacgggattcgctatcctgggaattttgattgtctgagttcgaagctgacttcgattcactgtcatctttgtctgattgcgaaatcgaacgcgattcgctttcgtgtttatccgaatccgacttcgattcactgtcatgcttatccgattcggacttcgattcgctgttattcttatcggattctgatctcgaacgcgagtcatcatcgttcttgtccgaggttgaagccgaacgcgagtcatcgtcgttcttatctgacgttgaggcggaacgtgattcactatcgttcttgtccgaggttgaagtcgaacgtgagtcatcatcgtgcttatcggaggtcgatgctgaacgcgattcactatcgttcttgtccgaggttgaagccgaacgcgagtcgtcatcattcttatccgacgttgatgctgaacgcgattcactatcgttcttgtccgaggttgaagccgaacgtgagtcatcatcattcttatctgacgctgacttcgaacgcgagtcactatcgtgcttatctgacgtcgatgccgaacgcgattcactatcattcttgtccgaggtcgatgttgatgctgaacgtgagtcgttgtcattcttatccgacgtcgaagttgatattgagcgtgaatcatcatcatgcttgtttgaggttgacttcgattcactatcgttcttattcgaggttgacttcgattcgctatcgttcttatctgagattgacgcggaacgtgaatcatcatcgttcttgttcgacatcgaagcactcgtactcatgctaccgtagttatcaacaactgtaaccgtaaccgtagttgatacattacctccggttgccgcatctttaaatgaaatttcaactgtgtatttacccgcggtgtcccagtcaacatgactaaaatctgcttcaaaaccggatgcaagggatccgtcagcattctttcctgaaggctgtaaatcaccaactgttaggtggtcttccccaaccgtgtaggtcgcatccttacctgaaatttctgattgattctttaagacgtgaatcgttacttgagttgttattatttcaccagtcgtgtcctcaaactggatgttaatatggtagtccttagcgtggtaccagttttcttccttcatgtcccaagaaaggtgagcatctgcaatatcaacatgttcccctttaccattgagaatggtatcttttacgaagtcaccaatatctttaggatatccttcatacgtgataccatctttaccatcaaggttaatcagcgaagtaacgtgtaccacaatcggcgtcgttaccgtttgtaacgaactagcatcgtagtaagaaagcattacttcatagtcgccatgttgattccagtttatatacccaacccaggttaatcccggaaggtcctcatccaagttaggatgcgatccgtcagcattggtaatgctcgtaaccgcatccttaggttcaagtggatttccaaccgacgtttcaacatcatgtccttcaaggttaagttcactcgcatgctctttaaagtaccatctcactcgaagcgatactaatgttacgtctgggtccgaaccatccaaatactgcttataaaagtcactgtttttaatccacgcgttaagatcatcgatactacccgcacttgttgcagcgtacttcttaaactcctgcaaataatccgccattgcctgactggacggccgatgtgcgccagccaattggaatgccatttccgttcgggtcatatctagaatatatcccgggatcgtaggcggcgctgaaatttttagcgcatcctcattatcccgataatcatcttgatcaggaagtagtgattcacctgtttccgcgtctaaatattgattcttgtggacaatcggggcttcaggatcacctgacttcgaagtgattttttccgtcgacttagacattgaatctgccatgctctggcttaacgaagtcgactgctttgcggcctctaacgagcgactttgcttcgctgaatctgtagctgatttaacggccgataagctttgggaactttggttgttgcttgcatccgtagatgttttactttggggatccgtttttgactgggatccttgactagcactcttagcttggttagcactgttcgtatcttgtttagttgttgaagcagcttgggagcccttggtactcgtttggctagctggcttcgctttcgttgacgaagtggttgattgtttaacagtcttttcactagctttttgttggctcgctaccttggctgctgcttgactttgactagccttttgttgactcgcactagcgtcctgagccgcctttaaagatgcacttaaactggctgagccagccttactggctgcttgactggtactggtttgcgcattttgtttagcagctgaagttgaattggttacactattgtgcgttgagttagtactttgtgagtttgcagcactcgttgaacccggaatcgtcgcactggttttggttgcgaggagattcttcgatttactgagatcgaggttcgcccccttaggggtttcatccgcactagcgatcgtggtggatcccgcaccaaaaaggccggctacaattcccattccggcaaagaaccactgtttaccgtttttgtacattttgtaatgctttttctcattaacattccatatttttctcttagacattaacttcctccattattaattaggcaattccctttttcatctcgtatgtaacttaaatcaggaaatcgttttcacctttgtcactaccattggccactttctgctagttctgaccactacctaacctacttaaactgtacttgcctattattgaattacttagaaaaataacctttaccgttaccaaaattcaaccaaatcccgtccttacaatcccgggaccggacgcgaaggttcctcgacggcaaaaatcgtttaaaaatttcgtcattattcgcaatttcccggtaattaccgtctcggacatctaaagccactcctttccgtatttataagtaggccatttgcctcacctcaaagtgtaaacggaactaaccaccttggtttcccaatttttatcaaacaaggtacgttttttaaaaatcgatagactgaaatatcaacgggatatatcattgtgtggaatccttccacttttttgacaccactgcggttcttgtcacttgctaattctatattgccaactaatcagggattgttttacaaattctttttgcacgaatcctaccaatagtgattttttatccaacgataattaacaaaaaaacagcaaattaaccatcaccgtcctttaaagtaaaccctatttaattttatacttagctttaaggtacaccgttaacgttgctttttattctcacttttttctttatttagttaaatctcgacacaagtaagggtaacgcacacaaaaagagctaggaagtcgatttcttaatcgaaatcgctccctagctctttatccccataaagtattccgttcgttataactttttcattactcggttaccgtaacttggacgggctcacttaacacatcgtcaagcgtgctctggtaaacctcaagtacgtcgttagcttctagctcaacgttgatcggcacaaggactacccagtttccaaattggtcgactggttcagcccccagcggccggttacttccgtcagcttcctttagatagatcttaattatcttaccgggttcgccttgtccagtgatattttgcgcacctgctttaactggatttacagtggggcgcggcacctctgcttgtttagcttctaccgtagtttgggtgcccttgacttgagcgccttccccttggtaggcgaaaagtacgtcccccgcgtgcaaatcctgttgactagcatctaccagccacccaccgcggaagtccaccgtggcgttaccaatcaagagcggcggttcaccagttggagtatccttaaaaacgttgatttccgcacccggctcgccagtcccggtaattaccgaatctccttctcgaaccacgttaaaggttggatccgcaacttcatcttgaatagctgcgttaagcgtactgccattttgcgcaaaaccggtttgtacccctgtggacccaattttggaaaattgatgcgccatttcggtacgcaatccattcttgggagccgcccttatcgacgcctgtacttgaccgatgcttaggcccagcagcgcgattcccacggtcaaagcgccaatcctggactttctcacctctttattgttccatattccagagtgatctttaaaatttaaccccattttgtagctccttatcaagggtacattatatggtttgtccctaatccagcgcttcctgcataatcaccaatcaaattccaatcaattggactttccggatcaactagtgccattttaaataggtagtaatcagtcgtttcaggaatctcttcatcaaagtctgtgactgcttgtccaagattgaaattaaggaacgctgtggtggttttacttccatattccagactcgcatcaccaacattcaaaattaaattagtaccatcgtatgaaaaatcttcattcttgtaggtccacaacatatcaagcggaccattgttaatactaccgtttccattaaaatattttgtccaatggcccgattcactaatttttttaaacaagccgcggagtggttccggaacgcgaattaccaagttgacaaagtcatatttgttcgagccgcttcccgaataattaaattgtagtcctccgctatatgtaccatccccatttttaaataatccataataagcaccccagtaatttttaagttacctttttctacagctggattagctaaattatttttctgcgttggagatgttttttctttatcaggagttttggtgttagcctcccagcttagcccgtaccgttgcgcattagcaccctccgcaacctttaccgtagtttcggtgcggggcgcgttaaccgtcgctgccttagcgaaagcatgggattgcgccatgcccgccccaaacattgccaacattactgcggatgcaaggagccagcgcttattccgcttagccaccggataattaccagctttgcgatccgctccgttgctgaaatactttttaaaacctttatacatcgggaagcctcctctgtccattaatttaaaattattgaaatcattcgttaaccacaatctaccgcgtgcatcgtttttgatacttgttagcgctttcataataatctttatggggttaattgtcaactgatatgagataaatcaaatcaatttagttttatttttcacaattagtttgttgcaggtgcacgtcacttgcccaaacgattcaacataattattcgaacacaaaaaagctaggaaaccgattccttatggaaatcgtttcctagcttccttactcccccataaaacttattcgttcgttataactttctcattgcttaacctacgacaacatcagttggtttgctttcgttaccatcagggctagtttcgattactcgaactgtatcgccagccttcaaaacagtgccatctggcaattcaattgtccaggtgccaaatgagtcaatcatagttgatttaatcttcacccagtctccgtcgtcacctagcacgtagaccgtgattatgtttccttcggtacttcctattccactaataactttggctcccgctttgatttcatctaccccaggtgctggtatctcttcttttgcaggttggacttttttagtggttggttcactagtgttaccatctacggtttgggttgctgaaacatcgtcaccttcgtttaaggttattccactggtgtcgattgtccagtttccttggtcatcaaccgttactggtggaagggtttgcccaccaacggttacggtaaccgttgcgccaggttcaccagttccggtaattgccgaatcgcctaccgtgacgtcgttaattactggcggattcaattcttcacgcgcttttaccgtctggttcgctggatcactcaccttatcaccatcagattgaaccgcttggatcttatccccagcctttaggtttacatgactggcgtttactgaccaggtgccatcggcattaactttcaccggttgtccaatcggtgtgccatcatcgtatgttacggtaaccgttgctccaggttttccagttcccgtaattaccgtatcgccttccataatgtcattaattactggcggattcaattcttcacgcgcttttaccgtctggttcgctggatcactcatcacatcaccatcggattggaccgcttggatcttatccccagcctttaggtttacatgactggcgtttactgaccaggtgccatcggcattaactttcaccggttgtccaatcggtgtgccatcatcgtatgttacggtaaccgttgcgccaggttttccagttcccgtaattaccgtatcgccttccataatgtcatcaattactggcggattcaattcttcacgagcttttaccgtctggttcgctggatcactcaccacatcaccatcggattggaccgcttggatcttatccccagcctttaggtttacatgactggcatttactgaccaggtgccatcggcattaactttcaccggttgtccgattggtgtgccatcatcgtacgttacggtaaccgttgcgccaggttttccggttcccgtaattaccgtatcgccttccataatgtcattaattactggtttatcaatcacttctctggcttttacggaaaccgtgtctttgtcactagttactccatctcgagtttgaactgcagaaactacatctccatcaactagtcttacatgcccagcgtccactgtccaagttccatcggcctcaacagttgcgtaaccaatcacactattattcttaccatcatcaaagtaaactgtaacttcatctccaggttcacccgttccggtgatgaccgtgtcaccttcctcaatcggattgatgattggtgcgtcaacgtgaatttctccaagaaccgttgtgtactgtttgtcgcttcgcgagtttcctttaatttgtaccgcataaatgctttcgccttcgactaaattatactgatctgaaatagcggctctccatttaccatctgccccaacagttgtagtaccaatcagcacatcttcgccaccgcctacacctggcatgtaaacttggatagtgtctccagcaatccccgtaccagttacatatttgctgcccgcatgtggtgcgtcgatgcctggcttttcaatcacttctggagctttctgaacaggtactttaacctcatcactggtttgcccgttaacattttgtgaaacgctgatttcacttccagctggttgtgctggaatggcgatactaaagtcaccattttcattggtatgggtacgcaatgtcccgccagtaggtaacgtaattacaatttcagcatttggttcacccttacctgtaagcgttgtagtattatcataaaccggttgattaacggttggtggattcaattcgtcccgtgtcggcatcagatgactagtatttaatgacgcaacacccgcgtagtcaccaattgggtgccagtcgataatatctgttggttcaattactgcggctctaaatgtatagttatcgccagcattatcaatctgttctttaaagtcggtaactgcttgaccaatattgaagttaagattgatttcggttgtcttctgttcaatagcaaggtctactctcctattttttagtattaatgtgcttccgtcatacgaaaaatcactattcgtataggtccacgggattgtataactaggaagaggccacggagtaattgtaaacttaccatcaccactgaagtattttgtccaatttcccgtttcattaattttagagaataggtcccgtaattgtggcggaatttgcagtattaggttcgaatcttcaccaatctgggccacaactgcacttccggtatacttgaaatgtagatttccgtcgtaagttccgtcttcattaagagtcaatccaccagctgcagagccatcaatcgctaggtttccatcttctaaaacagaaactcctgcccgtggatcgcgatctttggcggtcttatccttatcaacctttttgttatcaactgcgtttttatccttagcttgtgcattagcatcggcttttgcctttgccgcggcatcattattgatgtcgttttggtcatttgtatctaaccctgaagttccaatttcgtctgtggacacgccttcttttttaactgaagcgtcagagttagacgcagaagagttgtccgctggtttagctgctgaagaattatctgcttgtgctttagcatctgctgctggcttagctgctgaggatggtgccgcgctatctgcctttgcagttttttgttcatttttgcttgctgaagcatcgttcttttgttcagccttcgctgcgctgcttggtgcgtcggctttcttttgttcaggttgtgctgcggcacttgttgctgacttgtccgctgctgaacttgctgccttagttggagctgcactgctggctgctgagcttgcagttgcgcccttttctaccttggcagcgctatcattttgaattgatgattgcgctgctttagcgggagccgccgagcttggagctgcgctgcttgccgctgccgtagtttctttagctggcgttacgctagcactcagtgcttccttcgcttcggcaaccttatgaaccatttcagtttgcggttcgttgactgtatccgcatgagcagcggtgtcggtctgcatcattcccgctccaagcatcgacaacatcaatgcggaagcgaaaatccagtgcttatttaccttgtacatcttaaagttactaactttactatcgaccacgccacggtggttctttggattcttattcattttgaatccccccattttttattatttttaacttatggagacattacattatcattatgattagttaatgttatgtattagttaccccatcagttaatgtctacatgatattctatatggtgttcattgtcaaacggtaagattgaattttttctaaaaaagtaggtgttttcacaaatggatcacgtataaatgctgttatatcaatggtttacggtgaagaaaattttttaaaaaatattttaggttgttttaggtaaaacgttttaacagttcaccatcacactctattaatggggcacatcaaattaaaacatgttaccctttttggtaattttgtaatgaaagcgtaaacaaaaccggaactgttattttaaacagttccggttgctttttagtgtagaataaatattcatcagtttttaaatgtttaagtaaatcgaaataaacatcaacgtggttcccgccattacgaagaagtgccaaatcaaatgcaatccgggaatcttaggaaagctatagatgatcgcgccaacggtgaaggtcaccccgccggcaaccagtagccaaaaacctagcggcgacaagttggcgtagagggtcttcccggccagcagacataaccagcccatcaccacgtagatggtcgtttctactttttggaaacgccccttgcttaaaatgtgggtgataattccggtgattgccatcgtccagattgcacttagcatgatgatcccgctgcgccggtctaaaaaaattatgcaataaggtgtataagtgcccgcgatcagcaaaaagatgttactgtggtcaataatttgaaaaattcgcttggccttcgtgaacgcgaggcagtggaacagcgtcgacgccaggtacagtgctagaagcgttgcgccataaatgacaaggctgacggtatcccgcgtcggcagcccgttcgaaatcgatttcataattaacaaagcgactagcccgaggctcgcgacaaacgcgaccccgtgggtaatcgcgttccatatttcataaactacttggctcctttgaactttttgcatttttagtccccccatttacttaccttggatgacttcattatacatagaattgtattctacgtaaagcgtagtgattatctatttgatgttgggttatgttatgatatgtttggaggtttgtgcaatgaatacagaaaaataccagcagtggttggctgattttaagcagcttcgcttaccgggttaccaacaatttcctgacctggcgctctacatggaccaggtcatccaagaaaccaaccgctacctaacacccattttacataccgaggtcaccaaaaccatgatcaacagctacgtcaagatgggcttagtgccccacccgctcaagaaaaaatataccgcggagcaccttgcgttgattatgatgattagcgttttgaaaaccagctttagtttggacaccatcaaatcgctactggcaaccgacgaggtcgaagcccacttcaacgaattcgtgcgtattttcaatcacgagatcgaacacctcgacgaggccgtccaatctttctcgcctttagagatggcaatccgcgcggtactttataaattaattttggagcgcaagctgagctgatgccggtttgtgctttttttggtacatgagagtgggtggttctactgctgccgtagtcgaaacgcgcgaaaaagcctagctccttccggttaacccaattaagggatcaatcgcctaacccgcgattaatcccttaattttagaagctctattgttgccatagtcgaaacgcgctctggaacccagctccctccggttaacccaattaaaggaccaatcgcctaacccgcgattagtcctttaattacgttaatcctcacgagctacccgggttccggagtgctcttttattttccactcgtcacctttattccaacaatcccaatcactagcaatgctacaaacagccacgtaattgctgggaggcggtccctaaagcagattacccctactagaattgagccgaccgccccaattcccgtccaaatcgggtacgccaaacttaatggcaagtgttttaccgccaaccccaaaaagacaaaactgagaatcatcccgaccaccgtcactatgcttgctccgagttggctaaacccctgactcattttcagcgccgtagcccacaccacttccaaaattccggcaactaccaaatatatccacgtcattaaaatctcctcctaaacaaaaaaggcatctgtaaagctcttctcagacctaatgagctttacaaatgccaaccacccggtggtgatttcttatttttttaatttaaggacatcataacaactttcaaaaccgttggcaactttgccagttaccgcagtttcgtcaaaataacttcactcaacaattgaccagcgcccttttggcccgccaactcatcgtagtgtcgttggaaacgttcatcggcttggtacatttgcgctaaattttggtggtaagctggcgaatactgcttaccaaccatgattttcagccactcctgatgggcggtaaaaatcgccgccttggtcgcgtcgctattttgcgtcaacgcctcccgcaacaaggtgcccaactctttttcaagggcatctgctttttgtaattgggcttccgaaagcgccaagtagtgttggttggcgacttccaccgtttcctcgccatatttttgccgaatttcttgaccaaattgactttcgttttccgccagtctttgggcctttaaactgctaaacttttcactgtcactcatcttgcccactccccttaacattttgatggaggaggagattgccaagtctaaatcttggagccggcgttgcttttccgcgatgcgcccgcgttgactttccaaagccgcaatctgcgtcgccaacgattgcgccataatttttcgaatggttgccaacgaaacgcccaacgtcttaaagaacagaatccgttgcaactcgtctacctgggctttcacgtaccaccgggtgcccgactccgtacgccgcgccggtactagtagcccaatctgatcgtaatagcgcaacgttcgcgaactaatccccgccagcttcgccaaatcttggatggaatacatcccctcacctcctcaaaatcattatatgggttgccgtagcgtcaatttcaagcccttttggtaaattatttggttacgtcaaaatgataatttcccgggtagaactgaattcggtaagcccggtacgcgtaggtcttatcggccggattgttgctcaaggttgcgttgaagacttggttcccatcggcatcaacttcgatcacgttcgattcttttccgtcgtttttgtagccaaaattaatcaaggtatttccgttagctaatcgttgtgcataaccgatgatcggcgtaaagtttgcctgacccagtgatttcccgtatgaccattgctgggtgacggtcttcttttgctggtcaatttggtaaaccgtcgctgcggaatactttccggacgtcttctgatcgccattttgcacggcaatgttattgtcatacagcatgatggtttcttgattgcccttttgactcaagaggtaaacgccgtgctgtccgccggtaaccttagtattgccggtcgggctcagcaccttgtcacggtattttgccggccagctattcttgtcctttcctgagaaaatccactcgattttaccagtcgcgtaatccaattgcatgactaagtcttggttccgcgccgaaaccagcagtttgcccgtcttagaattatagtccagcgcgttgatgtgcagccagtcggtcccaatgttgccgtcgctagccttttgcttgctatcttggtacattgaagccggcaagatttgcttaaagtcgagtactcgcacaattttaccagtcttccggttcagttccacgaccgtatcctcggtgtacttacttccgtccgaaaccgtcagcaacaaattcccgtttggcaattcggcgatgtcgtggtgaattacggttacctcgtgactaaggttgccgccgagggtgccgtcaaaggaatattgccggtaaattcgccctagatagtcggtttccgtgaggaggttgtatttcccattttcggaactcttatttaagaccatgatgtggccgttcttgagctgttcgaacatgtgctggttccagttagtggagtaccagcgaatctggccatcggcgtccattgcgtaaacttgcttagcggtccggtcgaccagggtcagttcgttatcgccaatttgcatcttcgacttatcgtttttcgtcaccttaacgtcattttggtcaaggtacttcggtaacttgccggtcttgattttaattgttttagtttctttcttaccagattggtacttcacggtgatttttacggtattttcgtagtccgcgtataagccaacaatcggtaactggtgcttagtttggtaccccttcaccgaattagtgatcgaagtcttatctgatttaccttcaatcgtgtaaccaacctgtgcttttttcggcgttttaaagtataccaacgccgttagtggtgaagtcttatagggattcacctttatgtatggattttttaaatcgtagtcgccatctttaacaattttagcgtactttttggttaaggcggtggtgctattttcggtaactaacttcgttcccagatttttaataatttgctcttcggatagtaggtcgcttttagagtgcgcggtgtattcccaccccgcgaccgctaccagcgcaaccattaaagctgcggcaaaaatgagccatccccgaatttttttcattacatcccatctcctttaatatcgatatcaacattgctgtagtttatcggggaaatgtgttttgaaaatgaaaaagatgggagcttttttgaatctttttatgaattccgttaacggaaagcggtttatcgttcatataattttcttaaagtattgaaagctgactttgttttctggtttaaaccataaaaaaatggaagcttttggctaaaagcttccattataagtgtttatttatttttacttacgtttttcgttatcttcgctcggcgctacgaaactttttcgaaaactaccttacgtttaacctgaccttggcccgccttggcgatttggtaagtaaagctccgggcggtgaacttcttattcgttgccagaatgtggttatattgccattgggaaacttggccgtccctggtttcttctgccaaggttaaggtaccgccttccgccttatagctccaagtagcactcttttcttgggctttatactgccggtcaaaactacttgcgctttggctagctttggcagcatcggccttgttcgaactcaccaccacgtgatcgccgctttccgcaaaagttaagtacactgacttatcctttgataagccctgataaatataagtattaccaggaaccttcttagctacggcgtggctcatgttccagtagactcctccaccgataattaccagcacggcaatgatcacgcccacaatggtccactttttcttcttcatttaatcaacaatccctctcgttaattattcaacgtcatcgtcttcaacgtccgcattggtgtcgactgcttggtcactgtcttcatcgtcgcttttgttgtcttgcgaatcgctgtcttcatcgctatcggtatccgcatcttcgtcgtcattgctatcttcgtcttcggaactagcagtatcttcatcatcggatgattcactgtccgcatcgctactgtcttcgtcgctatcggcagtgtcatcgctgtccgaatcatcatcggacgtcaaacttaagttaaaggtgaagtcgtcatcgtcagccgtgatcgtcaattcgatttcgtcggcgtcggtaacgtccttatccttgtcgtcttcctttaattgtttaacaatcttgtcggccaactttttagcgttcttttcggttaattgatcgctaccggtagagacgctttggtcatcgtcgtaaagggtgtcggtatcggtatcagaatccgtatcggtatccgaatctacatcttcgtcggcagaatccgtgtcgtcactttcatcgtcggcatccttacccgtgaagtcaacggtcaactggtcgtcatccaagttcaatttatccttaatttcgtcttggatagcatccgaaaagtcggtttcgtccaattggtccgcatcttcactagattctttagcagcattatccgaagaagcggatgatgatttgtcatcagcatctggttgcggatcttttggcgattcgtattcgttcttcacgctgttatcgctattatcaatgtgtttattggaaactggcgaaacgtcgatatttaccgaatggtcgctattatcggtaaagttattgatggttaccttggtcttggcaacgtagtttccgtcaccttcataactccagtcgctaggcacttcgccatcccggttcaataccaaaacgtcgcccgcataaatcaggtcgatgttttggatccggttgtcgtaagccaacttagctactgaaattcccgttgcgttggaaattcctgaaagagtgtccccccattggatcacgtattggtcgccgtgtaaattattcacgtcgatatgttgcgaactaaggttattactaatctcttgggaagtgttggccacccaattagtaatgtcggcccgttccgcgttggtttggctagtgtaaaagctatcggctagcgcggtggctgattgcagtgtcagtggggcaaataataaggcacttgctaaagcagcacccgcaactcttttcttattcattgaaaatcctccatttgcgttacagtgtttaagctacattttaatactacctcttcataaatacgttttcaatgcatatattaataatcacgtaaaaaaaacgaatgcagcggcatctacgccctgcattcgttgaattgactgtaaaataaattattttttagttcttagtatgttgttttttacgcaactacgatggttccgttagccacgagataaatagctactacactcaaaaggaggattaatcccatcaccgctttttctttgccgccaaggtcgcgatggtcttcgcgaacggcttggtagtaaatgatgaagccggggatgaaactaattgagactaatagcatttgttgccatccggacaggaacatgcaggcaagcatgaagagtgcggaaagcaaaccaatcgtgaattgtccccattcttggtgtttgtgactgtacttcatttggtacaaacctacaaagaggtacgagaagaggattgcagccgaagctaacgagtaagcaaagttgtaagcttccgaagtaaacagtaaggagaacaagaagattgtttgtaagatcgcggtaatgtaaagggaagcggttggcgcgtttttctcgttcaaccggccccaaagcgaaggcattaccttatctttagcgattaacatggtggtttctgctggcaacatggtccaggataaccacgaaatcacggtcgaaataatcaaaccaacgttgatgatcattgctccccaatgaccaacgattaattcaaggtcgtttcctaacgccggttggctagctgaagccagttgggcccgagttaaggttccgtaagggatgattgaaatcattacgtagattgctagcaacatgataaatccaatgatggttgcttgttgcgcttgactacgggttttagcccggtggcccataacggacgcaccttcaaccccgataaatacccaaatcaaggtggaaagggttcctttaagctggtcgaaaactgagccagttaccgtacccttagagaagttgttggctacgtttccccagaagtcggtagtaaacatgtgtcctttaaagaagataatcgtaataatgatgaacaagaacaacgggatgaccttgaagaaggtcccgatggtgttcacgaacgacgcactttccactccgcggttaactaggagggtcagtgcccaacaaaagataattgctaaaatgatcgacggcatattttgtccgcctttaaaggtcggaatgaacgttccaatcgcactcattaacatggtcgcgaaggccacgtttccgagccaagctgataaccagtaggcccagccggagatgaattctcctagcggaccaaatccagcacccgcgtaactgaagattccggcttcgaggtccggacgcttctcagataaattatttaacgacaataccagtagcaaaaagccgataccgacaaaaacccacgatagtaaggcgggtccgggagccgccgctgccgcaaccgtattggtaatcccgaagatcccggtcccaatacatgaactaacgatcagcgcggtcaggcccaggcggccaattccgtttttattctccatattattcactccattcctggatttagtaatcaaaaaggcaaaagcaaactgctttgctattcataccacagttcacttctgccatttagcgtctaaattttactttacatcttcacgaacaattgggcaggacatgcaccgtgggccgccacgaccgcgtgataattcacttgaacgaacttcatgaactaagatgccatgtttgcgtagcaaatcatttgatacataattccggtcgtaagttacaacctcacctggagcaattgccaatgtgttagaaccatcgttccattgttcacgaggagcaacgattggatcaccatttccagttggaattaaatcaatttcagacttattcaaagctttcttcaaaacttctttaatgtcggtatgatgttccatcgtaatgccgccgttttgatctggatgcaatacccagttgtcaacatggccgtcaccatcaaggattgctggatgtactgtaaattggtcatggttgatcatggtgaatacggtatccaagtgcatcattgcgtgattgtgtggaataccaatggcaatcacggtatcgtagttagagtccttaaagagttgacgagtgatgtcttcaatggcgtccgccgtcgtccgttgggaaactccaattgctaatacgtgatcactaagtaccaattcgtccccaccttcaatgtgagtttcatggttccgatcacgccatacttcaactttgccagcaaagcgtgggtggtacttgatgatgtattcagtaatcaatgattcacgtttccgagcagtgaaggtcatcttgttaatggaaattccttcgccaatcgatgcttgtgggtcacgagtaaagtaagcatttggcattggatccatcaagaatggccaatccgtattttctgaaaccgattgcaaatctggttgcgcaatgttgatgtcggatgcccgaacaccttcaataatgcggtccaccatggtttggggatccattgctgacaagtattccatcaatccatcgtgagttgcaccagctacatagccggattctgcaatcatgcgttcgagaaattcgtgacgaacaccttcatcagccaaagcttcggcagccaatttagagaagtaaagtacttcaattccctggtcgcgcaaagtctttgcaaagaaatcatgttcttcttgagcaattggtaaatatggaatgtcatcaaataacagccgttccatatagtccggcgtgatgttttcaatttcacgccccggacgatgcaacataaccgttttgagtttaccaatttctgaggttacatgaattgcttgtgtcatgttgattcactccttatctgtaaaatctgtatttaacaagttaaacgcgcttttattcgtgaataaccgtgccgagtttgcctgctaaagcatcgttcaatccgcttagcgaagtgatgatggctttgcgttctggatggccctttacaaaggacaagcatgcttgaatctttggcaacatgcttccagcggcaaattggttgtcatccatatattgttgagcttcagccacgctcaacgatgttaaggccttttcatccggttggttgtagtttacgtaaacgtagtctaccgccgtcaagatgattaattggtcagcatcaatgttgtcagccaaaagggcgcttgaacggtccttgtcaattacggccggaaccccttttaagccttcgtcagtttcgataacgggaaccccgccaccgccaccagcgatcactaggtcgccgctttcgatcaacgttttgatgctatttaattcgataatcttctttggaagtggtgaagcaactacttgacggtagccgcgtccagcatcttccacaaaagtataacccttttcgctagcaatttggtcagcttgttccttgctgtagaaatcgccgaccggcttagttggcttttcaaaagccgggtcgtctttgtctacggcaatttgggtgattgcagttaccacgtttttttgcatcccccgatggtgaatttcattttgcaaactttgttgtaagtggtaaccaatgtaaccctgactcattgccccgcattcagggaatgggaaggctgcggttttgccgtgttcggctgcgtagttcattcctaggttaatctgaccaacttgtggaccatttccgtgactaatgacaacttggttatcgccattcatcagcccaattaatgatgaagcggtgttctttaccagcttcaattgctcttcaggacttttcccgagcgcattgccaccgagggcaactaccatttttgtcattacgataacctcctagtcacctaatgtagcaaccataattgctttgatggtgtgcatgcggttttcagcttcttggaatactaccgagtggtcgctttcaaagacttcgtcagtaacttccatttcagaaagaccgaatttttcttgaatcttcttaccaacttcagtgtctgtattgtggaatgcaggcaagcagtgttcgaagattgcgtttggattttcagttgcgtccataaccgctttgttaacttggtatggtttcaacaagtcgatgcgtttttgccacatttcgtctggttcacccatggatacccaaacgtcagtgtagattacgtccatgcctttaacaccactcttgatgtcgtttgtaaccacgatcttagcaccagtcttagcagcaatttcgtttgcttggtcgagaacttccttagtaggttcaagttctttaggggttactacgtggtattccatacccataacagcagcaccaagcatcaaagcgtttgatacgttatcttgtccgtcaccaacaaaggcaaatttaatgtccttgtattccttcttaagtacttctttggcagttaagaagtctgcaagtacttgagttgggtggtcttcatcagtcaaaccattccaaactggaacacctgagtattctgctaaagtttctgctgaacgttgtgagaatccacggtattcgattccatcaaacataccacctaatacgcgagcagtatctttaactgattccttgtaaccaatgtgtgatccagaagggccaaggtatgttacgtgagctccttcatcctttgctccaacttcgaaagcacaacgtgtacgagttgaactcttttcaaagattaaagcaatgttcttgccagcaagccgcttaccttcagtacctgcgtactttgcctttttaagatcttctgctaaattaagcatgtattccatttcgcgagtattgaaatctgcaagagttaagaaactccgattacgtaaattaaatgccattgaaaacatcctccttaaggtgactaaatatctttattacacttataatgatagtaagcggtttcacgacactttaggatttaaccttaaattccatgaaatcgttttaattcgcgtacttacttgacatagggcacattttccgtgtataaatttcggttgcaaagtgtataatttggataaaatgatcgtttggtttgaaaaaaaatccattattatatagtcttaatgtataaatattgtataaaacgtttagtttcgtattgcttcatgaaacatcacgatttttcaatactaggaggccatttagccatgaacttttatttatttgaaaacgattcccgtcacaccactacgattcgggatcttatcgaagctgatttcaacaataacctcgtggggatcggagtttcccctacccaagcttacgacgacttgttgcaattacgcgtcgacatcatgattattagtagtaacgacccggaagtcggaattcaactaatcaaacggcttgaacaagttcaaatcaaaccgcactacattatgattagttccgccgaggatgtcgccactaaggaagccgcctaccacgctggaattgacttcttcctagaacatccggtcagtcccgtcgaatttaaacacgtgactcggttagtggcctcctattgccaacagattagtaaactttccgagatttacaacattacgtcgcaagtggtaacgccttttaaccggccccaatccgagcaccgtttgcaaatggaccgggttaacgcgattctgcgcttcttagggatcgcctccgaaaccggcaacaaggaaatcttgaaaatcattcggatcatggtcgaccaaaacatttccttttcgagcatcgactttcagcgcgacctgggtcttgacgaacacgaaaagaaaatcgtttaccaacggattcgacgagcactacgagtggggattaccaacttagccggcatgtgcaacgagtactccgaaaacgaaattttactagaatacgctaacgccctttttgaataccaaaacgtctacattgaaattcagaagatgcgccacgaagacgttcctaacggccaaatctcgctccaacatttctttgatggcttactacaagaaagccacggaaaactttccatttaaatccctatataatagtagaaactttctaaacatcgttacgcgatgttttatttttgcgaaatagtacacccatttcaatatgtaccccgctcatttaattcgtttaacttccgtctcgcttgagccactcgcgaaacttcatcattcataaaaacgcacaaaataaaaatgcttctccagaatgcaaaattctcgaaaagcattgcgattttatactcgatttaaagcgttggttaccgattaattagtaaacctttgtaaaaaggttaggtacgcacccacaatttgtttgaagaacttttgggttgcttcatcaatttggtcgccgtccatgtgttgcgtaatgttgccgatgtaggcttccggttgttgcaataccggcatgttaacgaaggtcaacgattgccgcaagtggtggtttgcgccaaatccgccaattccaccaggtgacacggttaccacgagggctggtttgccatcccaaacgttttgtcccatgggccgggatcctacgtcaatcgcgttcttcagcgccgcgggaaccgaacggttgtattcgggagtaaagaacatcactccgtcaacactttgcaccgcctgccgtaaattttgccaggccagcggcggattgtcggtatccaaatcctcgttatacaacggtaaatcgccaacttcaatccaaactggttctacttcgcgcggaagtaacttttcaaaggtttgggctaccagtcggttaaaggagccctttcgtaaactaccaaccataattccaattttcaaagccatgataataaatcctccttttaaccaaaaaatgtaacaacttagttcacgtatagtataagcgtatttgcttctaaaaggtaagcaatgtgcattattttctaaagcttttttaacggccgcttagtttaccgcaagcaccgtcttcctcctgatcgctcccgggcttttcgtgtaaaaatccatccgtagcctggtcacgtttctaacaaaaaagactccccaagaaactaaaattcttgagcagtctgcttaaattaacggcttatttttaaattcggtgccggttcccctattcaatcgtttcgttcacgattaaccatctaattttgttaattctgagaactcacgcggggcttttcattttaaaagtagtcccacagcatcggtgattctttgcgcaaaacgttgtccaaacctgtaatggccgcgtacgatccgcgaatcgcgccgacccggtttaaatgtcccaaagaacggtacccgagaaacgccttggtcaattcttgaattgaaaggcgaatatccgccatgttggtttcgttgtcactaatcttttcaaaactcgtcccgttactgttaaccattaaccgccaaaccccgttattttccggaatcatttggtcggtaaccgccagccggatacttttgaccttacctaaaaatggataatcttggacgaaggtcgccaaattaataattcgggccatcatgtacggtttaatttccacgttgagcgtatcgggttcttgcaaaatatccggacgaccgactggatcgccacttacgtactcaaagttgaagtacatcgattcgtgctggcaaatgaaccgcgccaagtattgatagctttcccaattggtgtacatgatttcttgaatgtaaaaggtggtgtcgagcccttcgtaaatcacgtacccagccgcggaatgaaggtcatcaaagtagacgcctacttgccaatgcggatgcttaaggacgaggtagtcccaccaccagtccgcccgcaccaatccggcattgtggctatccgggttattattgtagagttctttaatgtacggaatcgcatccttgagcgacaagcgttccatcgaacctgcttgcgaatccacccgaatacgcggcaaatcggtattttttacccgatagatcgtctggtcaaacacctcttcgtaaccaaaccgacggtaaaatttatacgagaatggcgccagataagacaacgcaaccttatccgcgagcatatcttgaaaggcctggtgcattaacttagtaatcgctccgtggccgccatattcaggataactcatgacatcgccgattccgttcatcttatacttcacgccatggaagttgacctggaaggggatgcttaacattccgcttcccaatcgaccatcgtacttaatcccgtacttttccgaatgctggtaacgatggtcgaaaaacgcccgccgttccgcgctatccggattggtaaatgcgtacaagtatagctgatagaaatcattcaaatctgttttcgttaaccgttccaatttatccattttcaatccctctactttagcttaagcgtgttttttcagcgcaacgccgagccccagaaaaatcagcaaactaatcgccaacatggcccggtcgacggtcaaactacttaagggcagctttgttaaaatgattgcgctcgccataattaggaacgcgcccgctgcaccatatttaattaacatcttaaccattattatccctctttaagttcttgttgcaccatttgtttttcagcaactttgaagaatgggtaatagagtacacccgcaatcactagttcaattgccgaccatactccagctcgccaatcccaaccggtggccatcagcggaccgataatcggtggcatcgtccacggcaccatcattacggctggccgaattaggtgcacggccattaacaagtacgtcgtaatcgtcaacacttgcggaaccacgataaacggaattaaggtaatcgggttcataaccaccggaaaaccaaagattaccggctcgttaatttcaaataaggcacttgggaaggctaccttccctaactcccggtaggccttactcttggaagacagcatccagaagaccaacatgatggttgccccggttccccccacgttaacgaacaaactcgaaaatccgagagaggttatgtatgggatggtttggtggtgcgcgtacgcaaccccgttagccgccaaaaattgtaagaaaatcgggtccgaaattccttgaagcgtcatgtccccgtgaattccggcaacccataaaatgctaaccaaaagggtgtagaacatgattcccggcaaactgttcatcgcaaacagcaacgggtggaaaatactttgaataaagtgattaatatcaaaatgaagtggaacccgcaatccccagaaaaatagcaaaatcaaaaatgcgggagttaaggaagcaaacgactgactaaccgccgcgggaacgcccttaggcaacttgataatccaatccttcttcacgaataaacgtaaaattgaaactgaaataaatgaacaaacaattgcagtaaacaaaccagaagaagcaaaattatcagtatccagcgtcagtttgctattaaacgaagtgacgatgaacgccatggtcgacaaacccgcaccgttgattgcatctaaatcgagcgcctttgccaactcgtaaccaattccaatcgtggctaacagggaaataatcccaaacgagccgttaaccgcgacccccatcgcccccatgtacggcttcataaagttcgtccatgcgggaatcgggatgttcgcgataatcaagaaaatcgatccgctaattacggccggtaaggtcaataccagaccgttccggatcgaaactaagtacttattatttcccgccttcgccagcggtggcatcaaactggactgcacccagttcataaaattattcatctacggttcctcctaactacggtaacctacccaaaaatccaactcaaccaacagactaagtatagaaatgtttttgataaatgtaaacccttacaaagaaataattagatatttttgcttaattttaccgcaaacgtgcgttaaaaaattattttttagactggtatatacctattgtgataggttggaacctgctggtggggttatcgtggcaaataaaaagaccggcttagctacatttcaaagtccatcaaattgcactcgtgaaatgcgccattgccgatctaagttgcctagcgataaattgctttgagattgtaccgcacgtattttttaaaaaagttagctaagtaaaccgttgcgttcttcgccatcggccaaatcgaaatgccgagtccgcagaaaattaacgatagcggcacatcataccacgtcaagcttgcgggccaggggaggtgatacgccgttaccaataaccattcaataaatagcagtaacggtgcgctgataaaggttgtaatagtaacccataaacctactagtaacccgatcactgcgacgaccgctcccgccgtaaacaaaacgttaaaccaaaaaataccaaataatgccatccaattaacctgcttcattggatctccttcttcctgaactggattaagaagggatgtattggtcaattcgtcaatcgacacgccataaagctccgctaaatcttttaacgcatagatgttaggagtcgtcttcccttgctcccagcgtgaaatggtttgccgcgtcacgtacagctgactcgccacctccgcttgggttaagtgacgattttgtcgtaccttttgtaatgccggtccgattgacatttgatcaactccttctggcttcattctgccatatcccatagttttgccaagcaacaaccctgttgcacgccccgataccgcggtttatttaacttcaatttattttacgttaaacttcattgaagttaaagtgaagttcagcgaaaaaaagctaggaaaaactaaaaaatacttttcaaggataaaaaagttattttgtttttttgacttcaatagagccaaaacgtgtgccaaaagtcagtttgttccgcttaaccaaaaattgcccatcatgcctaattttggcatgatgggcaattttcagttaatgctcgcaaactaaccgacttttgtcccactctccttttgggaattaacgagtttttcttcgtaccaacaaatccattagagggtttccgcactcaaaactccgtcgttaatcttaaacatttgatcagcgtagtcctttaagcgcatgtcgtgggtaacgatcacgaccgccttattatgttcgtgcgctagtcgggcaaacatcttgccgacttcctttacccgcgaactatctaaagctgccgttggttcgtccgctaggataatcgacgggtccggatacaaggcccgggcaattgccacccgttgttgttgtccacccgagagttcggtaggatatttatctaccaaatcttcgacccccagttgggtgagcaagtcgtttaattctgcttgcgataaattatggtcctttttgaccttgtcaactaacttgaattggtccttaacggtcaggaagggtaacaaatgatagttttgcaacacaaacccaatttcattgagccgtaatttttccaacgccttccgggaactatcctggtagtcatgaccgttgaccttgaccttaccgctcgtcggggtccgcaaaccgccggcaatcgtcaagaaggtactctttccggaaccacttggcccgataattaagcttagggttcccgcttccgccttgaaatcaatgtcgtgaagcacgtgcacttcggcaatccccttcccgtaaatctggttaatgccgttcatttcaattgctgccatggttttatcctccaatcacacttaccgggtctagtttgatgacgctacgaatcggaactaacgcacctaagagcgccgtaattactaatccaacacccactgcggataacattggcacgtcaaaggccattggaaccgctggtggtaatacggccgccgtggcaatcgtcaacaacgtaccgataataattccgctaactaccagtactaatgattgcgcgattgtgctccacgcaattacccgactcggaattccttgggcgcgaagtaccgcatagttaggtagcttctggatcgtcaaaatgtacaagaagattgcgatcacaattaatgaaattgccatcaggaagccgatcatcaaagcaaaggtcatgttttgtgcggaatatcccggcagtttttggataaaggcttttttagtgtaagtcttcaggggctttttcacctttaaatcgtttgactttgaaacgattgcactggccttggtttggggcattgcccgtttcaaatcccgccagtcatccaacgttccataaattaccggcgcaatgtttaacttcgcgttatgagtgaacccgacaattttaaaggtttggtccgcgtcgtttaacttcaatttgtcgccgattttataaccgctttgctcaaacttatcgtcaaccaccacttcatggtcgtgtttaattttgtggccactggttaatttcaattgtttggcaataaattggtcattttgaattcccacgaaggaagacgaaattttttcgtgcttgccttccttggccactaccgaaatttggccgatcagggcgtcatttttggttagtttttggtccttgacctgctgatccgtaattaaggattggctaaggttaaagtttgcatcctgattcaaaactaccgaattaattttccaagagttgatggcgtcggtattttggtgggctaaccccagggctaaactagtcaaaataaagattaggtagctaatcaagacaatcatgccgataattagcgaataccgcaacttttcgcgtttaatctccttcaaagctaaaaacatatctattcctccagaatttttaggatcttagttagttgtgctaaacgagcttccgcagtctccggttccacaatcgctccgcgcagcgtgtcgtgtaccaaggtttgttgggcccattgccgttcaccgccggggtggaccggggcaatccaatgggccacgtacgcttcgttgtggcgaaagtgcatttgcaataactcgtagtatttactggaatgcgcattctccacaaaatcacggaccgtggtcactaaagcgggacctcgggcggccgggacgtgcaaagattggtgaatgtcgtgcatggctacttggtaaatgtaacggtaagcgtcaattaaatcagcaaaataattgtaaaaagctccccgtgaaatgcccgcatccttaacaatccgagcgacctgcgcctcggcaactgggtaacgcgaaaattccgtcaaaagggccgtttcaatcgccgcttttttagttggctttaacttcaccagcgtctctgagggcaaccttgccacctccttaatcaaaaatgacaccgtgtcaatatggttagaataccacattctgacacggtgtcaattttaaactctcgttttaacttccaaaagtttagtatttacctgccgaacaaattcccgatcgtgatcaataagcagcataggcggccgtactcgtagaattaactgttggatttgttcccgggtaattacgtctaagtaattcaagggttcgtcccaaatatagaggtgggcgggttcacaaagcgcgcgggccaaagccactttccgtttttgccccatgctcatctgttcaattcgttgggtgaacatttcccgttcaaaccctaattttcgcaaggtggctaataagtcctgcaactctacgccctttgcttgcgcgaagcttgctaaatccccgcttagtgcgtcaaacgcctggggaaggtaggaaaccttcagcccatttcgtaaattaacggatccggtcgttcgaagctccggatttcctaaaattgccgcaattaaggtcgattttcccacaccgttgggtccctggagcacgatccgttcgccagccttgaggttgaaactgatcggttggtttaacggtccctttccgcgacttaccaccagttggtcaaccgttaaaaggctcgcatttaccggaagtcggggaggattgtagttcaattgaagttcagtttcaatctcgatatttttcaataaccgttgtttatccgccacttttgcttccgcgcgggcttgaatcgtggttgcccgcttcatgattttagcagctttatgcccgacaaaacccttatcgggcgcgcccgccttttctcgttcggtcgccattgaccaattttgtttctggtgggcggccttggataattgcttaacttccttctgcaaggtttccttggttcgccgctcccgctcgtcttcgcgttggcgttcagttgcccaagtcgtgtaattaccatgcaagctcgtaatttgagcccggtcaattgcgatgacgtggtcgattacctgatttaaaaaatcgcggtcgtggctaaccacgataaaaccctgttttcgctttaaataattcgccaaccgttgccggccttcatcgtccaagtggttggtcggctcatcaattagttggaaagcccccgcattcgcgaacatcgccgctaattgcgctttggtacgttgtccggggctcagttcgtcatacggtcgcgcaagaagctcgttgggcaagccgattcggtccatttcccgttcgacttcccaaaaattagagtaatcccgttgcgtgatttccatcaacaccttttccaaaggcgcttgaggattggggacctttgctggaaaataattgaactgcaaatcggtgtttacctgcccttgataaggcacctgtccccgtagaatttttaataaggtcgtttttccccggccgtttcggccaattaagcccaatttccaccgggcgtcaatttctaaattgaccttctcaaacagcggggatacttgttgatcataactataacttaaatttttaatttgaataattcccaattagctcgcctcccatttttttcgggagtcgacgatttaagacacaaaaaagcactaggtgtgcagttcctagcgcagtacaaaagtgcaaaataccaatataacttattttggataggcaccctgactggatcaaaaaccgcagactactccgaaaaacaaagaaatcgtcatttcttaatcttcgaaaattagtctgtaatcttcaatcccatcaacatcccttccattgaatatacgcttatggtaacaagcccgttaaattttttcaagcaattagcccattttgtaacataccgtaaaaaataaaacatattaaccaattatttagaaatatttgtaacggtaaaaattatttcaacatgagtaatagcccgaaaataattaaggccccgtaaacaaacttaattgctcgggccggtgccattcgatcaacaatccagttgcctaagggaaccgttaaaactagcccggggattaccattaggagcacttttaccgcttcaagcgaccaaaatccagccgcaacgtgactaatcaccactaaaacacccacgcaaaggaaatgtgcttggagaattgctcggagatgagcggccggccactgcttcaacattccatagaccgccaccggcaccccgtgactgttataggcgctccccagcgctcccgaaaccattcctgccaaataatcgtagctttttgctaccaaatgcggtttccctacgcgccctgaatgactccgccacaaactgtagccgccataaacaatcaaaaatagtcctaagccatgtagcaccacgcttgccggtaacgtttttacaaggagaattcccaggggtaccccgattaaagagccggtcactaaccggcgaacggcccggaaatcaatccggtgccactcccgaatcgttgccggcagcgccaccaataatcctaccgcgccaatcaacgccgtactcgttttcaaatcgtatcccagtaacgccaataagggcattgatactagggcttccccaaagccaaacaccgttcgaactaacgcccctacccacgcaatcagcaaaactcccagaatgatcaaaatagcttcctcgttttccttcttattaagttaccattttatatggtaatcgcgttttgcaccagagccaaatgcccgaaaccgcaattaggcgggtaattttgtacttcatttcttaaactgaacttcaattctagcttaataattaggatttaacttcaattttagcttcaataacttaaatttaacttcatttgcgataaatgtttggcgtttgcggccattcgttataagatagttccaaggagttgaatattttgcatacatttaccattgtactaattattttaatcggattagaacacgttggcatcatgggactggaacttttaggcagcgaccggctaattgcgaagagttttaacttaccgcttgctgaagtcgaacggcctcatttacggacggcgcttgccaatcagggactttacaacggctttgtcgccttgtccttattcttaatcatcttcatccccggagggaccctgcttcgcggaatggcaattggcttgctagccggcatcttcatcattgctgcttacggcgccctcacggtagctaaacgtattctgtggatccagggagcacccgcgctaattacaatggtgctggcaatgttctttttataatatgatttaagtaaggcgcccgttgcggggcgttttttattgagcccatcctccactttcccgtgggggttaacgcagttttaatagtcatatatctaatctggtcaatttatttattacttccatagccttataacaaaaaatggtagctttcagcattaattgtctgaaaactaccatttttattatgaagctaattattgctaacactttcgccctgcatcgtggaagtgagtgctaccaaccggtttctgccggcccaaatttcgtcttattcctgattgttatcgtacaaggtcgccttccgcttcgtactttcgataatcaatgcgattactaccagcactactaaaatggtaaataacccgagactatacaagaagacaaaggaagtcgactcaataatcatactaccgactaacggtcccattgcccgaccagctgacggaaaggcactcgccaaaccttggtacttacccttttggtcatatggcgaaaggctattaacaatcgctggaatcgatgggaaggcgattgcttcacccacggtcaaaacgatcatcgcaattacgaagtggtagtactggtgtgccacggccaaaattccaaaggaggccatgaagaacgcgattccgagataaacttggtgatacgggtcctttaacaaacggccgcctcgtgaacttaagaggccttgcacaatcaaaataaataatccgttaaccgtccaaaggaaactgtataaacgaagcggaatgtgcagtttcaacatgtaaattgaaacggtactgttccattgttggtaaaagatccacataattaccaaactaacgaaaaacgacataataatcgtaaagttaaccttaggcattttggattgaatgtcttgagactgttgcactgattgtactgattggtcttcctttgggattcgataagtgaagaaggccaccacgaagaatacggtaaacatgaccgtcgcaatcgtgaaaagcggcgcaacgctgtgtttgaagaggattcccacaattgccgttcccagcattactcccaaattttgtacgaagtatagcatattaaagacgtagcgtccgtccttgctcttgattgaggttcccatggaattattcaaagcaacgatccagccggttccaaacccgattaacacgaggaaaattgggtatgtgggccaaccattgaagaaaattagcgtgaaaaatgaaatccaggtgaacacaatcccacccagaattaaataatagctatcgtatttgtcgtacagtttcccggcaacaaatgatcctaaaatactcgctactgaattcaaaaacaaaactactccggctgccaccaaggaatggccaagctcttgattcatataaattgtcgttaggggccacaccgagctcatcgcaatactatcaatcaaaacccctaacaataaccactttaactttaattcgcgcataattccctcccaatttttttataaagtaaaagactgactcaggcgaaatggtctgaaaccagtctttgaaaagaagtctcctcctaatcgccctagcgcgctccggcttcgggcatgtatgctaatgaagaaaatttattgtatgacttaataaacagcaggttgaccgtcccccgggcaccacttcggtttttttcaataatgacttccaccggacccacgttttggtcttcttcgtcgcgggggtcttggtcctgatcctgctgattagtcccgtcgtctcgttcgtagtagtcctcccggtataggaaggcaacaatatcggcatcttgttcaatcgatcccgattcacgaatatccgacatgacgggccgtttatcctggcgttgttcaactccccgagaaagctgggaaagcgcaataactggaattcccaactccttagcaagtttctttagttgacgggaaattgcagaaacttcttgttgccggttttcaccggaaccttcgattagctggaggtaatcaaccactactaaccctaagtttccttgttctttagccaagcgccgacatttcgcccgaatttccgacatcttaatgccgggagtatcgtcgatataaatgttggtctttgctaacgaacccattgccaccactaaattctgccactcttcttcatttaactgaccggttctcaaatgatttgcatcaatacttccttcggcacacaacatccggttaaccagttgttctgcacccatttctagactaaaaattgcgacagctttatccgttttggttcccacgttttgcgcaatatttaacgcaaaggccgttttaccaaccgccggacgcgcagctaaaataattaattcgtccgcgtgcaagcccgtcgtaattttatccaattccttaaagcccgtcggcaatcctgtaatctcatcatcattttggtacaggcggtcaatttcctccattgaagaagtcaacacgtctgtaatgggcttaaatccagtctggttgcggttttcagccacgtccatgatttcgcgctcggcttcgtcaagaatttccgaaacgtcattttcctgggtgtagcccatggtggcaatcgaggtcgccgttttaatcaattttcgcaacagtgccttttcttgcacaattttcgcgtagtagcctacgttagcggccgtgggcacggaacctgctagttcggcaatgtacgtaatgccgcccgcatcttcaagctggtggtgctcttctaaggcattattgaccgttaacgcatcaattgcttcgtcagcatcgtttaactcgaccatcgtcttaaaaatgacttgatgggcgtgtttgtagaagtcgtccgccgtgacgaattccattgcgtcaatcaacgcatctgaatttaaaaaaacagctcccaaaaccgccttttcggcctcaatattttgagggggcgtttgattttctaaaatcccgttatccatgatactctcccatgctcaaaatctagagttgaaagctattttcggcgacctatttttcagaaacgtgtacccgaattttagccgtaacttgttggtgaagcttaacgggcacgttggtgtaacccatgctccgaattggctcgttcaactcaattttccgtttatcaatcttaatatcaaactgttgttccaatgccgtggcaatttgtttgctaggaatcgaaccgaataaccggccgtccttaccagccttggccttgatttccacgaccgttgcgtcagcttccaaaacttgctttaacttttgggcttctgctaacacttcggcttcgtgcttttcttcagcctttttttgtccctttaattcgctcatggccgccttagtagctgccttcgctttaccatttttgattaagaagttttgcgcgtatccgtcggggacgtttttaacctctccgcgtttacccttaccctttacgtcttccataaaaataactttcatcagaatcactcctcttcttcatctttttgcaaaagtgcaattagttgatccttcgcgtcggctactgtaacgtccttcatttgggtcgctgccatcgctaaatgaccgccgccgcccagttcttccatgataatttggacgttttccgtaccggcactgcgcgctgaaattcccacgacatcttcagatcgtcgggtaatgacaaacgaagcctccacacccgaaatgtttaggagggaatcagccgcttgggctgcaataactggatcgtattcccgatcctcttccccaacacaaatcgcgtacttcacgtcgacaaattggaccgtgtcgatcaggtggttgcgttgcatatagctttccacgttttccttcagcaagtaccgaatcaagtcttcatcggcccctaccgagcgtaggtaacttgccgcgtcaaacgtccgggttccggtccgttcggtaaacgacttcgtatccacttcgattccggccaaaattgcggtagcttcgataggctggatcggatcgccatcatgtgattgatattcgaacatttccgtaatcaactcacccgttgaagatgcgtaaggttcgatgtacaccagcacgggattttccggaaattcggtaccgcgacggtggtggtcgatgataatcgtccggtcgcttaacttctcgaatagttcctttgaagtagtcattgatggtttcgaatggtcgaccatcaccagtaaactctgactattagccagttccaaggcttggtcggcgtcaataattgaatcccgaatgtcttcgtgttcgtctaacttatcaatcaaccgtttcacatcggaatggacgccttcttgatcaagaacaatccaagcttcctttttgttcatctgggcaatccgccgaattcccagcgccgaacctaacgaatcaaggtcagttcgagtatgtcccataacaaagacttggtcggcttgattcattaattcttggatggcttgtccaatcatccgcgcccgtacccgggttcgtttttccatcgggttcgtctttcccccgtagaaacgcgcaggttcatcttcagccttaaccactacttggtcaccgccccgccctaaagcaaggtccagattgctttgtgacacgtcagccagtttattaaggttgtcatccccataagcaatcccgatactcaaggtaaccggtgaattttgcttcgaagtggcttctcgaatcgtatccaacagtttgaaactatcttcttcaaccttttgtaaggtttcgttatacataattacaaaaaagtggtcgtcatccacgcgccgcaggtaaattccaaacgactgcgcccaactagaaatctggttggtgacgaagttattcaagttggaaacgtccgagtccgtcatggcttgggtaatttcatcataattatcgatgaaaatttgtccaattaccacctggcgattttcaaaacgattttccatttgtgcgtagttagtaacgtccacaaagtacgccacccgctcatctttttgcaccagtacgtcaaaagtccggtccttccattcgacccggttaagcccttcttggtcttgatgccggtcaatgacttccgccaagtcttcgtcaacttcggtcagcaaatgcccaagtaccttttggtcaccaaagtaatgttgcaacttgggattgacccactcgacccgcttttgatcactatagattaaaattccgatcggcatggatagcattgcatcttcttcagcttgatcaacccgaaaagatagctccgcaatgtatttactggtttcgtcactaattaaattcaacgtccgtacgctgaaaacccccgtcacgataaccaagcctaacattatcacgccaataaccggattaatataaaacgctaatcccagtccaatcaacgaaagcaccgtaattaccacagcaacgattcctactcgcggattacggataaacgctggtagacgatcgactaatttcataacacttctcctaaaaaaatgtgtctaactatctttgattttaccatacttggcttgacataaaacagccgtttagattggaaagttcgtcgtcaaaaaatcccctatatttagcggtttgcgcttagctcagccacaagaaaaagagaccagaaaaactaattcgtttttctagtctctatgttcgcttactttgattactttaccgaagcttagtcttcagcaacgaatggtagcaagcccatgatccgtgcgcgcttgattgcgattgtcaaacggcgttggttcttagcacttgttccactaacccgacgaggtaaaatcttaccgcgttctgagatgaatcgttttaacaattcagtatctttgtaatcgatgtattcaatgtggtttgcagcaatgtagtcgactttacgacgacgacggccgccacgtttttgatatgccattagtgattgccctcctctataatttgattttagaacggtaaatcatcgtcagaaatatcaattgactgtccgccatttgcaaacggatcgttcgggttcgaattgttaggctgcgatgcagcaccattgttattcgcttgaccactgtcaaaaggatttccagcagatgattgtgaaggggcagattgaccgttgttgaagccttcattttcttgacggcgttcggaagccgaacgggattcaagaagtgagaagttatccgcaacaacttcggtaacgtatactcgttgtccttgttggttttcgtacgaacgggtttggatccgaccgtcgatacctactagagagcccttacgcgtgaagttggcgaagttttccgccgctttccgccacattacacagttgatgaaatccgcttcgcgttcaccctgtgagttagtaaactgacggttaaccgccacggtaaaactaactacggcagcgccactacttgtatatcgtagttcaggatctcttgttaaacgtccaactagtacggcacgattaatcataatatccactccttccttgatttttaacgattattattaacgtacaacgatcatgtgacgaagaattccgtcagcaatctttgaaagacggtcgaattcgttcaacgccttgtcatcgctagctttgatgttaactacgtggtagataccttcgttaaaaccaccaatttcgtatgcgaaacgacgttttgaccagtcttttgaatcaacgatttcagcaccattgtcagtcaaaatcttgtcgaaacgttcaactaaagctgtcttagctgcatcgtcaaggtttggagcaatgatgtatgtgatttcgtaatttttttccatttgatatacacctcctcttggacttatggccttctatcaactgtagaaagcaaggagagtctgccaaaaaacgctggcaactcacaaataaagattataacattcaacgtagttagacgcaataacaaaaagcctgattaacgatatacacttataaagtacttcgaaaatcagacttttattttttattcttcagattgagtttctgcagaagctgctggagcttcattagtagcggcgctagtgtcggcagagttttcggattcgtcgtccttttcctcttcaacaatcgccatcgtagctaccttagaattttcgtccgtcttaatgacgtgtactccaagggtagaacgaccggttgtcgaaacgttatccacgttaaaccggatcattactccgcggtcggtaattaacataacgtcttcgttaccttccacggtgaccaagccagccaacggaccgttcttttcggtgatgttggcagtcttgattcccttaccgccacggcctttaattgggtattcttcggcaggcgtttgcttaccataacctttttcggtaatgaccagtaccttgctttcaggagcaagcaccgcagaaccaactacgtagtcattctcccgcaaccgaattccgcgaaccccggttgccgagcgacccattgaacgcacttcgccttccttaaagctaattgcgtaaccgttgtgggtaccgataatgatattttggtgtccgtcagtaattaccacgttaattacttcgtcgccgtccttgaggttaatggctttaagtccgttgctgcggatgttcataaattccgcaaccggtgtccgttttgccaccccttgtaaagtggtgaagaagaggtaacgatgttcgttatctccatctccgttaccgaggccgatgttgattaccgcttggatactttcaccactatcgattcccaacaagttaattaccggaattccctttgcggtacggctatattcaggaatttcgtaacccttcatccggtaaacttttccggcattcgtaaagaagagtaacacgtcgtgagtcgaggtagaaaccaggtgttcgatgaagtcgtcttcgtgaacgcccattccttgaattccccgaccaccccgattttgggtcttaaattcggaagttggcatccgcttgatgtaaccgttatgggtcaaagtaaccatgacgtcttcttcttcgatcaagtcttcgtcttcaaggctgaggacttcaccgaccatcagttccgtacgccgttcatccccgaatttttcttgaatttcaagcaattcgttatagatgatttcatggatccgttcggtatgagccaagatatcacggtagtcggcaatggctgccataactttccgatactcgtcttcaaccttttcccgttccaatccggtcaagcgcaccaaccgcatgtccaggatggcttgtgcttgtttactagaaagcgagtagttgttcatcaactggtctttagccacttcagccgtttgggatccgcggataatggcgatgatttcgtcgatgtgatccaacgcaattcgtaaaccttctaaaatgtgtgcccgcgcttcggccttcttcaagtcgaattcagtccgccgacgaaccacttcttcttggtgttgcaagtagtattgcaagatttgcttgaggctcaatacctttggcgcaccattaacgatggctaacatgttaaatccgaaggtcgtttgcatcaaggtcatcttgtaaagattgttcaacactactgaagcgctgacgtcgcgccgaacatcaataaccactcgcaaaccgtcccggtcagactcgtcgttaacgtccgtaattccttcgatccgcttatcacgagctaactcagcgattcgttcaatcaacttcgccttgttcaccatgtatggcaattccgtagctacaatccgttcgcggccgttcttttcagtttcaatgtccacttttgcgcgcaaaatgatcgttccgcgaccagtttcgtaagctttgcgaattccggatttacccatgacaattccgccagttgggaaatcaggtcccggtaaagcttccataaggtcggccgtcgtagcatcctcgttgttcatcaaaatatgaatcgcagcgattacctcagaaaggttgtgcggcggaatgttagtggtcatccccaccgcgatcccggtcgctccgttaaccaagaggtttgggaaacgggacggtaaaacggacggttcgcgttcggtaccatcgtagttttcttggaaatcaacggtattcttgttgatatcccgcaacatttccaaagtaatcttactcatccgagcttcggtataccgcatcgctgcggcaccgtcgccgtcgaccgaaccaaagttaccgtgcccatcaaccaacatgtagcggtaactaaagtcttgtgccatccgaaccatggattcgtaaatcgctgaatcaccgtggggatggtactttcccattacgtccccaacgattctggccgatttcttatatggtttttcgggggtaacccccaactcgttcatcccgtataaaatccggcgatgaacgggtttcaaaccatcacgcacgtcaggtaaggcccgcgcaacgataacactcatggcatagtccaagaatgatgtgcgcatttggttacttaagtcaacgtccgtaatgcgtcctgacatatcttctggcaattcattttcccccttaattttctgggctgttttaaattatttaagtttaaatatccaagttttcaacgaagaccgcgttgtcttcaatgaatttgcgccggggttctactttgtcacccatcagcatttcaaagtccccgttagcagcgtccaaatcatcagctgaaacccgcaataagcgccggttttccggattcatggtcgtttcccagagctgttcagcatccatttcaccaagccccttgtaccgttggataactggttttggcgatggtgaaagctgaccgagcacggcttctaactcttcgtcggaatcgatgtacttgatcatcttaccttgccgaacttggtacagaggcggctgagcgatgtaaacgtagcctgcatcgatcattggccgcatgtagcgatagaacaacgttaagagtaaggtccgaatgtgggctccgtcgacatcggcatcggtcatgatgattagcttatggtagttagccttggttacgtcaaaatcttccccaaagccagttcccaaagcggtaaatagcgaccgaatttcttcgttagccaacacccggtccaacgttgctttttcaacgttcaaaatcttcccgcgaatcggcaaaattgcttgcgtgagacgtgaacgaccggctttcgcgctaccaccggccgagtccccttcgacgatgaacaattcactaatttcagggtccttagaggtattgtcagctaatttaccaggcaggttgtttaattccaacccgctcttcttacgcgtaacttcccgcgcacgcttagcagccacccgcgctttagcagctaacacacccttgtccacgatttgccgcgcaacttttggattttccaacaagaacttgctgaatgtttccgcaaacacttcgttaaccgcggtccgggcatcggaattgcctaacttggtcttggtttgcccttcgaattggggatccggatgcttaacgctcaccactgccgttaaaccttcccgaacgtcatccccagaaagtttgtcgtcgttttctttcaaaattccggtatttttcgcgtaatcgttaattacccgagttaatgcccgtttgaacccttcttcatgggttccgccttcgtaggtgtgaatgttgttagtgaaggtcaacaacttgctttggtaaccttcaatgtattgcatcgcaacttcaaccgtgattcccttagtgatgccttccacgtaaattggttcagggaagatcacttctttgcctttgttcaagtattctacataatgccgaattccgccttcgtacaagaagtcgtcttcggtaggcttttctggtcgcatatcccggagggtaatccgcaagcccttgttcaagaaggctaactcgcgaatccgggtccggaggatgttgatatcaaagaccgtagtttcttggaaaatgtctggatctggaacaaagtgcacgatggttccgtgatcgtcaggattcttggtaggcccaagaaccttcattggggtttttacttttccttgttcaaagtcaatgtagtaaatcttaccgtcgcgcataacccgtgcgtctaattcggtcgacaaagcgttaactaccgaagcccccaccccgtggagtcctccggaaaccttgtaaccgccgccgccaaatttaccaccggcatgtaaaacagtataaacagtttccagcgcgggttttccggtcttcttttgaatgtctactggaatcccccgtccgttatcactaacggtaatgctgttatctttttccacgaccacgtcgattttatttgcaaatccggctaaggcttcatcaatcccgttatcgataatttcccaaaccaagtgatgaagaccttgggaactggttgaaccaatgtacatccctggtcgtttacgaactgcttccaggccctctaagacctgaatttgactcgcatcgtattctttggctaattctgctttcgtctctttttcgtctgccaaaagctattcctcctcgttttgcgttaaaactccgtggtcaatgttaaagacgtggggttcgttaattaattgttgcgccacgccacttaaactagtggtcgtgataaaggtttggaccttattttgaatcgcggtcaacaggtgcgtttgccgactatcatctaattcggaaagcacgtcgtcgagtaacagaaccggatattctccagtttcttctttcatcaagtcaatttccgcaagcttcacgcttaacgccgtggtgcgttgttgtccttgggagccaaaggtggagacgttttttccgttgacgataaacttaacgtcgtctaaatgtggtcccaccaaagttttgccctgttgtaactctcgttggcgatgctttttcaacagctcctggagcgccgcgtaaatggtttcggtcgacgtagtctcatcctttttgagcggagacacgtattgaaacgttaatttttccaaaccttgcgagatttcttcgtgtacggcttgcgaccactcttccagcttttttaaaaactgaattcgttgaaaaatgatttcggcgccatatgccgctagctgatcactcaaaacgtccagataaacttggtctcccttaggatcgatttgcagctgcttaagatactggttacgctgcttgagcaccgagcgatattgcgcagaattgtacaggtatttagaactcatctgcccaaattccatatcaataaaccgtcggcgaactgctggagagccttttacaatcgaaaggtcctctggagcaaacaaaatcacattgagttggccaacatactgtgataaccggccttgctcaatatgattaactttggcatttttccccttagaagaaatgtcgatttccaccggggtttgcgtatgttctttttgaatggtccccaatacccgggcttccttagctttccagccaattaagtcgcgatcgttgctggttcggtgactgcgcgttaacgctaaaaaataaatcgattctaaaagattggttttaccttgggcgttttcgcctagcaaaacgttgatccccgaaccgaattccacgctaaggtccgcataattccgaaaattatgcaactcaagtgtttttaaatacatttacttcccagatttcgtcgtaatcttgaaggaaccttcgtcaggaacttcgatgacatcattagcgtagagtttccgtccccgccgatcgtctggttcttcgttaactaaaacagtgtgttctcgtaaataccactttgcttgtccaccggttccgataatgccctcttcttttaaaagttggcctaacgtaatgaacggtgtgttgatttcaatttctttttgcatgacatcaccccacatatcttcttatatattatacccttattttggacaaaaaacaatcgaatcaggcgctcaaaaggcttttcagcgaatttaccccctttgaatcatttttgccttaagaagggtaatttttcttaaaattaaaatgagggggattataaaagagtgcattgaaacctgggtaggctttgaggactaaccaagctaagggattaatcacgaacttggtgattgagcccttagcttggttagccgcggaagactggggttcaatgcacgtttcgaccatgctgcagcggagcacaaggattaactgaggattaaccttaaccgcgggttaggtggttgaggctaatccttggttaaccggaagaaactgggtcggggcgcacgtttcgccttcattgcgggaaagcgcgcgagcttaatctgggtgcttcgtttcaataaagcgaccataaaatacataactcctccgcgttgcttttaattattgatcccccaattagaatttatcccacaaaaaaaaacaggtccggagcattagctgccgaacctgtttttttaatttttttaccatacagagcgttaggttacttttttaatccctaaaaagtccgtactggcgtaattaattgaataaagttttcttgatcttccgttgggaccaacgtaaatggacgcaacggtgaagtgaattccattttaattgccgtatgcccgaatgagcgtagtgcatcttttaagtaatcaggattaaatgaaatttccaaatcctcaccttggatatccttagtaactactacttcttcaacatttccgacttcgggagaatcccccgtaataatcgctttctttgcggccgcattgatggttaatttaaccacgttattgcgtccagcatgagaaagcaacgaagcccgttcgattgaagctaaaagttcgggcgcttcaaattccatcgccgtcgtactttcttttggaattaaccgggaagtatctgggtataatccctctagtaaacgcgtgtagaacaaggtttcatcaaatgtaaacaaggcttggttttccgaaatttgcaacgtaatcgtgtcaatttcttcatccaacatccgcgaaagttctaacaaactctttccggggatgataatgtcttccggcatttttacggcttcgggtaagttgatgatccgctggctaaggcggtgactatccgtagcgaccgcggttaacttattgttttcaatcgtgaaatgaattccggtcaaaattggccgactttcttggttggaaaccgcaataaccgtttcattgatcatttcgctaaatacatcggcctgcaatgtaatcgtggtttgactgtccacttctggtaaatgtgggaagttgttggcatctaaaccgttaattttaaattcggatgctcccgaagtaatcgtggtttggaacccgtccgaaacctcaactaacattttgttgtccggtaatttttttacgatgtcactgaagaaccgggcagttaacacaatgtcacccgtttgttcgatgtctaattccgcatccggatcgttaacggaaatggttgtttcaatcgaaatatccgtattgctacccgttaacactagttggtctgcttcggctttaattttcaaaccggtcaaaattggaatcgtggtttttgaagaaattgcgcgttgaactgcgtttaattttttaatgaacgtatttcgtgcgatggtaaatttcatgttttaaaactcctttttacacgtggcatgtatatattaattaatactaaaaaaatagtaatagtaataagggctgttagcactgtggataactcaaaacgaagcgggagaaacccaaatcttactgtggagtacttgtggaaaactttttgagttatccacacttatccacaatttacggttttaactcgctctttaaatcgtcaatttgacgagctaaatcactgttagtttccaaggccgctttaattttgtcgcaagaatggatgacggtggtgtggtccttgccaccaaattcagttccaatcttaggcaacgagttatcggtcagctctcgcgaaaggtacatcgcgatttgccggggaataacgattgatttcaaacgcttcttcccttttaaatcagcaaccgagacgtggaagtacttagccaccttatcctgaatgatggggatggtgacgtgactaaggttgctgccaaagttcaagctccgcagcgcgtcagctgccaaatcggtagtaatcgcggcattttgcaattgagcgtaggcctgaatgcgcgccatcgccccttccaattcccgaatattggaatcaatccggttagcgatgaaatccagagtctcatctggaatttccacattgtcagcctgcgccttttcccgcaaaatagcgatccgggtttcgagatccggaggcgtaatgtcaacggacaacccccatttaaaccgggaaaccaaccgctcttgcaacttaggaatttcattaggcaaccggtcggacgttagcacaatttgtttttgcgcgttgtacaacgcttcaaaagtatggaagaactcttcttgagtagcttccttatccgcgaaaaactgtacgtcgtccactaacaaaaggtccacgttgcgatacttttcgtggaattcttccgtggtgtttttctgaatggaattaatgaagtcgttcgtgaaggcttcactagtaacgtacttgacccgcgtctgggggtcgttttctaaaagctgatggccaatcgcgtgcattaaatgggtctttccaagccccacgcccccgtagaagaagagcgggttgtaaagaacgccgggttcgtcggaaaccgccattgcagcagcgtgcgccatctggttaccacttccgataacaaaggtatcgaaagtgtaacgactattaagctgggtgtcttcggtggagaaggacgaagatttgtcagtgctctggggcttttgcgcctgttgagctttaaactcgtcttccgtcacgaattcgggcgtaatgtcctgatccgtgaactggtaggcgtattcgacaaatttttccattaaatgtttcgtccagtagtcacggtgcaaattagatagaaccttaattttcattacgtggttatccaatgaaattggttcggccgtgtccacccaagcaccaaaactagctttcgacattgagtcgtcattttcgaaactatttttgatatggttccaaaggtcaatatagttaggcactttttattcctccaaaatttttagctcattcagtttatcataaaaaaaatcggttttccacaagggtgtggaaaactaaatggtgtaaaataacaggctgtgagttgggttttccacaggctggggaaatgacgcatccttaaaaccaaaagtagagttgtgaacaccaacctgtggataaaagatgttgtaataacggtgttaattggacatatccacagatttccacaaggctgtggataactctataaacaggctgtgatttgtgaaaatcgctgcgaaaaagcctgtgcaaaatcgaaaataactaaaatggttatccacaatttaatcgacaaactaacgctctgtttgtggataatttttttccgttaggttttatttggtggtttgctttctatggcaaatgtgctattatgttaaggtaattgttttaaaggacataaactgatttatcgagaatcaacttaagatataaaaattcagtatgtgtattttcgttcaggaggtggaccataatgaaacgaacatatcaaccaaagaaacgtcatcgtcaacgcgttcacggcttccgcaaacgcatgagcacgagcaacggccgtaaagttttagcacgtcggcgtcaaaaaggtagaaaagtattatctgcataataaggccactgatcccagtggtcttttatttttattttctagagacaagctaacggtttttacatataatatgtgatagtgaatgagattgtggtgaggaattatgcgaaagtcatatcgaataaagaaagaaaaagagtttcaagaagtttttgaaacccgaaattcatttgcaaataagaagttcgttgtttacgtaatggacaaacctgggcaaccacattttcgggtggggatttccgtaggtaaaaaaatcggtaatgcggtaatgcgtaattatatgaagcgccgaattcggcaaagtatcttggaattcaagccccttttgcgttcggacgttgattttttagtaattgctcgcccacaagcttcaggtttaccaatgaaagaagttaaacgccagttggaacacgtttttaaattagctggactgtttgcttcgaaacaaagtgaggaagaatagtgaaacatttaaaacgaaatttggctttgctgagtgtggtagcgctctctttcatattaacggcatgtagcaccgcaccaattaccagtcacagtaccggtttttgggacggcgtaattgtttacaatttttcgaaatttatcatttatctttcgaaaatttgcggaaataactatggttggggaatcatcgtgttcaccgtcttaatccggatcatcattttaccgctgatgatttaccaaacgaagacttcaatgaagacggctgaacttcaacccaagttaaaagagcttcaacagaagtactcttcacgcgatgttgaaacccaacagaagcttcgtgaagaacaacaaaaactctatgctgaagcaggcgttaacccaatggcggggtgtttaccattaatcattcagttgcccgtaatgtacgctttgtacgcggcggtaagccgaacacaggtattaaaagaaggaaccttcctatggttgcaacttaacgataaggatccttactatatcttgccaattttggcggcaatctttaccttcttaagtacctggctttcaatgaaggctcaaccagcgggcgcacaaaatggaatgacttcggcaatgacctttgggatgccattgattattttgattacggcactaaacttcccggcagcgattactttgtactgggtagttacgaacctcttccaagtggggcaaacgttggtaattcaaaatccatttaagattcaaaaagaacggcaagctaagttacaagccgaaaaagcaaaacgaaaagcaattgaaaaggctaaacgtaaggcaatgaagagtaaacggaaatagttcgtgaacttcaattgtagttacaaaagcttagttgaacgtcaatttaccggtgtcggtgagttggcgttttttattagcaagcgcaaaataaagtaattgacaaacaaaaacgaaacttttatgatatatgcgtatgaattgaatatgatgaagtagtgaaagtgctttgtccatctgacgtcgtctgatgacgattatttatttaggtggaattgcgctttttttattggaaatagaaaggacgatattagcgatgccaagtgtttcaacggaatttgatacaattgcggcaatttcgacgcctcctggggaaggcgggatttcgatcattcggattagcggagttaatgcgttaaaagtggctagtcaaatttaccggggcaaggacctcgccaaagtagctagtcatacgattaactacgggcacgttgtggatcccgctactgacgaagaaattgacgaagttatggtttcggtaatgcgtgctccacacacctataccaaagaggacgtagtcgaaattaattgtcacggaggaattgtggcaacgaaccgtattttacaattaattctcgggttagatgcccgattggctaagccaggtgaatttaccgaacgggcctttttaaacgggcgaatcgatttgtcccaagcagaagcggttatggatttaattcgcgctaaaaccgaccagtcgatgaaggtggctttagaccaacttgacggaaatctttcccacttaattaaaaatttgcgacaagatattttagatgttttagctcaagttgaagttaatattgattatcctgaatacgacgatgttgaaacgatgaccacgcgattgttaaaagaaaaggcgattgaagttaaagccaaggtcaaccagcttttagcaacggctaagcaaggtaaggtattgcgtgatggtttagcaacggcaatcattggccatcctaacgtgggtaaatcaagtatattaaaccacctcttgcatgaagataaggcgatcgttaccgacgtggccggaactacccgggacgtaattgaagaatacgtgaatgttcaaggggttccccttaagttagttgatacagctggaattcatgaaactgaagacaaggtcgaaaaaatcggggtcgatcgtagccggaaagccttacaacaggcagacctagtaattttggtgttagatagtagcgtgccgctgcgcgatgaagatcggcagttacttgatcaaactgcaaacatgcagcggattgtagttttaaataagactgatttaccaactaaaattaacttaaatgaacttcagaaatatgctagtgaagcagaaatcattaagtcttcggcggtagcgcctttaggaaccaaggatttggaagaccgaattgcgaagttattctttgcgggcagtatcgaaaatagttcaaataacgtaatggttactaacgcccggcacattgggttgttacaacaaaccgtgactgctttagattccgtactagaagggattgaagcaggcatgcccgttgatttagttcaaattgatatgacccgggcttgggacctactcggcgaaattaccggcgatagttatcaagatgagttgctagaccaattatttagtcaattttgtttaggaaaataaatttggagttgaagaatgttggaagtaaaacaatatgacggccgcgattacgacgtgatcgtggtaggggccggccatgcggggtccgaagcggctttagcagcggcccggatgggcaacaagacccttttaatgacgattaaccttgatatggtggcctttatgccatgtaacccgtcgattgggggacccgcaaaggggattgtcgtgcgggaaattgacgctttaggcggtgaaatgggtcgcaatatcgataaaacttacgttcaaatgcggatgttaaataccgggaaaggcccagcagtgcgggcattgcgtgcccaagctgataagcatgcctaccatgccgaaatgaaaaagacgattgaagcggaacctaacttaacgttacgtcaaggcattgtagacgatttaattgtcgaagacggggtctgcaagggagtaattaccaataccggggcgcgctaccacgcaaaaagcgttgtgttaacccttggaaccgccgcacgcggtaaaattatcattggggaattacaatactcttcgggaccaaacaactcccaagcagctttagagttgacgaagaatttaactgaaaagtatcattttgaattagaacggtttaagacggggaccccaccccgggttgatggcggaacgatccattatgacgaaaccgaagaacaacctggtgatgaggaacccaaccattttagtttccaaactccggatagtaagtatttggaattaaagaatcaattgtcgtgttggttaacctacaccaacgagaagacgcacgaaattatccgggaaaacctcagtcgagcacccatgttttccggagtaattgaaggcgtgggaccacgttattgtccttcaattgaagataaaatcgtgcgcttcgcggacaaggaccgccaccaactcttccttgaacctgaaggccggaagaccgacgaatggtacgttcaaggactttcgacgtcgatgccagaagaagtgcagcaacaaattttgcactccatcaaggggttagaggacgcagaaatgatgcgccctggttacgctattgaatatgacgttgtggctccttatcaattaaagaacactttggaaacgaagttaattaagaacctttacaccgcgggtcaaactaacggaacttccggttatgaagaagcagccggacaaggtttaattgcgggaattaacgcaggccgtcgagcactcggacaggaaccctttacgctaaaacgcagcgatgcctacatcggagtaatgattgacgatttggttactaagggaactaaggaaccgtaccgcttgttaactagtcgggcagaataccggttaattttgcggcatgataacgccgatttacggttaactgaaatgggtcacgaccttggtttggttagtgaagaagaatatgcggcattcttacaaaagaaggcggatattcaagatgaacttcaccgtttggaacagattcgcattaagcctggtcaagtaaaggaatttttggagtctaaaggttcccatggcttaaaggatggtgttttggcagccgaattcttgcggcgtccggaagttacctacgcagatttgctgaagttcattccagcttcagataagcaactcgatcgccgggtagttgaacaggtggaaattgaaattaagtacgctggctacatcaagaaagcccaagaacgagttgaccggttgaagaagatggaagctaaggtaattcctgatcgaatcgactataacgcgattagcgggttagcaactgaaggacggcaaaagttagaaaaaattcggccaaccacgattgcgcaagcttctcggattagcggagtaactcctgcggatatcgcaatcttgagcgtttatattcagcaaggaaaaattgcgaagatttaattaaataataggctgagaaaaactaaaaaacatttgggcactttgactttaatagggttaaaatgtgcgtcaaaaatcagtttattccgcttaacctaaaattgaccaatatgccagactcaggcatattggtcaatttttagttagtgctcgcaagttacccgacctttggcacacgctctttttgttttacagttccacgtgaaacaaacgcgtcgaatttgttagaatgaactaaagagtggtgaataaatatcatgaaaataatcattgcgccagctaagcaaatgcaggtggatacggattcctttgccgtccttaaccaaccgcattttctaagtcaggcccaacaaattgttaatcgattgaaaaaaatgaacttaaatgaacttcagcagctttggaaatgcagtgatcggctagccgtaatcaactatgaaaatacgcgccgacttgatttgttacgcaaccaaacgcctgccgtgcttgcgtatactggtatccaatatcaaagtttgggtgccgacttaatgactagtccgcagcttaactatttacaagatcatttgcggattctctcaggactctatggaattttgcgtccgtttgacggaattgtgccctaccggttagaaatgcaggcccacttacaaattgcaggtcaacaaaatttatacgatttttggggcgcccaaatctatcaccaattatttaaagagaccgaagtggtgatcaacttagcgtctaaagaatatgctcgggtaatagagccctatttacaagcagaccaacagatgataacctgcgtttttggcgaactagtggacggtaaagtaaagcaaaaagctaccaaagccaaaattgcacgcggtgaaatggtgcgatttatggcagaaaatgaagttcaaaaggttgcgcaactaaagcagtttgcgcagcgaggctaccaattctgcgaagaattatctagtggtcggcaactggtatttttaagttcaaattaagttcaacggcttcttaaccaatgaagaaatttaatggttaagtaagccgtttttttgtgtggagaatgaaaaataatacaggaaataaatataccaattttcagaaagcgcttgcaaatatggtaaacacaatgtagtatataccgtaaatcaaaacggatgatttgcgatgaggagcaaaagaatgccaaaaacaaagtttgaaaaagtggcgcaaagccttgtggaacggattcagcagggaatttattctaatatgcagcggttaccttcagaatatcaacttgctgacgaatacggggtgagccggctgacggtgcggaaggcaattgaacggctggtgaccgccaaaattttggtgaaggatccgggaaagggaacttacattatgtcgacgaattcgtccaataaggttgaaagcggccggatgggtctacaaagttttacggaagctgccgaaacttatggcaaacaaagtcgaacgcaggtccttgattaccaaccgttgattcaaccagaccagcgggtggaagaaaaattaaacttgcgtaataatccgcaacctgaagttgatgaactagtgcgccgacgtttttgggacgatgatccgatgactatcgaagacatcgtaattttacataagtacgtagccaatcatcaaaaaaacgattttaagcattcattgtttcaaatcttggcagaaacggttgaaattgcctattccaaccaagaaatcgaggccattaaggtcgacgaaaagctagcgaagttactgcatgttcaggagggagatcccattctttgcgtccattcgcttacctacacggcagatgggcaaccaattttctacgacacgtcttattaccgggccgataagtacacctttaaaacgaccctgacccgtttggaacaaggaggaaaataatggtggttaaccaagagtttaaagcactgattgaagcacattacgatgaatttttacgtgatttagcaaaggtgattgaagttcaaagtgtccgtgggccagctgatcttcacgcaccctttgggaaaggtcctcgccaagtattaagggtggccgtgaagttagccgaccagtacgggtttaaaacaagcattgtcaatgatgccgttgcggtagcacagtggggtcccgacacaagcgactacataggaatcgttggccacctggatgtggtcgcagctggtgaaggttggcaaagcgatccctttaagttaaatgttcgagaggacaccttgtatggccggggtgtcttagataataaggggcccatcatggcggtgctgtttgggatgcatttacttaaagaacgcggattttatccccggaaaactttgcgaatcatttttggtagcgatgaggaaagtgggagtgcggacatccccctttatctaaaggaacaaccagcacccgaatttggatttactcctgattgtaaatttccagcagtctatggcgagcgtggaattgttaattatgaaatcgataccccaattaagttgacagcattacagcaaatttcgaccatcacgggtgaccaagctaaagatcacgtccccgaccaactcgcaattgaagttcaaaatcaattggttgaagttcaggggaaacgcagcccttctaacgctccagagctgggggtgaacgccatcatgctcctagccaaggcgatcaagaagcgggctgaactagcccccgaattgattacgtactttgattggctcctcgatagttttgaccaacgttactttggcgaggggctagggatagattttcaagacgaagatagtggcaaattgatggtcacgccctacctcctccaaaaagttgaaggtggcttgaagttaaggattgcgatccgttatccggtgaccgttaccgaagaacaggttactgcgggacttaaaaaagcagttcttccgggaagtgagcttcgggtggttcggcggatacccggaactatgcatgataaaaatgacccgcggataaaacaactatcggcagtttacgcaatggttaccgggcaagatggaactcccgtaaccacgacgggagcgacctacgcccgggcggtacctaacattattgcttttgggccatcgttccccgggcaaaaagggattgcacataaacaagacgagtggatgaccaatcatgatttgaagttaaacatggagatttacatgaatgccatggtaggtttagcaaaaatggaggaaaagaaatgacaaattgggcaacgattgccacctggcgaatggcacacgacggagttttgaaagccagtgaaatgctgaaagaaaatgcaagtgcgggagatgccgttgaaagtttaatcaacgtggtcgaagaatatccctactataaatcggtgggctacggcgggttgccaaacgaagaaggagtggtcgaaatggacgccgcctttatggatggtgacaccctagcccagggcgcggtaggaggcattcaccacgtcctccacgcggtttcggtggctcggcaactaagtcatgaacacttcaatagctttcgggtcggtgagggcgccacaaagtatgcattggtgaacgggtttgaaatgcgtaacatgctaaccgaccgggcgaagcttcgttggcaaaaacgtttaaaggaaattcaagaggcccaaattagcccatacgacgggcacgatacgattggcgccctcacgcttgcgcaaagtggttccatggcagcagccacttccacatccgggttatttatgaaaaaagcgggacgggttggcgattcaccgctttcggggtccggtttttacgttgacagtgaaatcggtggtgctgcagcaactggattgggtgaagacatcatgaagggatgcatttcctatgaaatcgttcgacgaatggcagaaggcgaaacgccacaggacgcctgtgatcacgcggtgtacccgttcgttgaaaaactaaagcgccgttatggcaaggcgggtgaattctcattagtagcgttgaataagaacggcgagtggggagtagctaccaacgtcgaatttaccttcagtgtagctacggcaactagtgcaccccagattctaattgcccatcccgccgaaaaccaaacgacccggattgaacccattacgcaggaatggttggacgcttatgaaaaacgaattaaggcacccattaaataaatcaaaggaggggattttttgaaagtcatcattattttagaccaaattcaagcgggactaggtggtaaggaacgcgctgacaccccattaggcggcaaaaaagttgcgttgggaagcgcagaaaccaccgcgaaagctttggcaaaggtagacggagaagtcatcggtactttctattgtggaacggattattaccgggaacatccggaactagttcaggaaaagttcaccaaaatggccgctaagatggccgccgatgtggttataattggaccgacttacgattactcagaattttcgcaaatggcttgcgaattgaccacggcgtttcaaaaggataccaagattcccgcactacaagcgacggcattggaaaagaacgcggccattattgagcagtataaggatcagttgctaatcgtgaaaatgcctaaaaagggtggtacgggattgtcggcggcaattgatcaccttgtagaagggtgcgtactggcggctaatcgcgaagatttaaccgcctttaagaaccagtactgttactaaatttaaaagcaaagggggcttggaagatatgcagaagaaatttgaacaagtattaatgccgttagcatctaagttgggaaacaacgtggttttaaagtctttgcgggatggattcttaatcatcacgccattaatcatcgttacctccattttcctgctaatcggcaactttcccattccaggctgggaaagtttttggacaaggattttaggcgaacactggacagaatggtttagcgcggtttccaattcggtatttagcttcaccggaattttatcctgtatgggcattggttacgcttatggaaagaaccgggggctcgaggccatccattccgcggtagttgccttggtttcattcctcattttgaccccgacttcgtttacggttggtaaaacggcggtaagcgcggtacaaaccatgtacgtaggacctaacggaattttcctagggattttcatttcgattgtcagtgtggaagtttaccggtttgccgtgaagcaccactggacaattaaaatgcctgagggagttccgccagcagtaagtcaatcgtttgatgcgttaattccgagtgcgttagtaattttgctatttttcttaattcggatcggttttagtatttctagtttcgataccgcatataattttatttataccttgttacaagcaccgcttaagcacgtaggaaactcgttgccatcagtattgctatacaacttcttagcgagtttgctttgggtatttgggattaacggaccaaccattactaattcggtttggtcaccgattttctttgtccttacccaggacaatttgaaggctttccaaaaccaccttccgctcccacacatttatacgcaaccctttattgatatttttacgacctacggaggcggcggaagcaccttgtcgcttttgatcgttatgtttgcggtttgccgttccaaacggattcgggagttaggcaaattggcgattctaccaggagtgtttggaattaacgaaccgattatttttggtctgccagtagttttaaacccgattatcgcaattccatttatcatcgtgccggtattgaacaccttcatctcgggagtggtattcaccctcggatgggtgccacggactaacggggttttactaccatggacgacaccgccaattatttcgggctggctcgctaccggaagctggaccgggtccctattgcaactagtggagattattttagggattattatctattacccattcgtgaaaatgctggatcaccagtacctaaaagaagaggatgtcgcgttagggcaggacttagacattgactttgacgaagtgtgattgaagttcagatttaattgcttaagcaaattttgaacttaaatttaagttaaaaatacccgaatataacagttatatttcaaaaagatatagaaatatcaaaatttggtttcaaaactaaaaatcttaagacaaccaggatactttgggctacaattaaaattattaagtcgtatgagatagtctggaggagagttaatgaggtttttaagggattgggttttaccgatcgtagttggtttattaattgcttttcttgttaaaacttacttgttccaaatcgtaaaggttgacggttcgtcaatgcaacctaacttacaggatagcgaacgggtgctagtttggaaacaagccaaaatcaaacgcatgagcgtaattgtgtttgacgcccacggagaggatccggcggctactcaaccagttgattacgtaaagcgggtgattggggttccaggcgacacgatcagttataaagacggtaagctttacgtaaataataaagaagttccgcaaaagtttattgacgaggaacaacgcacaaccggaacgggaaattggacgctcagctcaattgctaataaatatggttgggcaaagaatccggtaaaggttccaaaggattcctactttgttttaggtgaccaccgtagcgtttctaacgacagccgttattggggatttgtaaagaagtcgaaggtgatgggcgtcgtgaaggtgccgttctggagtcatgatgaaaaagcgaaaaagaatatcaacgatttagctgttgaataacttaaagcaggttgaaagtccccttttaacctgctttttgtgtacaatgggactgaatggagggaccgcatatgaaaaccgacccaaactgtgtattttgccaaaaaacggaggcagattacattgtggaaaataaactggctgcttcctttctggatttttacccagtaagtaagggccacacgttgatcattccaaaacggcacgtccgtcaaatttgggatgtcactaccgaagagcggaaggccatctgggatttaattgaacaaaacaaagcgattttagacgagaaataccatccggacggctacaacgtgactattaattccggagcggccgcgggacaaagtgtttttcattgtcatattcatttaatcccccggtattggagcgaagatccgcagcgtaagccggtaccagcgcagtatttaattcctaataaacgcccccaatttaaaggtatggattaactgccaaaagattaatcagtataaataaaaacaggcagaccagttgctagagaattaagcaaaattggcctgcctgtttttaaacacaaaaaaagcgtctcactaaggagacgcatacaggtaataagtaactggtcttgagacccttcattcaccttatggggggagtaaatgaaaaagttatctatgcttagtactatagaagtaaaatgtgaagaaattgtgaatttttgattgctacgagattacattttgtcggatatttgattacatatgaaataatcaatggggtaatataaaaaatcacttttattttccaaaggagatagtatgataaggcataggattaatatggggggatggcattgcagattttaaaatggattgttgatgggattttaatactaaacgtggcgggagctttatatacggtttttagacaacgtcgggatattgccgcaacttgggcctggctattggtactatgttttttgccattatttggatttgttatatacgcctttgtcggtcgcaagctgccggaaaataaattatttccgttaaaaagcaaaacccgcttggaattagaccaaattatggaacatcaacgtaaggagttaaaggaaacgactttaaccgctgctgatcaagtggttaaagattcagcaggaatggtacagttcttttcgcggacggattacgcgtttttgactcgccgtaataacgtcaaaatcatcactgacggacacgcattgtttgaggacatgtttgcggaaattaaaaaagcccaaaaacatattcacgttgagttttatacaatttatgacgaccaaatcggaaatgatttgcgaaagttgttagaacaaaaggctaaagaaggcgtggaagtaaaggtgctttgggactcgtggggttcgatgggtaccaagcggagtttctttaagaagttaaacgagcttggcggacaggcctttccctttttggggacgcgttcagcgttaaccgactttcgattgaacttcagagatcaccgaaaaatcgtggtgattgacggcaaaatcggctatgtcggtggctttaacgttggcgaccagtatttaggacgtaaagaaaaatttggttattggcgggatacccatttgaaaattgtcggttcgggagtttatagtctacaatcgcgctttattttagactggaatgctaccgaccgcgcgcatccgataagtgaagaatttaaaccaggatcggtttacttcccggttgcggaggttaaggggcataccagtttacaaattgtgtctagcgggccggattcagacattgaaaagattaagatgggttacttgaagatgattaacgcggcgaagaagtcgatttggattcaatcgccatacttaatcccggatgatagcgtattggatgccttgcgattggcggcaaattcaggaattgacgtgcgcattatggtgccgtgcaaacctgaccacgtctttgtgtaccgcgcgacccagtactacgcttggcaatgcgcaaagtgggggatcaaggtttattactacaataacggttttctacacgcgaaaacgatggtggttgacggaaaggtatcgtcagtgggctccgcaaatttagattttcgaagttttaaacttaattttgaagttaacgccttcatgtacgacgaaaatattgctcaccaattagaagaaatattcttaaaggacattgaaaattctagtttgcaaacggtgggtatctttaaccgccaatcacgctggctgaagttcaaacaaactttttcacggctcctgtctccgattttataaaggttgggatttgacgtttgaaaatggacatgataggctagctacaataaattaaagcgcaataactttcacattaagtagcggataatctgggtgtcaggaagtcggtggttgctgcgaaccgatcaggattattgcggcgaaataccgtggaatagttttgttaagaacggctaataactagaaccgttatcatctagtgagtgagactgtcccctagggagggtctaatttgggtggtaccacggttaattcgtcccggttgtattttaaatacaaccgggattttttattagctaaattaaggaggaagaggatgcaaaaggtaaagacacgggaagcaagtttagttttgattgtcatgttggcaattttaggaaccggcgtgattaagtgggggttgtcaccccaaacaccggtactcttagtattaggattattaacgatttgggctaaaatacgggggtttagctggcaagcgattaacgatggaattaaatcggggatcgaaaccgggattatcccgattttcatctttatccttgtaggagcgttaatcagcgtttggattgcggccggcatcatcccaacgttgatgctcgtaggttttaaaatgatcagtgtaaactggttcatcccttccgtcttcgtagtctgcgcattggtggggactgccgtcggatcggcgtttacggtgatgtcgaccgtggggatcgcgttttttggaatggggatgacgatgggcattaacccagcgttagttgctggagcaatcatttccggagcggtttttggcgacaaatgctcgccgctttctgaatcaactaacctctccgcggcggtggtcgatgccgatttatttgatcatattcgcaacttgatgtggtcaacgttgccagcctttgtgggagcgttaatcttgtttgctatttttggtgcaggggacgcccaaaatgctgacattagcaaaattcagcatactgaatcagttttacaggcccattttgcaaccggctggtgggttttaattccaattattttaatgtttgtttgcgcttggcgccgagttccggcagttcccaccctgttcatcaacattggggtgtcggtaggtttaatttggctcgaacatccggctacttccgtgcagcacctagctaaaattattgaaactggctacgttgctcacactggtaacctagaggtggatcaattactaagtcggggcgggattgccagcatgatgaccaccgtctccttgattgtggtgaccttgtcactaggcggcgtgctcgttcatttaggattgatcaaccaggtcatggaaccaattgcgcgagtactaaatagtgacggcaaattgattttagcagtggttcttagtgcgatgggagccaacctcttgattggagagcagtttttatcggtaattctgccaggaaaagccttcaaagcgacctttaaaaaagccggcttagcaaacgtagcgctaagccgggctttggaagacgggggaaccgtcattaactacctcgtaccttggggcgtggcggcgacgtttgcggcaaatacgttccacgtagccacgttagactacttgccatttgccttttttagccttttgtcgcccgttttctcaatcttgagtggtttcaccgggattgggttaaaacgaagtaaggcaagctctgattaaacccagccgtgaatctgtagccagtccaacagttggcgactgagaacttgcgatccggccacgtcgggatgaacttcatccgtagtggaatatttccaagtggcggttggaattacggtgaaattaaacgtttgtgcgatggctttgatcgttttagcatggctctggtttaacggaatcatcacgaaaatttgagcttcattgaacttaaattgaacttccttcataaaggcggtgaagtacatttcaaatactggagtatcgaattgccagtcgttggtgcctaagttaacaaaaacaaatttaggttggaaatcaggtgccggagtttcgtaatctacgtagttaataaaacggggcgcggcaggaaccccgcccgtgccgtaacgaataattccggctgcactgtaagcaacccgatagtcttcccaatttaatttacgggaaactagcgctgcgtagttgaggtcggcgccatatccgcgagaaggaactttttcacgtacccaacatcccgccgtgatggaatcgccaatccaagcaaccaagggcccggcaggtttaactgcgtgcatttgaccacctacagaaggatggacatcggcgagcgctaaacctgctgaagaagtccaaacctcgtcttggtcggtattaccagtgaaataaaggtgcacgacgtgtcgggattttgaacttaattgaatttcaaagcggggctcgttaagttcaatcaatcgaggctgatcgtcaacaaaaattgtgacggtttgcgggatggcgaggtctggaagtatccactccaagctcacgctcgcagcattttgaacttcaaaagtaacttgagcacctaagttggtggtgtacatcaccgaccgatttgccaactttttaggaacccaccggccaataaaataaagattgggaatggtgccgtttgcggacgtgggaattagtctttccattagcagagccctccttagccggggttatacatgcattcaatttcatgatcgttgattaagccgattgcttgcatgaatgagtaaatgattaccggccccacaaatttaaacccgcgctgttttaaatctgcagaaatttttactgaaagcggggtttgcgcgtggatttcttccggaatgcggatgtggtcgttgatttgctggccattaacaaattgccaaatatatttatcaaagctgccaaactccgtctggacctgcataaaggcctgggcgttcgtaatggtggcttttaatttaccgcgatgccgtaaaatagctggattttgcataagcttttccacgtcagcatccgtcatttgggcaaccttagcgacctcaaagttagcgaaggattctttgaaggcagcccgtttgttaaggattgtattccagctgagcccagcttgatagccttctagtgagagcatttcaaacatgtaacggttgtcgtgagaaactcggccccattcgttagcgtggtaagcttgcatcagtggggaagcgtcccgagcccatgtacaaataaaattattttccatcataaatctccatcctaaaagaaaaatgccaagaacgaagcgacatcgcaaaagcgaaggtcgatgcgccattaaagtaggcgggtcggtcgtttcattcactgacattaacttcatttaacttaattttagcacagttactgatggaacaattaacgagaagaatcgtagccgttgaataataggttaaggaccacggcggtgatgctagccaccacgatgccgttagttaagagcatctggcaggcttgggggagggctcggtagatttgcggatctacggttgaccccaaccccattccaatggataatgcactgattaagatatctttagtttgattgaagttcaccttttggagaattcggacgccttggatgccgacaatgccgaacattactagcatagcgcctcccaggacactagaaggaataatggtggccatggcgccggcctttgggaggagtcctaagaggattagaaatccagcagcgtaataaagcggtttgcgacttttaacaccggaaagttgcaaaacccctacgttttcagaaaaggtggaatacgggaaggtattgaaaattccgcctaaaatggcagcaacgccttccgcacggtatccccgttttaaatcggtttgggtgatttctttaccaactaaatcaccgagggcgaagaataccccggtggattcaatcatcgtggtgagggtcaccataatcatcgttaaaatcgctgagaggttaaaagtcggcaccccaaagtaaaaggggcggggaaaatgaaaccagcttgcttgtaaaacgggggtaaatgataccattcctaacaaagcggcgatgccggttccaacgagaatcccaattaacacggcaatggaacgcatgaaaccgcgcgcccaaacgttgatgaggacgattactgcaacagtaaccaaaccgactaatagatttttggggtcgccgtatgattgcgcggcgggatttccacccccgatgtcttcaaatgccacgggaattaaggtaaacccaattacggtgatgatggaaccagttacgattggcggaaaaaggcccctaatcttggaaaagagcccggcaaccagaataacgaagagtcccgacgcgataattgccccatacattgccgtaatccctagtccaccgccaatccgctctagaggttggaccgattgaattgcgcaacctagcacgacaggtaggccaattccggtgagcggcgtggttctaatttgcaaaagggtggcaatgccacacatgaaaatgtcgatggacaccaaataggtcatttgggcggcggtaaaatgtaaaaagcccccgataaggagggggacgattacgtcaccagaatacatcgccaagaggtgctgaaaaccaagtaccgctgctttaccctcggttagttgcggggtgatttcggtaattggtgcgtcagcatacgaatcattagttttcataaagcacattcctcgttttcatatattttcaaaagttatgaaagcgagcctataaatagtctggaaggcgccaaactacaattaaaaaaagctgggacatgagggttagtagtttaccacgccgtcaccaagatttatcgttccccaccgtatcttagaagtggcccgattattggcacgacaaagcaaacggactagctcattctccagccattttgatgaatatgtaagttaaaaattcctatagtccaacatttacggcgttgggtagaaactgtcaaccagattaagacattatataggcttgggtccatttaatttgtctgaaattttaacacataaaaaatatttcaacaactcacgatcacgcggggagcgtacaaaagcttcaataatcgataaaattggagaaaggatgaatccgttctataatggtaaaaagacgttttaaaggagaatacaatgaagatattagcaatcgggatggatcgcccggtctctgatgtagtggcggcggagctaaatactttgccagaagtgaaggtgactattgctgaagttcaagaggcgatgggcaactacgacgtattgtacgtagacctgcttcatttggggatggacgaggagtttgaaacggtggtggaccggctagaagaacaacaattacaagttaataaaattgtttttttagcaaccgctggaatggataacgaaattgatcccacttggattgaagttcaggacgtaagggaactaatgctggaggtcaagtacgtggctaagctagttgatgaaacagagctgccgtacaccatcattcgaccagttgaagttaaatctgaagttcaaaatcaaggcgctgaaattactccggaaggacaaccgattaccactgccgtagttagtgagcgggcagttaccaagctcgttaagcaagcaattttaacagaagaataccaaaatcaatccgtagggatctcaaatcccaattaaggaggaactatgccacttaaatttatgtacgggccggccagtgtcgaccatttagatgcggttgctgaaacaataattgaacttcagcaacaacaaaagcaacgtaaaatttactatttggtacctaaccacattaagttccaatctgaaattcaattgttgcaaaaactacgcgaaaaaagcgattcagcgggcccggtttttgcgcaaaaggatattcaaattttatcgattagccgattagcgtggtttttcttacgtaatagtagcatttaccaatatccccgtttgactaattcaagtaccagtatgttactctaccgaattatcgtggagcatcaggatgaactattattattccataacattgacgcacaacttggtttaattcaagaaatcactagccaattggcagaatttaaacaaggaaacgtaagccctgaaaatttaagtcaaatcattgatcaactagccgaaaatgaagatccccagttagacttgatggctaagttgcatgatttaaacatcatctatacggcttatgatgaagcaattcaacaaaagtttgtcgatagcagtgatatcttgcgtgcattaaccgaccagttagccaaaatggatttacatgcacaaagctttgtgattagcggtttttctaattttactgcggaagagcttaatttaattcagacgttgattaaggctaacgcgaccgtcgtaattgacttagtaatggagcgtaatccactaaatgaaaaactttcagaaaatagcttgttttttgaaaatgaaaaattatttttcaaaataaatgaatgggctcgtgaaaacagaattcaagtggcttctccacgagtggtgactaaaaaacgggtaaatgacgacctaagaaagctagagcgctactgggttgcatctacgcagggacagcttggtcagaatggacatgagcaaaataacagtgtggaggtgctcgaatttaacagtcggtatgccgaagtagagcacgtagccacggcaattcgccaaatgatgacgaaggatgatcggctaaatttctccgatttttcagtgttaactcgtcatttgaacgactacgacacaattattaagccaattttcaatcagtttgatattccgattttttacgatatgcaagtggcgatgaaaaaccatcccctactagaactgattaacgcgttgttcgacgttcaaaagcggcattttcgttacgaagacgtaatgcgcttgctgaaaactggccttctccgtcctgaaaatgacgccgacccagacggaaaggatttcgtcaaaagcgtccaaattacggaaaactacgtgctgcgccaggggatttacggcagtaagtggctgcaaaaagctccgtggcaataccaacgtttcaatgacgttgatatggagcagcaaaccgacgaggaacgtgaaattaaccgacggattaacgagattaaggattacgtagttaaaacggtcaacccgtttttcaaccagttggcggtagctgaaaatggcgcggaggcggccaaggcactgtaccagtttttaattcgtagccacgtggaccagcggttgctggcctggcgcgaccaatggattgaagacggtaacttggccaaggctgctgaaccagagcagacttgggaaacgtttgtgacgatgctggatgaatttgtggacattttaggtgaccagccgtttgattccaataatttcattggtttattaaatgctggctttgaaaatgcgacctactctcaaatcccatccactttggatcaggtgcttatttcagaaagcggcatggtgcaaatgatggatcggaaggtggtcttcatcattggcgcaaccgaccgggccatgccggaacaaattcaggataatgattttttgagtcaggaaggtaaggcgcaagttagtgaccagcttgcagatgaccaattccttaagatgagtaatgagcgacaaatgcgtcaggaaccttatttaaactacctaacctttatgattggttctcaaaggttaatctttacctatccaaaacggggtaatgacggaactgactttaaattgtcgccttacgtggaacgaattaaggcttactttgaaattgaagttcaatgtttgcctagtcgtccggccgtggaccaaccgcttattcaaccgtttatcggttcaaaacggagtacgctgagccatttagttcagtacgctcgttccatgaaggaaagtaagcaaccggctgacgtacggtggaatttaatttacagcatcttagaggctggccgctggcatgatttaaccgaacgactgatggggagtttaagttataagaacgtccctcgcaagttaaaaccggatatcgtcacgcagttatatggtgataaaatttacgcttcggtttcgaaactcgaagaatttttccgcaatgaatattcatacttcttgaagtacggtttgaaactgcaagaacgggaaacggcggatttaagcccggcggataccgggcagtacttccacgctgcaatggataacctagtaaaagtaattactcaagcggatctgaacttcaatgaagttaatcaaacacagataaaacaggttaccaaacgagttttagaaaacatgcgccaagattcgcagtttgatcaatttaatagcacctaccgaatgggttacttgagaaagcagttagatcgtacggtggaaacgatggttacggcgatttttaaacaattagctcagaccagaatgcggccaattgcttcagagcaaatgtttggccaaattggcttgaaggaaggcttacctgcgctgaacttcaaagttaatggaaaacaggaagttaacgtccgcggtaaaatcgaccgcatcgacaaaattaatattgaaggtcaaccatatttaggagtggtcgattacaagtcgagcacgcgtaagttcgactttgccgatgcttattacgggctggcaatgcagatgttgttatatttagacgttgtgcagcaaaatcgacaacggattgatcctcacgaacaagcacgactatcaagtgcgctatacatgattttccaagatccgttattaaaggctaccgatttgaaggtgcaagacgaagatcaattgcaacaggcgctcttcaaaaagttttctttaaacgggttcgtgttgaacaacgaagaactgttgaaagaaattgataaaacggtcgctgaaactggtaaatcggcagtgtacccgtttgatttcactaagagcggtagcctaaccaaggctagcttaaacaacgtcgtcagtgaaactgaacttcaggatttaattaaacatgccgaagaaaaggtcattgaagctggaaaacgaatctttagtggtgaagtcgatttgaacccggtacaatggccggaccggacgaccgcgctggaatattcaccatataaagaaattatgcaatttgacgcaatgctaccggaaaataattaccgggtcttagaaaaactcgataaagaaacggtcttaaggaagattgaggaggaacgcaagaagaatggcaactagaacttacacgcctagtcaacaacaagcaattgatagttcggggcataatattttagtttcggcctccgctggatcgggaaagacctcggttttagttgaacgggtaattcaagagattatcaacggagaagacgtggatcgtctcctggtcgtgaccttcactgaagcagctgctgctgaaatgaaggaacggatccgagcggcaattatgaaaaaaattagtgaggttaaggatgctgacttacaaaaccacctttcgttacagctcggcaagttaaataacgctaatattagtactttgcacgctttctgtatggcggtgatccgcaactactactacgtaatcgacttagatccagcctttcgcatcatggatcctacggaaagcgagttattgaaggaacaggtgtgggccgacttacgggaggaactgtacgaaagtgatgaggatggccaatttgcacgcttaacgcgcaatttttctaacgaccgttcggatgctggtctccaggagttaatgttggacttgttcgaatttgcgaacgccaacccggatcctgaagcgtggctaactaaaattaccaataattatgaagtacaaactgatcaggtaatggaaatggattttgtgaaacaaatcctcgcaaagataaaaacgcagctgattcaaatttatcaaacggaccttaaccttaccgaacgtgcaattaacggcggcgagcctttgcaaaaagcggccgctaatttccaagcggaagtagccggtttaaaaaccgtgattgatcaatttgatcagcctaactgggatgccttgcaacaggcaatggttaactttaagtttgctcagctaccgcgtgggaaaaagcctgaagttcaagagtttaatttagaagctaagccgttacgcaacgaatttaaagctgaatttaacggattagtagagcgttactttaaactaaaaaatgaccagttaatcgccatttttaaggacgcgcgggagttaatgctgaagttaattgaagttcagcagcaattttccgaccgctttttacaggaaaagctaacgcggcgttccctggattttagtgacctagagcactttgcgttacaaattttgcaaaaccagtccgaagagggtcaggcagttcggcgaaatttccaggagaaatttaacgaagtaattgtcgatgaataccaagatattaacccgcttcaggagaccattttgacggcggtggctcgtgaagatcctggaaacatgttcatggtgggggacgttaaacagtcaatttacgccttccgaatggcagaccccagcttattcattagtaaaagccggcgatttaaacaatctgggcaaccagacgaacggattattctggcagaaaatttccgttctatgcaaaatgttgatgattttaccaacttgatttttaaccaaatcatggaccaggcggtgggagaaattgcctacgacgcggatgcccagctgaagttcggcgcgaaatattaccccgctgaagttcagaatgacacggaagttctattatttgacgatcagcaaaacgaaaatacggctgaccaagaacctggggcgataatcaccgataaaaacgacggacagttgcaaatgattgcgcaacgaattaagcggctatttgcggatcaaaccgaagttttcgatcgagatacgcaggaaatgcggcctttgaaatatagtgatattgcattgctgcattcgacggggaataacaatcttaacatcgtggacaccttcaaaaagtacggtatcccaattgaagttagcaatgcccaagactatttccaaacgaccgaagtttcgatcatgatggccctcttgaagattattgataatccgtaccaggacatcccattagcggccgttttacgttcgccaattgttggccttgatgaaaacgagctggcctttttgcggatttctaagaagaacgggcattattttgagtcggtattgtatttccaaaatgagtttaaaattgattaccaaaatgaatttcaagccaacttaaaacgtaaaattgaccagttcttagcccaattacagcattttcggaagctttcccaacaatgtacgcttgtagatttgctttgggagatttaccaagagaccgggtacttggattacgttggcggaatgccggacgggccgcaacggcaaaataaccttcatgctttatatgaccgggcccagagctatgaagagtccagttttaaagggttatttcaattcgtgcgttttgtagagaaaatgcgcgaaaagaataaagatttggcagaaaatccggtagttaccgatacggaagctgtaaaattaatgaccatccatagtagtaagggattagagtttccaattgtgttcctgatcgatgcggatcacgggtttaataatagcgacactaagggccgctacgtgttggatcgtgatgcggggatgggaattaccgtgaaggactttgtgcaccgcttagaagtcgacacgatgcaaaaaaactggattattgacgtacggcaacgtaaaatgctcgccgaagagctccgggtgctctacgttgctctaacccgtgcacaacaaaagttaattgttaccggagcgctaaaggctgctaccccaacgctagaaaagtgggctcaggcagctgacacgggcgagctgctgttgccggaagctgagcggggaaaggcgaaaaactttcttgattggattggaatggcgattatgcgggtgccctccgttacggaagattatcccgatgttagttcacgaaaattggactctgccgcgggagttgaagttaaattgaaggtcgttaaccgcgctgatttactgactgggcagcgttctgacacgggaattgagcaaggaccgccaccaacgttagaaaaagtggacgtgaatagcgacattaacgatgcagaacaaattcgggcgattctgaacttcaaatatcacgatattgaagcaacccaaacgacggcctaccagtccgtatcggaaattaaacgggtttttgacgatccggacaaattagagatggactttagtgcggtcgaccgtgaccaaaaaattcgtccgcagaaacgatttgtcaccgatcaattgatggcgccccgctttatgagcgaagttagccaacctaaaccaactgagatcggaacggcgacccacttgattttgcagcagcttgatttgcgagaaccggttactgaggcagtaatcaaggataaaatccgtgagttagtgatgaatcaggtattagaagaagccgtagcgaagcgaattcgaatcaacagcatcttagacttcttcgaaagtgaactaggacaattaatgttggctcatcctgaacaagtgcaccgtgaagaggcgttctcattgctgttgccggcaaaagggctatttcctaatgtagttggcaatcaggacgttttaattcacggaattattgatgcgtacttcgaattagatggccgagtaattctgctggactacaaaactgactttgtacttccaggcagtccgcagcaagggattcaaaaagtgattgatcggtaccagggtcaggttaacctatatgcgcaagcattaagtaatattctgggtaaaccagttaacgaaaagtacctgtatttattgtcaattgggaagctagtagaaattcaataagtagttagcttgcaaactggattctgccaaaaatatttggtggcggaacccagttttctatacggcagtaaaaggtgggcaagaacgtaaattagttttggtgaattcaaagttagttcaaaaattaatgatagcgatttaggcggaaggacaattgaagtacagttgtagttccgtgtggaaaactgtggataactttgttcataactttggaagaggaaataaagttgtgcacaaaactgattaaaccgacctttggacttgtagaaaagttttccacaggttgcggtgaaaaatgtggataaaaaaattaaaaattgaattttaaggtaaaaaacgccgtcatgacaacgtttgtagcggtaacaaaattttaaaaatgaaggtggaaaactgtggataagtaaaaatgctgttgacaaatccaaagaaataaatgtggtggcgaacataaattcggcccaatatattgtgagtatttcaaaatgcctgtggaaaactttgtggataacttgaggataggatgtggataaacattgaatatcaaaattattggtgtgggaaagttaaaagagaaatatctgaaacaggggattgcagaatacgccaaacgactttctaaattctgcaaatttcaaattattgaagtcccggatgaaaaagcgcccgaaagtttaagtgacgcccagatggaaatggtcaaggaaaaggaaggcgaacgcattttagctaagattaaagatcgtgaatacgtctttaccctagagattaagggtaaggagcgttcttcagaagagctggctgaagagatcgcgaaattaaccacgtatggacattcagacatcaccttcgttattggcggttcgctaggtttaagcccagcagtaatgaaacgagctgacacggcaatttcatttggacgtttcaccctgccacaccagctgatgcggttggtgctaacggaacaaatttaccgggcttttatgattcaatcggggagcccgtaccataagtaaataataaactaagaggcagagaaaaaatcctgttctaaggatgaattctttttggaaaatctcttggtgcgttgtctttaagggaccaaaacgcgcgcccaaaaggcagtttattttacttaatcaaaaacgactattaagcctgaatttggcataatagtcgtttttttattggtgcccataaattatccggcttttgttatcagtgcttaatttacttattgcgggtcgtatttaaaccataaaaagtagtagattgcattcgccgttaaaaaaattacggcgagtcccgtaccaataaaggcgatggtggttttagcactgagagtgaaaagcggaatgaacagtaaggaaaggaataaaataaagcagctggcgatgaaccaggaagttaccgaacgtaagattgcataaacaattttttgttcacgttcgtcgtcgccagggtagaagaactgattatatttaacgcccatggattgatggtggtggcgttggatggctccaccaaccgtggtaattttgaaaaaaagaaccgctcctagtactgtttactgttcttagaagcggttctttttaagtcaaatcaatacttttaaacaaattctgaagttcaatttaagttcgttggagctgactaaatcagttatttagtgcaaccagtgctctaaaagcggaaacttagtttctaaccataccattagtttagtatgtacgattcgttgatgcagctcgggagaggctttttttaagcagaagaatgctaaaatgaaaaagggagtgccgggcatgattggcaacaccgcgccaatagcgcctaaaattacgttaaaaatggtggccgcgacccaaaaaaagcgcgaaattgcaaatgtcatctaaatcaactccttcgactctaaaaatagcaccttcagttaacaaatacgagcaaaaggctgaattatttagcattccttaattacttttaaattttctgaaagaaggtcgatctaaattaaaattcatcggttaaaaaacattactgaagttcaattggaccaaattatggcaatttggttggacggaaatttatctgcgcaccattttgtggatccccaatactggaagcaaaatcgaggggcagtgcaggcggcaatgcggcaggcaacgttttacattgctgaggacgagcgctgtattcgaggctttgcgggactacaagaaaactatctggcggggatttttgtgtctgctgatgtgcaaggacaaggaattggcggccggttagtgacgcagctccaacacgattactctgaacttagtttggcagtatatgagcaaaatccggcggcaattcgattctatttgagtcataattttcaaactattaagcggcaaattgatgaagcgacgcaacaaccggaattagtaatgcaatggcgtcaagaacgttagaaggtttcgtggtgttgaatttaagtaggttcaaaacgtgcgccaaaggtcaatttgtcccccttaaaacccaaatcgactattatgccaataattagcataatggtcgatttttagttaatgtttacaaatcgtccgaatttgtcccgtttcctttttattaagcgcgctaagtactaacttttagcacgtcttagcttaggatcaagcagcttttactcggatactaccaagtaagaagaccaggatgaaacatgccgtactagctaagattggccagtataaaacggaaatccagtcaagggaaaaataggcaacatcaaacacccggtttttcacaaaacggatggcggcaaagaatagtaagttaaaaattgccatcaaaaagccaaccgtcaagctatacagagctccttcctgaatttgttccaataaaatatcaccgggggaataacctaaaaccctcaattgcgtgaaatcttgttttgcaatgtttctttccataatggttaaggaaatcatattgccggcaacgataatcaaggtggggcccaaataaatcagtaacacgaggaacactccagtaaggctccggacgcgttgcatattaagcaattctagaactaaatgaagaatccctgaaagcagtagcagtgcgattaaaaaaggtttaattagggtagttaatcgtgaggaatggcggttaactcgataaaatgcggtatttagcgtccgcgtacctagtttacgcactccatagtaaatcaaacggagactgagcttgattaagtgattaccaaccagccaaactaaaacggcggtaaggaataatagtagctggaaagtatcggtaggtttaatatcgttggtagcaaagtagatttgatagtactcccaaaggatccctgagatggttagcataaccacgatgccgaaaaaaacggttttcataattttcaaaaagtggtgttgcttggtatttttcattttcactaaagtgtggtaactataaagaaaacttgaaacgtaggtaatgattaaggtaagtccccaaactgcgcagaacgaatttaactggtaattgattacaacggaaggaatgtaagcttttcccgcttcgttttgaatgaggtggtacatttcttgagctaagggaagggccacaaaatagcctatcaaagttcctaatgaactaactaaaaccatctgtaccgcggtaatttgagctaattgggcggggttagaccctagttgagccagttgggcgtgttctttagcgagcgcttttccaatggttccaatgacgccactgattaccacaaagagggttacgaggccaaaactcagtggagtaataaagagcgcattggtgacttcagaatggtgaacaacgggtgccaacggaaaataaataattaaacagctggaacttactaaactagccgcaataaatacagctaaagcgcctaaccaattgttaaattggtagcgaaattccttaatgccaattcgaatcatgatgaggttcccccctgaagataaattaaatctgtagccgtggggtttgaaatactatgcgtaaggcggccgtcgtttaaaatgattacccggtcactttgagcggctagctctaggttatgggtgaccattacgagggtggtgccatgctgaactaatttttgcaaaagccgcattacaattgctcctgatttggaatcaagtgcgccggtgggttcatcggcaaaaactacgctagctcctgcaagaatttcacgcgcaatggccaccttttgttgttcaccaccagataaatcggtaacgttgccgaataaattgccgttgaacttcatttttgataaaagagcggttacgcgagaacgttcaatgggcttacgagcaagccggagcggcaggacggcgttttcgtacggagaaaggtaaggaactaggttatactgttgaaaaatcatgcccaccgttgatcgccgaaattgggctagtttgcgcgggctaagttgaaaaggattggtgccgttaatcgcaacggttcctcctgagggtgatagtaaaccggcaatacacttaattagcgtagttttaccacttccagaagggcctacgatgcttaaaaactccccggacttgaccgacaaattcacgttgcttaaaacgggcttcaattgggaatgctgaccatagtaatagtttttgtttagatgttgtacttcaatgatcgattgcattatatttaccctccaatcggttaaaaagttattcaatatggatatcgccgtcgttagtgctaaatgaataattggttgctaaattaccatcggtaaagtggcgtcgggagtgaccgaagatcgtagtttttccgtcgttagctgtggcggagacggcaaggtttttagttgaatttaaaacggcatgaatgtcaccgtcgctcgtgcggacggtcaattcgtgcgtaatctgaagttcatttaagttaatatcaccatcggatgaagttaaattggcacgtttaagtttggtattggtgattgaaatatcgtcggcgttagcaattgaagcgggctgcttttgaaagtcggagttttgaatgtctacttcgccatcattgttaatattcaagttgtcagccgttacgttatttaaattcaggtcagcttcaccactaatgcttaagagcccgttgaccttcacgttgtttaaatgaacttcatcagttccccgtaatcgaagttgatcgacgtttaaagcggaaaaattaagttcgccggtggagctgccctttaccgaacgaagggtggtttgccgcggaattttaattaaaatggggtcagagtggtcataacggttgagaagtgaagttagtaaatggttcactcccgctgccccaatggttaaacgctgggagccagattggtaatggatttgatttagggaagtcggtgcggacacctttaccgacttgccatcataagcttcaaccttaatgtcatttggggttttaagttcaatggaacgaacctgacgataagatttagtggctgaatgcgggctaacaaaatgaatttgttcgtttatttgaggaacatcataaaaagcgttgttaagcgaagcaatggtgataaagatgattccaagaatggttagtgcaaatccaacgataaaagtttttttcatgggtttataccctctttccgaaatgatttttttcgttgaggaagttgtataatttctggaataattgggaaacgaggtggataccgttcaccgtaagccagtggaagattgggagaagcaataaaaacaaccccaaagcagtaaagccaattccgagaactaagactcccgcccaaaatgaagtgaagattatgtaaccgcccgccccaattaaaattacgcccatcagcagtaaccctaaaaagaaggcagcaatagtgaccactatcgaaaaaataatgctgaacggaaccacgcaaatggtaatgaggatggcggggatgatcagacccactggcgtagcaaaggagaggattgctaaaatgatcagccaaatggtgcgtacgtcacgttgcggttgcttagattggggttgcgcaccagtatcgtccatggtttggctagccttgatcgaataatcagcaagcactttcctagccaactggaccggcgtgccgagcttatcaacggctgcggcatacgtttcaattccggcgtctgcaaggtattcggtataaaaattaattacatctaactgttcttctgcagttagttcggttaaatgggactttagttcatcgatgtattcatgcatctgattcaactcctccaagtaattggtcgatttggtttttaaaagtgaaccactcgtgctgaacttcagttaactgcgcttgaccttcagcagtgatttgataatagcgacgattccgtccttgatagggttcatcgtaggtggtaagtagattagcttttttcagtcgccttaaaacgggatacatagtggattcggaaacggggatgtgctcttggactttctgggttagggcgtacccgtaataatcggcatggtttaaaatgccaagtacgcacccatcaagtaaggcggtgggaatttgaattgccacattactcctccttatactatatgacatataatattgcttaagccacattatgaagttaacactattgaaagtcaatagggaatattaaagaaattataattagacaaaaccaaaagagcgtggaacaagtttacggcgtaactaaaaatcgaccactatgcctgaattgggcataatgatcgatttgggattgaacggaataaactaacttttggcgcacgtcttgacgctattaaagccaaaattattttttcaaaaaagtttcttcggggaaaagaatttttttagtttttccgattctttaggcttaaattttaataaatgaagtaacaaaaaccaatccagcacttctgctgtcacactttagggagattaatttgccaaacgttgaacgtctcgtacaatcattaattcttcgttagtaggaacgactaacacgtctaccgcggcattgtcagggctgattttccgttctttgccccggacgtcattgcgggaggcgtcgactgccaaaccaaagtaactaagttggtcagcaattttttggcgtacttcaatcgcattctctccgcagcccgcggtgaagacaattgcgtctaaaccgccaagttctgcaacgtagcttccgataaaacggacaacccgattaatgaacatatctaaagccagttgcgcttgagggttggtaggtgcagcttcttccagatcccgttggtcgggagaaagctgggagatgcctaataaacctgatttttggttgaggatgtcaacaacttcttctacgctaatttctaatttctcagctaggaaagccacgagggaagcatccaaatcgcctgctcgagtcgccatcattaccccgcctagcggagtgaagcccatcgaagtatcgataacctgaccatggtcgaaggcggtgattgacgaaccggatcccaaatggcaggtgattaattttaggtcttctaacggccgaccgagcatttcggcagcccgttgggcaacgtaacggtggctagttccgtgcgcaccatatttccgcacaccgtactcggtgtaatactcgtaaggaatggggtaaaggtagtttacttttggcatttctgcgtacaatgaagtgtcgaaaacggcgacttgtcgcgctttaggcaatagctgcatgaaaatctcaatatagcgcgcctcaatggggttgtgcagcggggcgtactgggagagttccttaatctgagccaaaacttcattgtctactaagacagaatctttaaaatactcacccccagcgacaacgcgatgaccaattccgctaatttcgtgaagatgttccacgaccccttgatcttttaggtacgaaagcaccatggtagctgctaaatcgtaggtaatattatcttgggtaatgcggtacttttcttgcccgggttgttgagcagtaaaaacggaggcaggcaaatcaattcgatcaaccaatccgctcgctaagatttgctcatcaggcatggagaataatttccacttcaaagttgaactaccagcattaataactaattcttttaacatacgtcattcctcactaactccgacaattttaaacgaacttatgaatccgcttacattttaataataaacgatttaacgatttttatccatcaataatcgtcttagcgttaacaaattcgcgaattcccaggtcacttaattcccgtccgtagcctgaaagttttacgcccccaaacggaaggcttgcgtgtgaagttagcatttggttaatggcgacttgaccagtttcgatttgggaagcgagcttttcagcacggtctaaatcgccagcaaagacggtaccgcctagtccgtgttgtgaggcgtttgcgagctcaattgcttcttcgtcactgtcgactttataaacttgtgcaactggaccaaagagctcttgatcatacatcggattgtcgggttgcatgccactaagaatcaacgggtggaaactagcgccaggcccttcaaacggcgtattatctccccaaagcaattcagcaccgccggcgatggccatatcaacctgtttttgtagtttttcttgggcagacttggaagaaagtggcgcaagagtcgttttcggatcttgaggatcaccaatttttcgtttagcaaactccgcgattagtccgtctaagaactggtcgtaaacttttgaattaataatgaatcgtttagcggaagtgcaaacttgtccagcgttggttaaccgagcttttgcgccaactttaattgcctggtcaagatccgcatcttccgtaacgatgaatacgtcggttccgcctagctccatggttgatttcttcaggttcgcgccagcttcggccgcaatcttctttccggcgccttccgaaccagttaaagcgactccttgaacacgtggatcagcaatgatggtgttgacttggtcatagttgatcaataagtttttgaaagccccggtagggatgccagctttttgggtaaccgtggcaaaggcatcggaacagtccggaattatgctaggatccttcaataaaacggggtttcccaccatgaaattaggagcaaatacgcgcatgatttgggtgtacgggaagttccaaggctcaactaacaaaattgccccaatggattggtatttaacgtgagcacgaacgcccggaacgtcattgtagggggtgtcttccaatagtttagcggcgttttgggcgtagtattccgcaaattcaatagtttttttaacctctgcttgtgcttcggtgaaaagcattcccatgttggtagtgattaaacgggcgtagtcatcgagattttcccggaaggtgtccgcaattaattgtagtttctcagctcgtttttcgataggttgagttttggcaagttggtaaaattcatcggcattttttaaagcaacttcgacctcttgatcagtggtgcttggatatgtttgaattaattttccagtatatggatttacagattggtatgccataaaaaaatcagctcctttttcgttatggttctattgtgcaaaagaatgcgcttacattcaagtaatatcgcttatttgttaaaaaataaatttaagctcttttacgtggagggaaaagtttgatttttggtatatccccaaaacccgattgaggttcttcatttttcgacctcttttaaggtcgttttcagttagttaaatgaacttaaatttaagttcagcattcctgaattgacggtaatataaaacgagacccggtaattttcagagtctcgttatgaaggttaaattaagttagtaatggattacttttcactggagctagactgctcacggacttgttcaagtaagtcggggtccttgaccaacgcatcacgaatttcttttaaataaatttcactattatcaacttcatcagtgttttcttcctcttcagctttcttaggtacaaacttattaacggtttttacgataataaagaccacgaaggcgataattaaaaagttaatgacggcgttgatgaagctcccaaatttaaaggtagcgccggccaccttgaatgaccagtctgaaaaatcaattcctccaacgaaaaggccaattaatgggttaattaaatagttgaccagcgccttaacgattgaagtaaaagcacccccgatgataaccccaacggctaaatcaaggacgtttccacgtgaaacaaattctttaaattccttaagcatatgtagtacactccctattttagatgatgccggcactttgcattaatcggccgacaataattttaactttggacaaattccttcgttaattaccatttctagtttaacatggtcagccataatttaagtggcggacgaattttaccaatttagtaaggattagagtggcaaatccaaaaaagaggttgaaaaaactaaagaaatgcttttcatgaatgaaaagattcttaaaaagtcgttttggtgttttgccttcaataaagccaaaacgtgtgccaaaagtcagttggttccgcttaaccaaaaattgaccgtcgtgccaaattcaggcatcatggtcaattttcagttaatgcttgcaaactacccgactttggtcccactctctttgaattaagcggagcctgccgccctttgaagctagtaaattaagcgagtcgttctatttaatcttaattttcaccgtaaaaactaagaatcacgacccccacaatgatgaagaagattcctaaaatattgcctaggttgatcggttccttccaaaaaaggaacgcaatcacggcagttagcaaaatgccaatgcctgcccacactgcatacgcaatgtttaggttaattgtttttaacgagagcgagaaaaagtaaaagcaaattccatacgaaagtaacgcagaaataccgtaaactggacgcgtaaaaccggctgacgcctttaataaattatctccaattaattcaccaacgatggcaaatgataaatacatataccccatatctttgacctctaattctgatttaaccccttcatcataacagaaattattaaataaagtattagttataaaaaatttagcgggtgaaattttatgcgagttggtgattagtaaattgaagagaagacgttgaaaactaacaaagttctaaaagacaattcaacaaatctatctcaaagcgggtggtagtttgatacaatcaacttaaaaacatcacagtacgagatgatttaggaggattgaaatggcgacggttaaagatgtggcgttaagggcaggagtctcgttgggttcagtttcaaattatttgaatggtaaaagattaaagcccaagactgctagtcgaatcaaaaaagccatggatgaactcgattatcatcaaaatattattgcaagtgggttaaagaagaacaaaagtatgtcaatcgggattgtagtaaatagtttgaccgactttttttcaatgtcgattgtatccgaaattgaaaattacgtggaaaattatggctatagcattattatctgtgattgccgagaagataaacaacgttttgaagaaaagatcgagttcctgttaaaccgctcgattgacgcaattgtagtctttcaccaagacgaaagttctcccatgttggaaaaagtggtggaacaagccgtgccgattgtagcaattgacgcaccgattcacgggattcaatccgacgtggttttagttaataattatgagtcatcgcgggaaggcgtggtggatttaattaaccgcggttaccaaaaaattggcattatctcggggcaacctcggaattacatttcccgagaacgtcagggcggatatgaagatgctctaagagaacacgacttacccattaatcagcagtatatttggcaaggaaactataccattcaatcaggagtggaggggacaacccgcttacttactaagcacccggaaattgaggcgcttttcgtgatcaattattatatgtcattaggtgctttaaaggccttgagacaaaatttttcaaaaaggcacgttgaaatgctagtgtttgaccacttttttgttaacgatattttttatccatcaattagctcgattgaacaaccggtcgccacgattggaaagacggcgggacgactattgatcgaacgtttggtgaaaggtaaggaaggcaattatgaaactatttattgtaaaaatagcctacgtacttaggcagcgctagtggatttaagggcggattggcagataaaagtaggtaattaagttggcaaaatgtttttgaaagcgcttgcgttatttagaggggcgtgttattatttcggtgaaaatgaaacgattcaaaagaaggtggtggtgttcagcagtaaattttatttttatcctaaaaatgaaacgtttcaaatttaaaggaggaatttatcatgaacattttattagcgtgtggtggtgggatgagttcgtcaattttggcggaagctttgagcaaggaagcccaaaacaacggagttacttgggaagttaacgaatctagtattgaccgcgtcgaagacgacttacaagaaaaggattatcaaattgtcctcctcgcaccccaagtttcgtttaggaaaaaatacatcgccggattagctgaagaaaagggtgctaaattagtgctgattccaatgacgatgtacactcctgcaaaggcaaagaaactgtttcaactagttaataaggaggctgaccatgaactttgatacaatttccgagaaaatgggagcggtggccaacaaccgctacttaaccgcgatccgggacgggatggctgtaattattcccgtttcaattattggctcgttctttacaattttattgaatttaccaatcgatgcttggaaagcatttattcaaccctatgcatccatgttgtcaattccaatgtactattccatcagtttgatggcggtctattgtgtattctcgattacttctagtttgtgtaaattttatgatttagacccagtttctacatccgtcttagctgaaatgtcattttttattttagcaattgttccaaacgttttaagtgctaagacagccggaatggaaccaggaacttaccttccattggcaaatatgggagctcaaggactgtttaccgcaatcctgtgtgccattttttcagtagaagtagtgcggttcttctataaaaagaatttaattatcaaaatgccagagggcgtaccaagtgcggtggggaaatcgtttagcgcattaatgcctggggtagtaattatcgtggtgtcgttcgttctaaaagaaattttgaagctggacgttaatggaattttgacctggattttctcgccgatcggctactttggtcacgacaccttcctttctgcggtaatcccggtattcttgattaccattatttggctctttggggtgcacggaatggttattgccaccccgattctgtatccatattggtacgctaacctcaatgccaacactgatgcaatcgcgcacggcggcgcaccagttcactttatgacggaacaatttttccaatggtttgtttgggttggtggagccggagccaccctttccttagcgattctactggcatttttcagtaaggccaagtttagtaaaacgatgggggcggtcaccatcattccggccatttttaacatcaacgaaccgttgatttttgggattcctatcattatgaacccttattttgcggtaccgttcgtacttgcaccaactgcaatggcggcggttacctatctagcgatgaaattgcacatggtcgcgtacacgaccgcagtggcaccgtggacgttaccaggcccgatcggagcgtggatggcgaccggatttgactggcgagcaatcgtcttatgtatagtgaatattttgatttcgatggtgatttattggccattctttaaggcatacgataaaaaccaacttaaattagagaaagtagatgactaggtgatgtttggcatatcagtttacccaagtaaacaaagtacagcagaatgcgtcacgtacattgataaagcggctgatttaggttatcagcgtttatttacgagcttaattgaattggaaggcgatccagaggaaaccattgctcgttttaaaacggtgattcatcacgccaagcaacgaaagatgtgggtgagcttagacgtaaatccaggtttgtttcaaaaattgaacgtcagctacgatgatttgtccttttttaaagacctaggagccgatattttacgcttagacatgagttttgacgggatgccggaatcattgatgacctatgatgagcacgaccttacgattgaagtgaatatcagtaacgatactggcaacgtcgcgaacattttgacttaccgaccactaaaatcaaaaatgattgggtgccataacttttacccgcaacgttataccggattagataccgaatactttttgcaaacaacccagaagtataaagaaatgggcttacgaacggcagcatttgtttcatccaacgttgccacgcaaggtccccatccctacaatgcggggctgccaactctagaaattcatcgggggcggccaattgttgaacaagtgcaatatttaatcagtactaaattaattgatgatgtaattattggcaatgcttgtgctagtgatgaagaacttgcccaagtggcaaagctaaatcaacagttgcccgagttcttgatccaatttactccagggactacggagttagaaaaacaaattattttggataatttacatttcaaccgcggagatattaacagctacgcaattcggtcgacctttgttaagttgaagtatcgtcaggtcaatattccggttaataacgcgaagcatcaactgacccgaggaatggtaacgattggtaatgatgattttggacagtataaggccgaggtgaacatcgttaagcaaccgatggaaaatgctgatgagcttaaaaatttggttgctacaatcgtaccgaataatcaagcgttgattgacttcatccagccttgggacaagtttaagtttatcgatgcggacaagttttaaatggaaacggggaatttgatttggaaggtttagaagaaatttgttttgaaataattagtcactcgggccaggcgaagggcttactgatggaagcggtgaccgattcgcgagcggaacatccagactattcggcaattgaaacgatgctaaaagatgctcgagacgagttgaaggttgctcaaaaagcgcatttgaaggtgttatccgactttgcacaatcggggcaaggagacgcggttaatccgctatatatccacgcggaagatcagatgatgtcagcagaaatcttcctggacttacttagtgaactgattactactaataaggaactccaagaaataaagcaacagctttaaggataactgcaactgaggctgttttaggttgaatttgaggttcaattgaacttcagaattagtttaaaaatgaatttaacgcagttattcaataagctaataaaaatacgttcccgttctcgctttcaacgattaactaaactataaggacatttttaaaccggttaatctatcaagacagctggaacgggaatttttattgaggtaaatttaatgatggtagaagacaagattttaaattttgaaaagatgggtttagggttatttattcactggggtctctatgcgcactttgcggaaggtgaatgggcgcaaaatattttagaggttccaaattactcgcaagcctttacacatttcaatcccgatcctaagaaaattcgacagtgggttaccctggcaaaacaaaatggttttaagtacatcgtgttaacggccaagcatcacgacggtttttgtctgtttgacactaagggaatttctgaatttgacagcatgcacacgccttttaaagcagatgtcattaagatctttgttgatgaatgccaccgacaaggaatcgctccgtttttgtactttgccacctatgattggcataatcctaaatatactgcggactttccgggataccttgcagagttacggcagctaattcgacttttggcaacgaattacggagaaattggtggtttttggtttgacggtaattgggacaaaccggatgcagattggcagacggaccagttatacagcgagattcgccaacttcagcctcaggcaatgatcaccaataacacgggtctagaacagcagggggttaatcaaggcgaggccgtggatgtcctaacttttgagcgtggtaatccacaaaatatcaaacatgagcagcacggccggtactttgctgcagaaacttcgatgacgcttaaccgccattggggcaacgcagaaaatgatttagattatgtggctgctcgccaattaattgaacaaatttgtcaatctcgtaaagtaggagccaacttactaattaatatcgggcctcaattcgacggttcaattgatttaccaagtcaggcgcttcttgaattggtcggcaaatggatgcgagttaatggaacggcaatcacagccaccgctaacgaaactcatccaacgtatatcgctgagaataacgataaaaacttcattaaaggtgactatttgtttgttactggcttgcagaacatcgggaaccataacgtggtgctgggtggcgaacaggcacaagaaattatctttcaagggcaggtgccccaacgaaaaattaagcaaattgtttggttggataatgggcagtctgtggattttcaacaaagttcagatgagctaaaaatacttgctgacagtttccggtacggcacgcacctagtagtacgggtagcccaaatcacttttgtagattaagctatattcaacaaactaaaacgagacccagggaaaaattccctgggtctcgtttttaaaatagaatattgaagttcaattatgcgcgttgcccatcccagcggttaggcttagatggcaaaatcatcaagataaagaaccagattgttccaattagcggaattaggtcaattaagacccaccacccggaacgatccgtgtcgtgtaaacgacggaacttaagtgataaggttcctacccaaacgattaaggtaacgatttgtaccactacgttagtgctcaagtcctgccagttgtaaatatcatcgatgggatgtcccattaaatttgtgatgatactaactgctaaaccgccgatgatgtagttaataattactggccaccaatattcggcacgttttgcagtaccagaaaaatcaaataaattattccagaatttcttgtatgcagttaccataaaattctccccccctcgagtaaatttaaaattaataccagctttttaagtcttcagatcgttggacgtcgttgtttaaaagtcggtgaaaataacgggattaattccagataaatttaatccgtataggaataaaactaatccattgatcaccagcgacataataatgatgccgtagcgaatcgttagataactaaaacctgccggtcgccaagcggtaaagcgtggtccccggtaaccgattgcgattaataataagccaaccgtaataattatttgaatgacggttcccactacgtaaatggggttactaggatgatttaactggatgaagtaagttccgagagctaaaaaatccagaaaacacgcgaataatggcataagcttctccttaatttaacttaattattaagtacaattgaagttcaaaaaaacaccaacaattaattattacactatttttaccaatcttaaagaaatatgataatgctggggttttcttaattataaggggtacgaattttaatagcgatttttatgcttgtaacgattagtagctataaatatcccgaaagaattagtgatgaaagatttaataaagtaacgatgatttctcagagctagaaaagtattttgaagaaaatagatggctggataagcctaagggagtgccaatcaggggaggagttgagctgggtggccttttggttaagtaaacaaccgtacataattatttaggcgaactctattattctgaacagtttgtgttaaattggacttgaagaacagtgaaatgtatggaggaaaaatctttggaaatcgaagatgagattttaggaaacttgaaaccggttaagcaccggttgctaaagtatggttttcaagaaaaagacggtcaactagtttttaccaagaaaattatcaacggtgatttttcggtaaaaattagtgtagcccccactggacaagttacggggcacatttttgatttagcgtttggcgatgaatacaccaatttccgagcaaaatacgtggctggagagttcgcgggtaaagttcgtgaaacctatgtagcacttttaaaatcaattgccgaccaatgtttcacgtttgataatcatgcgcacgtaggtcaaaaatggattgtccctgctaatcctaaatattttgatgtggatcaggcgtttcgcgaaaatagcaccatcatttggaaacagaccagtaatattaaggtgaacgacctagtgtacctttacgtaacgtcgccgatttcggcaattaggtacaagtgtttggctgtggaagttaacatcccgcaaaattaccgggatgccaatattaaaatgaataaggcaatgcggattcatttgataaggcagtatgacaaaacccaattcgcgctccccgttttaaaacagtacggggtcaccaccattcggggaccacgacacatgcccgagcagttggcgcattacatgcaagtacgggaggatgatgacgatgagtgattcgctatccgatttatcgttagaagaactgtggcagctttttcccatccagctggttgcccctcaaccaaaatggcaaacttggtatgcagaagaagaacggcgtttaaagcagctgctcccggccaacgcggtaattagccacgtaggaagtacggcaattgctaatatttgggctaaacccattgtcgatattttagtggaagcccctcacgccagttatgcagcgattaaagaaattttggaacaaaacgactacatttgcatggcgcaacgggaaaaccggagtgattttaataagggatacctgccccaaggttttgccgaacgagtttttcaccttcatttgcgggtgcttggagataatgatgaaacatattttcgggattacctaaataatcatcccgaaattgcccaccagtatgaagaattgaaactggcgctttggaagccttatgaacacgatcgtgatggctatacggccgccaagaccgagtttgtaaagaagtatacgcagctagctagaaggggcaaagtttaagaagttatttagtttaaggttaaaaataggaggtctatcaatggaagcaagtcagccagtccaagccaagttaaccgaactcaacattccgtttgaaattgtcaatcatccgccggcaacgaccaccgcagaagcggatagttatattaaaggaatttcgggagttcgcacgaaatcaatgtttttaactaatcgccgaaaatccgcgtactatttattaattatggatgaccaaaagcatttagacatgcataagtttgcggaaatcgtggatgaaaaacgtctgcatcttgcttcgtccgccagtttaatgaaaaaaatgaagttggctccggggatagtttccacgtttggtctattaaataacgttgaaagggatgtccaggtttacttcgataaggacattgtcgatgagcaacggatgagtttccatcccaataccaacgagcagaccatctttttagccactaccgacttgtttaagtttattgaagcggttgggtttaagtaccaggtggtggaattgtagtaacggtaaagatagtggggcaaaaattgaccattatgcctggatttggcacaatggtcgacttggggttaagcagacagggctgaattttagctccattaaactcaacataataaaatgaattttcaaaaaatttccgtttttaaaacggatttttttagtttccgctttatttacccgtttgtaaagcagcaggttttttcaacgcagcaatcaatttcttggctaccgctcgaacagaaaatggattttgtccggtaattaaacgaccgtcttggatagcatattttcggtaagctaacttttggcgaaaatgggcgccgtgatcttcggccgcttttttattaaggaagggaactacggatttttttccggcaaggatttcctcactggtcgtaaagccggtaatgtttttcccgttaattaagtattgaccatcttccttaagattgagtaaccctgcaattccgtgacaaacggagctgatgtagccatggtgatgataaattgccatggctatcttctgaagttcagaattatctggaaagtcccacatcacgccgtgaccgccggtgtaataaattgcagaataatcggcagggttaacgtcttgaggggctagggatgctgtcaacgcccgttttttaaaatctgccgattcgtagattttaagaattgcagagtcggcatacttcatgcttcgcggatcaagcggaacaaatccaccttgcgggctgacgtaatccacttcaatgcctgcctgcgtcatttcatcaacaaattctgcagcttctcccagccaaagtcccgtaaggtcagtggtcccctggtaatgatcaacgttggtaagtactactaaaactttctgcataattaatctccttcattaatgcactcgctgatgtgagtcagcaaattttgtaactgctcaatttctttaatttggtgcgacaaataataataattcttcgtgcctactcgctggtacttaactaaatgggcctcacgaaggattttaaggtggtgcgaaactgcggggcgggaaagctttgtcaccgaggttaattcactcgcacgtaacccttggcaggcattttcggcaagtaaagccataataatggcctgccgtttttcgtccccgatcgcaattaagaagtcactcaaattagaaaattcggttttgatttgctttaggttgtccatttgaaagctcctaatggttcatatttttaaaccatttaaccacgcctaatgaactaagtcaaataaaaggtctaagttgaaggacttgacgtctttaaaaagacaaggtaagatactgcaaaaagtaatggtttaaaaaaataaaccaatcgggagagttaaaatttatgaaaaaacaaaacttagtagcagaaattaaccaatatggacaatccgaagtaaatcttgttgaacgtgcaattcctgaagttcagaataatgatgttttggttgaggtagttgccgcgagtgtaaatccggtcgatttaaagataattgaaggtaaattgaagttaattctgaagtacaaaatgccgttgaaagttggtagtgatttttctggaaaagtggttaaagtgggttcaaacgttaaaaactatcaagtgggggattacgtttacggtagggtgcaaaaggaccggatggggacttttacgaactacctggtggtcaatgaaggtgaccttgccttaaaaccgcagaatttaacttttgaagaggcggccagcctacctttagtggcgttgactagctaccaagtgctacatgaagcaatgcaaattaagcctggcgaccgggttttaattcaagctggttctggcggaattggcacggtagcaattcagttggccaaactagcgggtgcggaagttgcgactactaccagtaccaaaaacgtcgcgtttgttaaggagctcggcgcagatcacgtgattgattatcgtaaggaaaactttgtagagaagttaagggactatgattacgtttttgacacgttgggtggccagaatttggagaatgcttttaaggtggttaaaccaggcggtaaagtggtcacaatttcgggaattccagatgctaaatttgcccgtagttacggattaccgcgttggaagcaagcgttgtttgcgattgcttcccacaaaataactaaactagcgcgccaagcgaaggcggattacagtttttggtttatgcgcccggatggcaaaatgttagcccaaatcacccagttagttgaagaaaacaaattgaaacccattattgactcaacttttacctttaaacagactcaggcagctttagattattctagaaaagggcatgcacggggaaaaattgtcattgatattaaccaggatttaagcaaggaaaaatagtaattagggctagaagcggcggatgtaacaagataatcgcgttacatttggcgctttctttattaatctggaaataaaggaggacgtgatggaattttcgaaggtgttgaaaaaacgtagaaaggaactccaaattactcaacaggctttagcagaccggttatttgtcacgcgacagacggtttcgcggtgggagaatggattaagttatcccaacttggatgttctagtaaaagttagcgaatgcctggaaataacgctagacgaacttttgaagggagaagggatgacggtggtcaataaaattagtgaggacgtaagattaaaggaaaaatatcgccgggctttgataatggtttcgttaattataggtgtttcggtaacgctattagtagtactgggttacgggcgagtgacccaaaatactacgattgatcgattaaatccttttttgaccacgaaaataggctacggggtgttgccacaaggaaagaaaatgtccgtggatacgttcatttcggacgacccgtttggtaatggagagtggcttaagtttaaagcgggacaacatactactaaggataaatgggtgatggtttcgcatcggggttcttacgtgtctagtgtacgattaattacttacgaggaagttcctacgacgtttaggacacaagttggaaccgactattttaagtataggcaaaaaactatgggccctcgagtttccaagaagtggggctggttgccatttgggggatgaaaaaagggctatatcttcgtattttaattgaagatatagcccttttttatataaagttaaatgcctagaaaatagttgacaattatttttgtcttaattaacggccagataaggcgcaatttacaattgattgttgaattttttgtaccataaacggtacaatgtaaaaggaagttaatcaactatagcgattattcaaagctaatgattggagtgaagtaaaaaatcaggttttgtattttaactaaaatgctagttagaatctaaaaatatcgtactaaccagtggtttaaggcttttaaaaaattaaatggggggcgaaatttttagatgatatgttaacggttattcacttagaaaattattattggaactatgaatgattagaaattattaaatgatagaaaaataagaaatgagagttttaaaatggacatgttaaatttagataataatgatagtaaattgaaagtaggtcaattcagcatagataaaaatatattgcaggttgcagattttaatctacacattcaaaatattgcatatttttatactggaaaaatattagttacgtatccaatcggattatatattttaatgggaatcttaggacttgcattgttggcattaatgccattattaggaattgtagtcttaattgctctcggcataatgatttatatgaaataccgtgaaaagttaaatagcagctcttatatatctatagtaatgaataacaactatacatacagaattttagtacaagacaaagactttatgaaaaaagttgtagaaactatacagcaaagtataaatggaaagtcagagaaatatatcgtgaatattgaaaatcaacaaattaataatggtaatatgggtggcggaatgtcaattaatgataattcaaaccatataaacattgacttcaaacaattaaatgaagaaataaagcaagcaaaagctgaatacacagaaaatagtattgaatttaaaatgctttctcaaatggaagaagctgccaatactgagaatacaagtaaattaaggaagattctacaatccattaaagaattagcaccaggctttatcaaagataccttttcacaagtggtagcaggtatgttaattaacttgatgtagttgtactatgtattttcgtgttaaccggacaaattaaataatttaaaaaccactattaagcgcaggaatgagtgtttctgtttaatagtggttttatagtcctattaattgttaaaaaaccaattcgtcgtcaaacgaaatggtttctttgataaccctcatgcataaatgctaaatagaaggttttagaagtttattttttaatacttcttatctaagttaatctcctgaacgctcttaattgcggacatgtcgaagcctgccatatcctcgacgaagcccttgctgtccatatattctttattctgtgcgctgagattcccgtcagaagaaaccaaggcgaaaattcggcattccccatcggtgccgacttctttgtatacattgtgaacggtgataccgtgtttaggaaggctcaccagatgtctcttccaatgcttatctaaataaatatctgcgtttttattgttgttaattgtgtaaattctaagctgaaacagcgtatcccctctttcatgaagtggagttattatatgctttaaaaatttttgcttcaaagggaaataccaaaatttggctaactatttttatgaagtatttgatcgtttttgatatctacatagtaattaataaaaatccccttaaggaggctcgtcgtcttcattatcctattagaacatgcccatttattatgggaagttaagcgcactaaatatttaggatataatggtaaatgctaacaaaagacgaaaggacaatcttaaagaacgatgaatgatttagttactaaaaaagtatcgttaattgagctcttttatgacttggtttttgtatacatgatatcgcaagccacaggtctaattcatcatttacataatggagtaattggattaagcactttttctatttttgctttagtggtaattttatttatcaattcttggatgattcaaactgtctttatcaaccgttatggcaacgattcttggtcaaataaattatttatttttattaatatgaccgtggttttgtatatgtcaaactctttttcaagtacgtttaatcatcaactgacacccttttttggcgcagctgcgttgttgtctttgacccaaaccatgcaatacgtaattgtgtatttaaaaacgactcagaatgcagataaacaaattaccttagccttcagcggaatcttagctacgaggaccttagcgttaaccatcggggctgctgttcaaaaccaactaggactactagccgcgttactgggaatcatgattagttggattgcaccaagctttactggtaaattaaccgtacgccgaccaattattttttcgcacttacttgaacgggtcacggctttaattattattatgttcggggaaatgattgtaggaatagcagaatatttcacccaacggacggtttcgccttattcactcttattatttgtgctagtggcactacttttcatgacatatgctacagaatttagcgatctaattgaagaaaagcaaggtagggaaacggggaatcgattaatttacctacattacttcattttatttgggttaagtttaattacggtggcaattaagtttatccatagcactaatgctaacctaatttttagcgttggatgcctatatacgggattattgctgttttacgttggaatcctcctaggcggtatttacaacgaagtaagctttaagattggaagtagacgggtgtgctggataataggctttaccttgctaggttggggaggcacattgcagttaaaaaatgctaccgaaataatattcattacggtagtggttgctctattaaatctactgatattagctaggattgggcagaatagtacttttaggcaaaaaatacaataaatttaaaacctcagaaattatagccatgacttaatttctgaggttttgtttatctgcagttgccgacaaattttgaacatctacaatcttatcttttagatggtcaatggattgttgaagtgtgcgtaattgcttttcggacttggataactgtctttttaagatggctagacggctggggatagtttcgtttcccctttggtaaagttgaataaagtttttaatttcagtaatggtcattccacaatttttagtgcaaataatgaaatccagtctttctaaatcttttttggtaaattctcgaacgccattaacgcgattaattggaccgagtagtccctcgctttcgtaataacgcagggtggaagtagaaacgttaaacattttagcaacttcattaattttcatggaaaatcctccttgacttaaagtgtactttaagcagtagaattgtcaacaaccgcagagggatggtgtctagcgaagttattaaaggaggcatttcgatggtcgatgtatatgcgcatgttttaacgcctaactaccttgctgagatattaaaaattgcgccgaatgctttaaaaaataacgaatggatgcaaaatccattattaacggatattaaaaagcgagtaaagacaatgacagaagaccagcaagaaatcatttcaatggttaacctgaatcctgaagattgggttacccccaatttagcggcttccctgtgtcaatctgccaatgccgaacttatagaaagggttgaagcgcaaccgaagcactttgtgggcgccgtagcgatgttaccaatgaataacattcctgcagcgttatcaataattgatcaccaggtggctaacaataaagcgttggtgggcgtgcaactgtttactagagcgatgaaaaagcccatcacagatccaaaatatgagccgatttttgaaaaaatggcaggcttaggaaagccaatttggttgcatcccgtttttgatgaacgcaaatcagataataacctaacttttagctgggaatatgaacaaacaattgctatgaataatatagtgaataacggttactttgagaaatatcctaatttaaaaataatcgttcaccatgccggtgcaatggtgccatattttgcgcagcggatttattacattcaaggaaagcataactatgaagatttcaaaaaattttatgtagatacagctctattgggtaatccaaaggccttagagatggctgtagagttctttggggaacggcatgtattatttggtacagatacccctcttggagtcaaaccggatggtcctacccaaattattaaacaagcaatccagacaagcagtttaactaaacaacaaaaaagaaaaatcttcgttgaaaactggcaagatttaataattaacaaactgaaaggatgagttcaatgaataaagatatgcaatatacaacgttgggaaagactgatatagcagtttcaaagatgtgtgtaggcgcaatgagttttggcaaaccagggagtatgcacgattggacactcgattattcagacagtaaaaaagtgatccgccacgcccttggtttgggggtcaatttctttgatacggcaaactcttattctgaaggaactagcgaagaatacctgggacgcgcgcttaaagagaataaaattcctcgtgatcaagtagttttagcttctaaagtttatttcaatccgggacgattatctaaagcggcgattcaccgagaaattgagggctctttacgacgcttgaacacggattacttagatttatatattattcatcgattcgattatgaaacaccaattgaagaaacaatggaagctttaaatgatttagtaaaggctggtaaagtacgtgcgattggtgcttcagcaatgtatggctatcaattttataatatgcagcaaattgccaaggaacacggctgggcgcaatttcaaactatggagaaccactacaacctgctttaccgggaagatgaacgtgaattaattccaatttgtaatcaaatgcaagtgtcattaatgccatacagcccgctagcagcgggacatttaagtcataaggcttggcaggcgaacactttacgtagtcaaaccgaccgagtagcacgtggaaaatacgatgattcccgtttggaagaccaagaaattgttgaccgagtatccgaattagctgaaaagtatggtgtttcgatgagtcaaatagccttggcttggcaatggaaaaaaggcgtggctgcaccaattattggctcaactaagatgaatcatcttgatgaagcagctgctgcgttatcgattgacttatcaccagaggatgttaattacttagaagaattatatgtaccacataagataattggggcgcttgacgaaaatccagctgaaggaaccgtcctaattgacgagaaaaaataatgattttgttaggagagtgtacacatgctaagcgaacatgaaaaattattagcgggaaaagactatgattaccgggatcccgaaattcaaacaatgatccagaatgcccagaatgtgacgaaagaaattaatcagactcaggattttagtaaaagaatggcattgtttaagaaactatttgcagacgtgggcgaaaatgtaaccataatgagtccttttcgagttacgtacggaaaacatatgcgactgggaaatgatgtattaataaacgctaatgccaattttttggatgctaatttggtcaccattggtgatcgggtgttaattggaccggacgttaagttttattgtggtgagcattcgattgatgcaagcaaacgttttggaaagcgctcagatgggagttcctacgttatttccactaccagacctattgaggttggaaatgatgtgtggattggaggaaacgtcactattcttcctggggtaagaattggcaacaatacaattattgcggccggagccgtagtcaataaggacgtccctgataatgctatctttggcggagtgccagcaaagaagatcaaagatttgccagtacttgatcgctagtgatttagaaatctaaaactctataaataaaatagagatatagtccaaaaaaatttgagcacaaaaaaaccagcactcatttaattgctgttttttttgttaaagagaaaaatgtagacgacaaaaaaatcagcaaccacggcctgacgcagcgtgattactgattagtgtgtctatgtaatgggtggtcaggggatcgaaccctggacccacggattaagagtccgttgctctgccagctgagctaaccacccatgtgattgatgtcctcatcaactcgacttaaatatagtagcatgaaaaaaaaatcatgacaacactttttttgaatttttttcaaaaaaagttaaaaaaagtgaaattttagctaataaggggctacgagagcgttatcattcaaatttgagcgcatgtggtataattgacagaaacgaatgggatagacctttgcctaaaaaaatggcaaaaaaatccgcaactttttttgaatttgtatttatatggacaaaatcggattagtaaatttggttgacggtagcttaatgtgaaattgaagcactaagccggtgaccaaacgtttgaaaattaattaagtgtctgtcccaacttcttacaactaatggcagatatatcttctgaggagggcaaacatgccaaaaattttagtagtagatgatgaaaaaccaatttccgacatcgtcaagtttaatttagataaggaaggttacgatgtggtaactgcttatgacggcgaagaagcgctagaaaaagtagaatccgaggaaccggacctaatcctattagacttaatgttgccaaaaattgatgggttagaagttgctcgccaagtgcgggccaagcataacatcccaatcattatggtaaccgctaaggattcggaattggataaggttgttggattggaacttggtgcggatgactacgttaccaagccgttctccaatcgggaactggtagcgcgggtaaaagctaacttgcgtcggcaggatcaattccaacaaagcaatgaagaagtaaaaaataacattaagattggcccactagtaattaattcggattcgtattcggtaactcgggacggtgcgcaattagatttgacgcaccgggaatttgaattgctacattacttggcacaacatacggaccaagtgatgacccgggaacatctcttacaaacggtgtggggctacgattactttggcgacgtgcggacggtcgacgtaacggtgcggcggctacgcgaaaaaattgaggaaacaccaagtaatccgcaaattttggtaacgcgccggggagtaggatattatttgagaaatccggaaacggactagagtgttcaattctcccgggtagcctttgaggattaactggattttagacttaatcgcgaccagcgattgggtctaaaatttggttaaccgcagaaggctgggagacttgaacacgtttcggctacgcagcagtaaaatttggttaaccggaaagagctgagggctggaacttatttcggctacgcagcagtaaaatttggctaaccgcagaaggctgggagacttgaacacgtttcggccacgcagcagtagaatttggttaaccgcaagaaataggctgcgaaactcatttcaactaattaatagaaaaatatcggtcgctgcgccatcgcaatggaggtagaagtagcgcccgtttaactatggaatgggttatgatgcctgcctaactcagcgaacgtcttaaacgccaactcaacggttgcaaaagcgcatcacgattaataacctttgaccagtagtacttagttaccggagttcggtaagaatccccatggctaagcaggctggcctattttaggcacgcaattgccgatttgtttccttaactaatcaattagttagaactcggggagtttaaatgaataagcgaacaaatttttttagatcaatcaattttaaaatagctctagtgtttgcaatgttgctggtggtaacgttggaagtcgttggagttatttttgtgcgtcaattggagacgcaaaacttaagccagttcaagtcgcaagtccaactccaaccgtacgtggaaaatgaaattagcgcgcaacttgagcgcagcaacacgaaaaaggcgaacgaccaaattgcggacattattggcaatattaataaccaaaacatcacggaaattcgagtaattgatgctaagggagttattcgcgggactagtaataatgccgatcggagcatggtcggacaaaaaactaccgaccggaacgtcaaggacgttatttataatacccgcagttaccaacaaatttcttataataaaacgaataacacgcgttactttatttcggtggttcccctcattaacacgtcgggagctaccaataatttgacgggtgttgtttacattcgggccaacttagagtcggtttaccaaaacgtgaataacattacgcttattttcgtggtggcggccctaattgcgattacgattggtcttttccttgcggtcttaattgcgcgggcgattacgcgaccaattgaagaaatgcggcaacggaccatgcaaattgcccggggagattactccggacaggtccagatttacggtgacgatgaacttggccaacttgccgcggccgttaacgacttgtcagttcgggttgaagaatcgcaggaactgaccgaatcagaacgacggcgattagactcggtcttgggttacatgaccgacggggtgctggcgacggatcgccggggtcgaattacaatcgtcaacgaaatggcaacggactttttgaatttggaaaacgaccaaattgtgggcaagtcaattttagacattttagacttacgcggttcggtaacactgcgtgatttattggaaaatcaagatcccgaagtgttggatttgtctaccgatgaacaggatttgattttgcacgcctcctttgccctgattcaacgggaatccgggtttattagcgggttagtttgcgtgcttcatgacgttactgaacaacaaaaaattgaccaagaccggaaacgcttcgtatctaacgtttcgcatgagttacggacaccgctgaccagcatgaagagctacattgaagcacttgtcgatggggcttggaaggatccgaacgttgcgccaaacttcttgaaagttacccaagaagaaaccgaccggatgatgcggatgattaacgacctgctaaatctgtcccgaatggacttggggacggcgcggttagataaagaatacgttaatttaaacgagctatttaaccacattctggatcgttttgatatgattttgaagaatggggaaaaatcggagaaaaattacaccattaaacgggatttcacccggcgcgatatctgggttgaagtggatacggataaaattcaacaagtgttggataatattatgaataacgccatcaagtattctccggatggcggggtaatcacttgtcggctggttgagacccataaccacgtgatcatgagtattactgaccaaggacttggaattcccaaagaagcgattagtcacgtctttgaccgcttttatcgagtggataaagcgcggtctagagcacaaggtggtactgggctagggctagcaatttccaaggaagtggtccaaatgcacggtggccggatttgggtagaaagtcgcgaaggcgaaggttcgaccttctacatttcactaccgtacgaaccgtttgaggaaggggatgcttgggaataatgaaggatacgaagacccggcgcattattcgccacgcgcttttagcaattttagcgattatgagcattagcctttcgtggttaatttggacgaatccggcgcgttacggcggctcacgccatattgcaaacgaaaaagttcagtctaaccaagttaaacgggacatgagcgacgtaattttacctactcaaattatttacactaaccatgacaaacaacaattagttaataattctaagaaaaatttaccaaaaatgatcgtggccgaggttagtaaatggcgtttggaaagctccacgcgagtatcacgcggcaataaggaacggtttatggattacgccaccatggatcgtagcgtaatgctgaaatatcctagcaacattaccacgcaaatttttaatggagtttacgatcagaagttaaattccaattacgaaattagccaagtggtgattaatctagataaacgtaacgagtttttcttacttaatgataaaacttacgacgtttatcaaattaaagtcagcaggcagaacttaaagaatttacgacaactagtgcagggaaatgaccaagtttatgcagttaaagaaacggtcatgaatcatcgtctgatcaacgattactataaggctccggcggtaccatacaacagctttttgattaacgaggaaagcagcagcgtatttacggccaacttgttgaccaacacggatgcggattcaattgataccaaaaagaccaaggatggggtggtgtacgtaactaacgacaacacgaaacgccttcttgtccgtaataatggtcaggtaacttttaataatgcgagcggtaatggcggcggagatggcctgaataataatatcgagaagagcttcttgcagatgaaacaactgggagtgcaagccgataccaacgtgcgctactttgatttccaattggctaaacggcaggcggaattccgcgattacgtcgccggattcccgattttcaatgaggatggtttaggcacgattaaggttgcccggcaatccaacgaactgacaacgtctttttcaatttacaacttacaggtgccagttccttctaaaggaggtaccaaacagctgcctacgactgaagaagtactaaatcagcttagttaccaaggaattaaccctaaagatatcaaagacattgaaattggatatcaatgggcgggtaaagtagcggccaacacgacggtagaattagaaccaacgtggtacgttaattatcgtggtgaatggacggcctaccaaaatttggctagctaaggaggaacgaaatggattttaggagaatcgaagtaatcttcatcgtggtttttgccatcttaaacgcctatttattcggttcctactggcaataccaaatggaatcgggcacggtcacgtcgtcaaatactagcgcgagcacgtccattttaaaggagatgcgtaacgaccagatcacgtatatgccactttctaacaagaaaaaggaagggtattacgcccaaagcaaagtggatacttccctcaagggtggcattaagcaccttactgggcaaaatgcacgcgtggttgataataagttgtatagcacgatcaccgatccatttaccatcgatcccaaagatccccagaaggctttagaccgctttttaaaggatcgggaaaacgtaattgctggcacgcagtatcagtacaatgcgaacttaagcagcgatacgcaagtggtttatacccagatgattgaccagcgtccggtatattctaaggacggccagcttattttttacgtaaataccagtaatcaagttactggctacgtgcaaggtcatttggtagctaaaaaacagcttcgtgaagaaagcgaactgattagccaatcgcgggcggtcaccctgctttaccaatacaacgaaattcccaataactctaaaattgagtgggctaatttgggatacacgaggttgctaagcactgatgagggtgcagtttacgtgcctacttgggtaattggaatcaaaaacaaaaatagtgctaatattgaggttaaacgaattaatgccttttcgggagtgttgatcaaaaaagacggtcaaaccccagtaaagaaggctaaaaccacggataaagcagctgctacggatccgaacggcacgagtgctgaatctgcagaggacggtactgcgtcaacaaatagttcgaacgcataaattattgttaatggattaaattttaagtaggaaggtcaaaagatgagcgaagagggtttgaaagttagcgtgctttccagtggaagcaccggaaacgttacctacattgagacacccgaacataaggtgctggtagatgcaggattgagcggcaagaaaattgccgggttaatggaaagtgtcggtcgggatattcatgaggtggactccttatttgtcacccacgaacattctgatcacattcaaagtgtcggagtgttagctcgaaagtacgggatcaacgtttacgcaaaccggggtacttgggatgccattaaaaataaggtcggtaaaattcctaccgaacaaaagtacatttttgatcccaatacgactaggtcgttggatgacttggatattgaaagttttgcggtgtcacatgacgctgccgaaccgcaattttacgaatttcatcacgcgggaaaatcgttcgtaatattaacggatacgggatacgtgtcagaccgggttgcgggcacaattcgcaatgccgatggctacctgtttgaagtaaatcacgatacggaaatgttgcggatgggcggctacccgtggccgcttaaacagcgaatcatgggcgatcacggtcatttatcaaatgaagacggggccaacgcgctcatggacgtgattggcaaccgtactaagaaaatttacttaggtcacttgagtttgcataacaacatgaaggaattggcccatctaacggtgagttccatgatgcaaaaccatgatttagcggttggccatgattttgaaattctagatacggaccatgaaaaagcggatccgctggctttaatctaatttttaaccttttaggaaatttaccgagtaaattcatacaaataacataaattacaggctataataggccgtaacgggaatattgtatgaggagggagcgggaatccgcgacgtgttatgaaaaataataaaattattatcacggctgccattgcaggtttgcttggcggtggggttgcctatggtggggcgagttttgtacaaaatcgaatggaagccaccactacggcagttccaactggttcaaataaatcaggggaaacccagacaagcaacgtgaaggttaacgttagcagtcaatcttcaaaagcattttctacggtaaaggattccgtagtttccgtaattaatttgcaaaaagaaaatacgggcgacaccgacaatattttaaattcaatttttggggacagtgagtcctcgtcaagcaagtcttcttctgataagcttcaaacggcttcggaagggtccggggtaatttataagaagagtggcgacaccgcgtacatcgttacgaataaccacgtggtcagcggctcaaattcgcttgaagttatcatgagcaacggaaagaagctaccagctaaaattgtgggaaccgatagcgtaaccgacctagcagtcctcaagattaactctgctccggtaaccaccgtggcaagttttggcgattctgacaacatcaaagttggagagacagcgttggcaattggttcaccactaggttcggaatacgcaacttccttgacgcaaggaattatttcggcgaagaagcggaccattgaaacgtcaaatagcaacggccaaggtactggcgaagcaacggttattcaaacagacgccgcaattaacgctggtaactctggtggtccgttaattaacttggcgggtcaagtcattggaattaattcgatgaagctttcttcaagcggtagctcgacttcggtagaggggatgggctttgccattccatctaacgaagtggtttctgtaattgacgaattagtgaagaacggtaaaattaatcgtccggcgctaggagtaacgttggtagatttaacggcaatctcttcagaccaacaaaaatcaatcttgaaattgcctagcagcgtaacgggcggatcggtaatcatgtcggtaaacgcaggtccggcaaagactgcgggcttgaagaagtacgacgtggtgacgaaagttgatggaaaatcaatcaaggacacggccgaacttcgcgaagcgctatacaagcataaggttggcgataccgttaagattggttactaccatagcggaaaatacaagactacggacgttaaattaactaaaacagcaagtactaactaattagataaaattgctggacggagaatgctttcttgagtattctccttttttattgttttttttgaactattagaaattaatctctttaagaaagtatctataacaaatgtttttggcggaaaataatagtgcacatttacgatttaaataattactcaagttaacttaggtagtttatattctaggatctttatagagtgttaaagcagagtgaaaaattattttgttttaatacaacagctaaattattaggaatacggagagagtaattaaaaagaggcagaaatttattttcgttattttataagagttcacattaattaataacaattaattgtattagttttattttatagcaaaatgaaattaaaactaaaaaatttctaaatttcaaaaaataataaagtttaacgttcacgagcagttttttggtgtaaattaagtaagtaaaacacttactaatgaatttgtttaatatcgtttattttttgtactaaaaattgcgttatagttatgtttgtaaaaagctataagtcatgctactatgctaaaagcaatctcggctgtacttttttgcctcttaatactgtgatgaaaccgctaactaatttagattggtggcttttttatatagtatttcgaggtattcgaacgggattcgcaatggataataaaatttggtaaacaaggaggaaaaatttatgaagaaaatcaaagtgatgagcattttcgggactcgtccagaagcgattaaaatggctcccgtagttaaagcgatgacgcacgatgaacggttcgctccgattacggtagttactggacaacaccgagaaatgttggatcaagtcttgcagatttttaaaattaagccagattatgatttgaacattatgcaaaaggaccagactttaagcagcatcactagtaaggtcctcttgggaatggataaaattttgcaggaggatcgtcctgatttgattttggtgcacggagacaccacgaccacattttctgcggggctaagtgctttttatcaccagattccagtaggtcatgtggaagcgggattgagaacttggaataagtactcgccatttcctgaagaattaaaccgccagatgacggacgtgttgacggacctttacttcgcgccaaccacaactagtcgggataatttgctccgagaaaatcaccccgaaaagcaaatttttgttaccggaaatacggcgattgacgctcttaaggacaccgtcagtgaagattaccataacgaaattttagaagaaatcggtgaagatcatcgaattatcttggttaccatgcaccgtcgtgaaaaccaaggggcgccgatgcaacgagttttcaaagcaattcggcaggtagtggatgaaactcccgacgtagaggttattttcccagttcatctgaaccccaaagtacaacagatggcggaggccgaattgggtagtgatccccggattaaattggttgcgccattggatgtccttgattttcataacattgcggctcgcagttatttaatcatgacggactcgggtggtgttcaagaagaagctccttcactaggtaaaccggtcctagtactacgggacacgacggagcggccagaaggggttgcggccggaacgttgaaactagtgggaaccgacccgcaagcagttaagaagcaaatgaacgtcctcttgaatgatccggcaaaatatgcagaaatggcccaagcccaaaatccgtacggcgatggtcacgcagcagctcggattttagatgcaattgccaaaacaattaaatagattttctaggttattaatatttctgtgagtacgcttttaaggtatgtaaatatcacattcttaaaaagctagatgttactaagtgttgggggaaaagatatccatgaagaaggaaataaatattggatatgcaagggtttcgactgtcgaacgccaggttttaggtcttgaacttcaaattagggcattaaaagaggcgggatgtgataaggtattttacgaggaagtcagtggaagcaaggatgaccgcgaccaaatgctaaaagcaattgaaagttctaaaagatacgtggcaaaaaaatttaaagtccgtttttatatttataaattagaccgattgggacggcattcaagtaaagccatccaaatcattgaaaatttaaatagcaacggtattgaagtagttagcattaaggagcagtttgacacttccactccagttggagtgttacaataccagatactggcgtcttttgccgagtttgagctgaacagtattaggcaacggaccaaagaaggcttagcgcaggcaaggttgaatgggaagagattggggcgcccaccccttagcgaggaagttaaggaaaaaatattgaagctatacaaagagactgatttaaccgtgattaaaatagcggaattgtgtagtgtgggtaccacgtctgtatacaatactttgcgggaatcggatgtaaaaaggcggagaagtcgttagatctcgtgtttactttttatcgtatctgtaataacataatggtatcaaattaacgccgtaaattttttgaggtgttttatacataaaatgaacgttttacgtagttcttaaaaaacggtaaaagaccgccatcagaaccattttttagagaaatttctctaaaaaatggttcttttttttatgtttttgattatccgtaaaacgttcgttttgtgttgtacatagcggcgtttataaaaaggatagcaggtggaattttgaataaagtcacgtttaaagaggaacaagtcacgatttatggtgaatatggtgagggcagttcaattggctttgtctttcagaggttcggaataaaccagattttttcattagcggaagtttatatcgtgcctaaaagtttggttgaaattcaagaaagtgatttgacggccgaaaaccaaattatctcaccaatcacggattggatttccccatattggatagttgccaaaaacgatatcgacatccctaacaacggcaataaattaacgggtggtaaccacgggactaacaatggggagggtgatccaaccgctgaatttgtaagattagatgtctttattggtaatacaccaattaaaaatggcctcagcaacatggtcgttgataaacccatcacattagtgacaactaacctagtggaagctagcaatacgcacataagttatccacgaaaaattgtggaagaaaaggtcacgtacgtcgttaagggatctgaaataaaggtaaaggtcgaatttcaagttaaagaacccgcatacattattgaatatagtgggctacagactaacggacaatactacgatcagttttcgattcctaattctgaaatcgagggatggcaaccaattggcacgcaaacttaccggagtggtgctcatgaacaatatggcttaagtagtcaaattatgctgaataaggaaggatcttcagattggctggtggttagcttggatggctataaaaaaatgtccctagctgatggggtagagatgattcaagtcatggaagcccccgtgaacaaaacgtacttccgcttgctatatgacactagtttaatggtcgaggctggcgatgttttctggtttaaaggttcatatagttttactaattcaagcccgtataacgtgtgaggacggtgaacctttatgaacatgaaaatggaagttgcaaatttgagcttgtatagcgtggtaaagcgtctctcggatgttatcggcgctgttttagggatgaccatcttatcgccagtatttctaatcattgccattgctattaaattagaggatccccgcggtccaataatttccactcaagtgcgagtagggaagaatggcaagtatttcaaaatatataagttccgttccatgcgagttaatgctgaggaagagctagcaaagttgaagagccaaaatgacgttaaaggtgccatgtttaagttaaaaaacgatccccgcgttacccgagtgggtcatttcattagaaaacgcagcttggatgaactcccccaactgtacaacgttttaattggggacatgagcctgattggcccgcggcccccgttagtaaacgaagttgcggcatattcaaaacgagatcttcagcgacttcgcgttcgtccgggatgctcgggtttatggcaaattagcgggcgaaacgagttggattttgacgaaatggtggacttggaccttgagtacatccaaaaaagaagcatactttttgatttggaaatcatctggaaaacggtggttcagatgatttttcctaagggggcgtactaagaatgaagcgtgtaaatttatttgggattagcgttgacccactaaccactaaacaaacggtggaattggtgcgggaaaaaatagttaataaggtccctacccaccttttaggaatgaatgcggataaagttaacggcttaggaaaagataagcaatatgatgagatcgttaaaaatgccgatattattaacgctgatggagtttctttgatcatggcggccaagtttttgaataaatcaattcccgagcgggttgcgggcatcgacctcatgcaagatctactggaaatggcagaaaaagatgggttctctgtatattttttaggtgctaaacatgcagtggtaagcactttagtagacaggatgaagggaaaatatccacagttacaaatagtggggtatcgggacggatattttggtaaggatgaatggcaaaatatttcaaacgagctgaaagaagctcatccggatttggtatttatcgggattagttcacccactaaggagtacttaattgattacttcatgaaacaaggcaataacgctattttcatgggagtcggtggaagctttgatgttttgtctggctatattaaaagggctccaaaatgggttagaaaaacaaatatggaatggatgtaccgctttttacaagaacccaaacgcttatttaagcgatacttttttgggaatgtaaaattcttaatttcgatgtttagggagaaatttaagtggcaaaaacaagtttaagaaccgttgctaatgatctagttgacgacgtaattgcaaatacaaatatagtttacaaagaaaaccaaaacgttattagcatggtaccagtaggtcaagttgaaagatatgaccagtttgttggtttggttgcggaatgcttccgaaaagaatttgaaaaaatactaattattgattggaattttggaaaaacgtcgcgtgaggataatttggatgctccaggataccagtgggagtcgattgactatgttaaggcgactgaggtagccgacaacccgaaggagtttaccaaaatactgatcaacagtgagaaaaattccatcacacaatataccgactttgacgtcgttctagttaaatatcgggataacatctttgagcaggcaccatatttattaaaaaaacaaaaacgggccgtagtagcaatccacactaagggaatggctaaaaaaatcatacgaaatattgatgaagagagtaaaaagaatgagctagagtttttagctccagtactttttgattgatgggaaggagttcggaggtatcaaaactacaagaaaaacacttaaagttgtcttagccaaatttttaatcccagtggttatcttaactgcgctaacttgtttggtgggattgaagttttatagcaagttagttcctgaaaattatatggccgaaagccaagttctggtaactcctaaaaggggaaattcagaaactttcaccatgaaatatgcaaatacttatagccagttaatgtcttcaaacagtttcttagaaaaagttaagagtaaatatcacggcaaggagaaaatcactaccgataaattaaaaaatcatttgtcagttagtattggaaaggattctcaagtaattgttattcaagcttctgcatctaatccagaagacagtattaaattagttaatgcgttagctaaagagtcggtaaaatacattcctaagatcttagacacaaataaattgaccttagtttcagtcgccaacaaaacaaatcgggtagtcaaaatcaataaaaaagtgtatctaatctccttatttacaatcttttttgtgctttattacctgctagttattttttacgtaatttttggcaagaaaatctatttcaaggaacagatttccgatattttagaggccaaaacaatttataaggtgaaataatggtcgattcaaaaagcacaatttctttgaataaggtcatcttatttctcctagttatcatgccaatcgtggaaagtttgaatggtcttctgttggggcatcacatttccgatatatatcgtgctgggttgggtttattaattttggtgtacattttttgcacgggtaagtacttgcacaagcaaagctttgaattactattcctattgttactatacattgggttgaccatgtttcaatttattttttttcatggagatattacggcttttaaaagtgatttaaagacaacgactagaataattatcacccccttatactacgcgtatttttacgtagcacttgtccgaaaggatattagaaaagctgaattagtcaaactgttgacaacatatgcaatcttatatgcggtgctaattattacaccaactttgtttcatacagggtatataacatatgattaccaagggacagggttcgtaatggtagggcacggcactggggtcgggagcaaaggcttcttcgttgaaattaattcgctagtgggaattttggttatatttactttttacactggacaacgtgctttggccttttttaaaaagggtaacttaaaaaatggggtgcagttcgtactaatattactaagcttggtcatggcagagattataaccacgacgaaaacgggaatcgtggtaggggtgatttacctaatttattttttgcctcgttcatttttcgttttacggaaagtaattactaaaaaacagcgtcgaatactagccgaactgttgtcggtgctaattgtggtactttcaccatttatttatcaaggattcgctaaagaagttacattatttattcagcggaatcagtacttttttgatttgtttgacggaaatctgctgaaattcattacgagcagccgatcagtttttctcgaaaaaacatttaaatcaatcaatagggcagataactccctctttttacatctttttgggggcggctactacattagattagataagcctttctttggagccggacgccgggtcaccgagatggactggtttgatttgtatttttcttacggtttagttgggatagtagcctacatcacctacttcaaggaaagtttatttaatttacttaatagtaagaaaaatcccgtaaaaataatgctagttgtattcatagtgtatagcttaattgctggacacgtaatctttaacgcaatgaccaccacgattttggcagttgcgttagcatactttactgataataaatttggagaaaatgatgattaaaaagagaattgattggattgattatctaaaagcttttagtgtaattagcgtggtggcgttccacgttatggacggaatgcattacgaagcgcattatagtggttttatttacgttttaatcacaacccttacaaaaggagtcgctctttcagcgttcttcttggcaagcggactatttgctaattcctggcttaaaaaagaaaaaaagtttctattaaaggtgaaagctttgctggtaccgtactttatttggtcaattgtgtatggtttattgaacatcttgggaagttcctatgttaatcatcgggctgatttttcgttcgtatacacaattttagtttctcctaaatggcatttttggtttttgtattatctgttttggtactttgttttctttgcagctattcaaaacttaagacaacgaacgcaaatgctggttatcgggagtggttttattttgggattggtttttccaaacttttggattctaaacaacttttttccatacttcattgctttttacgtgggaacctattttaaagaaataaaagaccaaattcaaagggacagtttgctaaggctcgccctcatggcgcttccgttatatgccgcttatagctactgtttacaaatgaactacgagttggcaacgtcgatattaattccactagcaggaattacttgcgcatttttcttcattaaattatttatgcaggttccacatatgaggtggctacaatatttgggacaaagaacaatgccgatatacctgttgcacgtcttttttacggcgcctacgcgaatagtattgttgaaactcaatattcaaaacgttggtattaacgtgctagtaggaatattggcggggctggtaatgccgctcctggtctacgtggttgctcagaagttaaaaattaacaagatattatttggtagttaactatttatcagatggagaagcaggatgcaaagagacttacgaatagattttttgagggtattagcaattttgctcattatattggcgcatattgatccgtcaaacttggttttccaagctagagcgtttgacgtacccctgatgacgattcttatggggtcaagttattttatatcatctagcagacactcggacgaacgctacggaacctatttgttaaaacgttttaggcgattaattatcccaacttggggttttttaattctatatttcattggtatctggctgtttactttggttacgaaagacggttttccttactcgttttcaaaaatgatggcgtctttcttgatgtcaacaaaccacgggattgggtatacttggattttcttgattttctttgaagtagcaatctttttaccatttttaaaaaagatgtttgaaaaaaagcaaagtaaaaaatttatggtaggtggagtagtgttaattgcgctactaagttggttatatgaccagtatagttccactttctttagcacttccataagcgtagttttggggattgtggcgtacggattattggcgtatttaggcatggtcgccttaaaacagtctaaaaagcaaaatttggtgctagctggtgtgtttcttcttgtttatataatgctgggttacttgcatagcgattttggagtggagaccttcaagtttccgcctgaactgcaatacgtagcctatggagcagggatttcgttgttgcttttcacggttactaccatagtgaataaatattttgaaaaagttaatccgaaatggctaatctggctgtccaaaaattcattaactatttactacgttcacatttttgcgattcgggtagtcaaccgggtaccgtacttaaaccgatggtgggaaactcgttacttatttttggtcggcagtagtttagtgctgacttacatctggattaagtttaaaaacgctagtgctttaaacagattattcaaatagttacttgaattattaaaggagaacctaaattgatattagtagtttcaaatatgtatccttcaaggaatttccctaattatggggttttcgtaaaaaatttcgtgcaagaattatcgcaaactgaagaagtgaaagtggtcgctttaaagaaaaaacaaagtaagtttttaaagggattaggctacctgattttttatctgcgggttttcttcaattacgtttcgggaaagtatagtttagtttacgtacactacgctggatacaacgtgccaccgattcttttaggaaagttcttcaatcggaaggttcctttgatcgttaacgttcatggcagcgacgtcactcctgaaaaaaggttggaagaaaagactaattttttgaccaaaaaaatagttaagaaggcagatctaacggtagtgccctctgcctacttcaaagaagtagttgaaaataagtacgggaagattcctatttttgtttcgccgtcttctggggtaaaccgtaacctctttaagaaacaggaagttgaaaaaagtaccgaccatttctacattggctacgttagccgtattgacgcagaaaagggttgggatatccttttgaaggcttttaaaaaggtaaaagcagagattcccaacgctaaattagttatggtgggtggcggcgcgcaagatgccgatgccgtgcaattaattaatgatctgggaattaaacaagatgtcgaaaaaattcaaatgctcagccaagcggaactagtaaaaatttacaataagctaaacgtattcatttttcctagcacaagggctggagaaagtttagggttggttggattagaggccatggcttgtgggactccggtaattggaagcaattttggtgggattaagacgtatactagagatggttataacggcttgctcttcaaaccgggcagtcaatctgacttagaaaataagattaagaaattttatgctttagatgccgcgcagcaaaaggctatgggagaaaacgccatggcaacggcccaaaagtatgatagtaatttggtaaataaaaaattaattgcagaaattaagaaatttgacgggaactaaaaatgagagcagtctatacagttttatttttaatagtaaataaattgttcgtgccttatcgtctaaagaggttggaaagaaaatttcggaagctaaaaaatgccgttgcaaggcatttgttcgcgtttgtaggggataatgctaatatccggccccacgttcggctttcgtacttaagcaacatttccttgggtaaggaatctagcattggtgatcgtagtatgattgttgcggccgattcagtaattatcggagataacgtaatgatgggacctgaagttgcaatctggacccaaaaccatgagattacggatcgggatacgttactgttaaatggcaaagccgtcaaaaaacgggtaattattgaagacgacgtttggattggtggaagggtgattattttgcctggagcagttatccaaaaaggcagcgtagttgcagcaggttcggtagtggtgggaaaagcctaccctccgtacagtgtgattggcggtaatccggcaaaagttattaaagaaagaacgtaggtgggggtaaccatgtcacaaagaaaaattggtgtatttctgtcctacgtcaacattgtggttaagaatttatcgacggtgctgtatactccctttctaatacgaagcttaggacaaactaattatggtttgtaccaaatgaccacttcgataatgacaatgttatttacgttgcacttggggttttcagcagcatacataaagttttattccaaagaagacgaagacggaattaaacgtttgaatggcatttacatggtgatctttttctcactgggaattttatccatcattctcgggatgatcctccaaaaaaacgtagcattaatttttggacggacctttaatgatgctgaattactaacgatgaaacacctgatgacattgttgattattaatgttagcttaacctttccttcggtagtttttgattgttatatttctgcgaaggaagaatttacctttttaaaatcgcgagaaattttattgaatttagcggtaccgctagttacggtaccatttcttttttttactagtaatacggtaattgtggtagccattcaggtggtgattaccacgatatttttgttgtggaacatctactttgcgtacgttaaattagggatgcgtttctggtttaacaaactaaaattatccctttttaaggcaatttttgtcttctcaggatttattttcattaatgaagctgtcgacatggtcaactggaacctgcctaacgtcgtactcggaattttttcgggtccccgcgacgtttcaatttatggggtggctaaccagattaaaaatgtttttatcagcatttctaccgcaatttcaacaatttacattccccacatttaccaaattaataaggagaaggaaagcactaaaaaactcaatgatttggtggttaagctggggaattatcagtatctagccgtttgctatatttttggtggcttcattgtttttgggacgtacttcatccaattatgggtaggaaaaggatatgaacaagcttacatagtgggtattttattaatcattccattgttgacgccgttaattcaaaacgtaggaatggaaattatcagaatgaaggacttgtataaacgagtatcctacgtttacctaacgttagcattaattaacgtgctcatcagcgtgatctttacccaactatttggcctagtgggagcggtgttaggtacttttattaccatgattttaggaaacggactctacattaatatttactatacgagggtggtaggattggatatgccacgcttttggcggaggattatgagagtttcggtagttccagggggtagcatcctgttgctagaagcagtgatgtattttcatcctattaatagcgtacttacatttttggtctatggaggaatatacactttatcatatctgattttgtttgttcgtgttgatctaactacacaacaaagacaaaggatgtttactttaattattaataaatttaaataaatgaggacctaattaatgaataattgggccctcttttttagttacccgctttaaaacgggattttatagtgatagtttaaaaaatataacttgcatattaattatcaaactgttaattttaaagtgattttatgaacataattggttaaatatgattcgttattagctgtacataggtgttttcgcgcatgtttgtttatcataagggttattaattgacactttctgtggaaatcgctatcataaaaaacaagttaatgagttagttagctttaattaataaaaagtaagggagttgtatactatgaaaaaaggtctgattaccgctgggttagttactagcttggtgtgtacgagtattttggtagaacaaaccgccttcgcggcaagtaaggataatggacaagcaaccgtcactaaacaggttaataagtcagcacataacgatcaaaaagctccacgtgatattggaattgttactaagggagaattaaatatctctggtacaggtgctaacgggttgaagctacaaggtaataatacggttaccacgggtactcttgatttacattacattgggaaatctcttgggatcgggattgacgaacaaaccgaaattgtattctctgtacctaaagaattacaagaagtggttaactcccctaacttcaataattatgtaaccggaatttttaaatttaataacggttcggaacatacttacgatccccacgacattcgggttgaagataatggtgcgaccattagagtgatcaacccaactgaaagttggttcatcggagcaaactttgacgttaagttaaatatcgatttaggtcaattagtaacggatacgggcattagaatccctgatgctgaaaataattcaagctattatttcaacgctggcttaattaaaaagggcgacgtgattgattgggacttaattggtaattacaatgcaggctatactttaccaacccaccaattagatcctggttggacactaattaacgaaaaaccaaccgttgaagacgtttatgatagtgacgaagtagtcactggtaaaggagtgccgggagccaaagtccaggtcaaagttggagacgaggtaattggaactggcacagtagacgaaaatggcatttacgaagtaaaaattcctaaacaatctaagggagtaaccctgacgatctcacaaaataccggggtaggctggagtgatccaatcacgacggtagttaaacataaagaagaaagcattccaaaaccaacggtgaacgaacccgtaactagcagcgacacgcaagttaaggggactggttacgaagctggtaataccattatcgttacggattccaacggtaaggaattaggcaggggtctggtacaatcagacaagtcgtttagcgtagacattccagcacaagacgcgtacacaatcttgcacgtggtggaaacaaatggaactgaaactagcccagctacggaagttaccgtgcacgaaggagaatccaaagatggtaagatcactggtttggataagtactcaattagtaacaatgacggttacattcacggcacctacactgggtcagcagcagcccaagttaacgtagtggttgatggggttaaagggagcaccgtacctttagtacctggcaatggtcaattcaagtactacatcgctaacttggtatcaaccccaggtcaaaatgtaacggtcaacttgttagacgcttctggaaatgtattagactcaaagaatctagaagtggtggcttagaaaatttttatcaagaacgttcttggagaaatccgagagcgttttttattttgagatgtttaaggatttagatgggaaataggtaaaggaaaagcttaaaagatacagtaatttcttgaagtaaaacttagttgtttttaattatacaaaaatagctttacttaatctagatatgcaagtggcacaaatttgaaatacaaacgacctaggtgcgtaaataaaaaattcactttggtgaacgtttttgctataaatgatactttgctgatatatttttattttttatttatttataatagaccatataaaagaatgctgcttacatagaggcaaagcttaatagccctgattaagtacaagttttattagccaagttcataatatggggagaggcttatcaaatttacaaatcgaataagtaagcgcttttataaattggctcttttcacaagaaaggtggagtaaggatgaaaaaaagttatgcagtaatctcagctagtatggcactattactaacattgggaggggaaatccagtcagtaagtagcgtagtacacgcacaagaagtacaacagagtgtaaaaaacgtgcagcgccaggcagactttaatcctcaacaatatgctaatgaggtagacagttttataaaagaccaaacggatccagatattggttccctttttatgaaatttacatctcaagaagtaaaagactatggtaaatatggtcaggagaacaaagaacaaattaagcagatttggggagccggaattttgtttaattttgcgtttcaagggcatagtgttatttatgatgatttaataaaacttctgccaaataatggcagtaatgatgttaatctaggcttcttccctaacactaaatcggaaaagataacaattccaaatcaagagaacggcggtactattcagtcggttgcgtatttcaccccacataaagaaggttccactaacgcaaataaaactgtggtcatgcatggtggatatcgcggaaatgttgataagggctatgatttagatgaagcaggcgtattttataatctcggatacaatattttatatgttgataatcgagcaactagtcaaagtaccggagattatgtaacttttggacagtacgaagcagacgacgtaatcgcttggatcaaccatttaaacgaaaccaaaccgggacaaaaagtggtgctttatggtggttcgatgggcgcggcaactatgatgtcggttcttgctaaagcgcatccagataatataaaggggcttatagaaaactgtggatatgcacacataggtaatcaattaacatattcttatgatgctcttactagagtgctttccaacaatccagatacaaaattcatagcagacctcttgaagaaaaacttctctattaccacagggaacgcaagcgaaatgctaaatacaatggatcaatattacattaaaccgcaggcaaatgtggatataaatggagcactaccgattaaaggagtaggttcttcgttaccgaaattactgatccacgggacgatggataatattgtaccttacgacaacatgaatactttgatggaaaatagtaagggcgatacaactgaaatgcgagcagaaggtgccggacatggtgaagcacagaaaatgtatccagaaagatatgaacgcacggttgataatttcttaaatgacgtagtttttaaaactaagtagaccattttttacaaaaagctttcacctttattttgggggagcttttttatttggaaagtaatggtaattaagtaaaggttggttctgataataattcaatttaatgcagagtttttctcacaaaaaaacggtagcgctttcacaaccggcgtgttaacataaccgtgtaaggaagtcggctaacttttacgtaaatttacgttacataaatttttgacgttgttggaatacgggtttgaatttttaatttaacgtggttgttaagcaaaaatgttcacgcgaacatttttggccagcaactaattacggaggtaaaaaatatggcggacagtgtacattcgagcgcgccagatcatgaagttttactcaacgactccaccaagcgaatccctaaatcacagcaaattgcttatggatttggtgacatggggaatggattcatgtttgaccttgggcaagcttatttaaccaagttttggatcgacgggaccggaattgctgccggagtcgtcggggcaatttttgcgtttactaagatttttgacgcggtgatggatcccatcgtgggtgcggcaattgataaccgtaagcgtggtaagcacggtaaattccggccgatcatgatggggtcggcagtaattttagcaattatgacggtggtcacctttaccatgccaagcgggttaaccatgacgcaaaagatcacctacgctttagtaacgtacatgatttggggcgtcttttactccttaaccaacgacccctatggatcgctagcttcggtaatgagccggaacttggaggaccggagtttcatgtccaccacccggcaaattggttcagtagcggcccaattaattgccggggtggcttttatcccattaatgcaattgactagcggtgggcacccgctacatggctataccatttccgcggccatctttggcgtaatgggggtactgggtttcttagtatgcttcctgggcacgcgcgaaaacctacatatcaaacgcgacgaggatgccaaaaaggaaggcatgaaggactactttaaggtggttttcactaacggaccgttgggcgcgttagttttaatgacgctgtttacgatttcggcaatgaacactaataaccaaatgatggtcttttacgcacagtacaacctgggcaacatcggtttgcaaccggtaattaacttcatcatgatgggcagttcggttgccggggttttcatggttccgtacttaaccaaacatttcgggcaaaagaaaactgccatcgtgagcttatttatcggggcggtggctaacgcaatcaactttttcttgccgacaaatttgtacaccttcatcttgttcgtgacgattggttacgtagcgttagcaatcccgaacggaattacttgggcaatggtttctaacgtcattgattatggtgaatggcataccggcactcgtaaagagggaatcacgtacgccgcgtttaacttctcgcgaaaaattgcccaatcaattgcggcgttagtttcttcgggattgttggcaattaccggttacgtggctaaccacacacaaactggttctgcgctcaacggaatcaagattgcgatgactttatacccggcaatttgtttggcactggctggagtgattttactgttcttgtttaagttggatgacgataagtttaaccggatttctaatgacctggaccatggccgttgggaaaagggcactttgtaatttaagaaagaggtaattggaatggctttagaaaatttactattggatgttaaaaaattgattgaaaatccggacgcggacgttgacgagggaatttaccgtccttcagtacaaattgaccggcgcaacgtttactttatttatcgcgaaggaattaagaagagcctggtagtttacgaagatgcccgcaaagctcgcgatttccaagctgacgagaccttagttgatgacgactacgttttattgaagggcccgctgaacttcttcaataaccaagcgctagcaaaacggtttgcctggattaaaccgtcttcccggcacggtcacaagtacacgcttggcttaggcgaccggcttggaattgcgtctaacgcccatttgaaattgttaaagggtcgcggaattttccccgtactcgcccaacaatcaattcgggaactgttattgagtaaccggaccttcaccgacgtaattgaagcagcatcgtggtcagtttttgaagaaggctaccgtgacggctggggtgcagatggcgaccacgttaaaaatgcgtacgaaattgactacgcggtacgttcgggtgcaacgatgattactttagacctcaccgaaaagacccataccgaatacttagcttattcagatgaagatttggacgcgaagtataacgaattagcccctgaaattcgcgaaaaatttgaaaagaagtacctcaaccaccgctttgaattaggcaacggcgacgtggtcgaatttagcccccgggacttgaaggaagcggtgttggcctttaacgaaggggtcctcttcgcagaatgggtcaacgaaaagtttgttaaaccatacgccttggattttgaagtttcggttgacgagacaccggtttctacaactcctgcacaacactacttctttgccaacgaattggccgatgctggaattactcccgaaaccttggctccccgtttctacggtgaattccaaaaggcgattgactacattggcgaccttgaccggtttgaaaaagactttggcgaacacgaagcgattgccgagaagtttggctacaaacttagcgtacattccggttccgataaactttcggcttatccagtaattgcccgtttggctaaccagcacggttggcacgttaagacggcgggaactaactggcttgaggcgctccgggtggttgctcacgaagatccccaatttatgctggaactttacaagtttagctatgacaaccttgatgacgtaaaagacttctacgtcttcaacgcgcaaactgatggcaaggcacccaagcctgaagacctcaccgaaaaagacgtcaacatgctgctcgtggatgacgacgcacggcaagttttgcacacgatgtacggttcgatcctcgggtacaccgaaaactaccaatatgtataccgggaccgtttgtttgatattttgcttcatcacgctgacgaatacgacaagtacttgagcttgcacatggcggaacacgttgacctattacaaggaatcgaaaccacgaaacaagctgttttagataaatacgaaccccaagactaaatcaataaaggaaggtagcagtcatgaaattacttgataaagactttttgctggaaaacgaaatggcgaagacccttttccacgattacgcagaaaagatgccgattattgattatcactgccatttaagtccccaagcaatttatgaaaataaaaactatcccaatattagtcgcatctggctaaacgaaggcacctacggagaccactacaagtggcgcttaatgcgggccaatggggttagcgaagatttaattaccggcgacggtgacgaataccaaaaatttctggcatgggcggataccattgaacatgcgtatggtaacccactttacgaatggacccacttggaattacgacggttctttggcatcgatgaaccacttaccgttaagtctgctccccaaatttgggagaaggccaaccagttattagcaactgacgattttaaaccccgtaacttgattaaaaattccaacgttaagctagtagcgacaactgacgatccggcttcggatttgcactatcacaaacttttgcaagacgaagaagcggaatccggcttcaagacggttcccgcaatgcggccggataaactaatgcagatcgaaaaacctggatttggcgaatacttgcaaaccctcgcaaaggccgctggggtaaccatcaattccttccaagatttggcgaaggcgttacggcagcgttttgaattctttaaggacatggggagtcgtttatccgaccactcgttgccgtcctaccactttgtggagctatctgaagcagaactagaccagattttaaccaaggcggccgatggagcaacgctgacagaacgcgaacgcgacggttacacaaccgcgttgttagaagttttaatgaaactcaacaacgaatttgactgggtaatgcaattccacatcaattcgttgcgggatgccaacaaaccaatgtacgaaaaattaggtccggataccggttttgactcaatgggaactcaaccagacatcgtcgacggcattcaaaaattaatgaccaagatgtcagcagagggcgtggttcctaagatgattttctactcccttaacccaaacgattggatggaattggcaacgctcatgcaatccttccaaggtcaaaccaaacaacggattcaacttggagcggcctggtggtttaacgacactgccgaagggatggacgaacagctccgggtctttgcccaacaaagtcttttaccaaacttcgtcggaatgttgaccgactcccggagtttcttatcatatccgcggcacgaatacttccggcgggtactgtgcaacttctttggccgcttggtagcgcaagggcgggttcctgacgatgccgagattttgggcaaggtagttcaaaacattgcttacaacaacgcacacgaatactttggtttcttcgattaaatcaatttgaggtgaaaaatagaaatggttaagctatctgataattacattacccaccggaccgagtttgaaaaggccggaattaaggttcccacttacgaccacgatgccgttgcgcaaaaaggggtgacccaaccccgttggattcacttcggaggaggcaaccttttccgggcgtttcacgcggctattgcggatgagttgattgaacaaggggagttagacgctggtttactagtagtcgatacctttagtaaggaagttgttgaaagggtttaccacgataatcacaaccaagtcttgcgggtcgttaccaaagcggatggcacgttggaatctgcagtctttggttcggttgcagacgcagtttttgattctgcagaggcgcctagccaagaattacgcaaagcatttgaaagccagtcgttgcaactagttacgttttcaattactgaaaagggctatgcattaacggatggggaaggtaacttaaccgctagcgtagccaaggacgtcgcggcgggtcctgaaaatccggtagataacattgcccgccttactagtttactttacgaccgcttcaatcacggccagctaccgttggcattactaagtaccgacaacttttcccaaaacggggaccggttgaaaaagtcggtcttaacgattgctaaaggctgggcggcaaatcagttggtcgaagacgaattcttagattatttgcaaaacccggacaaggttagtttcccattatccatgatcgatcggatcaccccgaaccctgccaaagcagtaggggaaagcttagaggcccagggcgtggaaaatatgaccccgtttaaagcctcatacggcgcaatgctagcttcctttgctaacacggaagaagcccattacttggtagtcgaagacgcctttccaaacggccgtccggcactcgaaaaggctggggtaatcgtgacggaccggacgacggttaacgatgtcgatgaaatgaaggttacaacctgcttgaacccgttgcacacggctttagcaatttttggctcgttgctggattatcactcgatttccgaagaaatgaagaatgccgacttggtggacttaattaagcaaattggttacgtggaaggtttaccagtggtgaaggatccgaaggtaattaacccgaaagccttcattgacgaagtggttgaaaagcggctgcctaatccatacattcccgacactccgcaacgtattgcgaccgacacatcgcaaaaaatggcggtgcgctatggcgtaactattcaacactatttggcagatccaacgttgaaggttaccgacttgaaatttatcccgttaacgattgccgcatggctacgttatctattagcgattgatgataaggggcaggcgtttgaacctagcccagatccgttaatggactacctaaaagaacaacttcagggaattcaactaggtgaaaatgcaaaccttcaagcccaaatcaaaccgattttggctaaccagaagctattcggcgtggacctggtagaagctggtttggcagaactaattgaagccgacctagcggaaatgctgcagggaccgggcgcggttgcacaaaccctccatcaaaaattaaatcaagtaaattaaacagaggagaatgagaaatggcaaaatatcggattgcggtcgtcaactcaagtagttttggacaagttttcaaagaacattggcaagccctcgaagagattggggaagttaaacggtttatgctgccgacggatatcgatggtaaatcattggcagaaaagctacagggtttcaacgtggtggtcgctagcgtaaccccgaatttcaatcaggaattctttgataataaggatgaactattgttaatttcacgccatggaattggctataacaacgttgacctagcagcagcgaaggcgcacggcacgaaggtcaccatcgtttcaccgttagtagaaagaaatgccgttgcggaaaacgtgttggcaaacctgatggcgctggtccggcagacggttccggctggggatgcaattaaggccgaccattatgaagaccgggcccgttttatgggtaatcaattctccggcaaaactttcggggtaattggcgccggaaatattggcagccgggtagcggaactatttggaatttttggcgggcccgttttaattaacgaccccgacccgaaggctcccgaaggttggctagaaaacaataacgtgcaaagggtgagcctggatgaacttttggaacgggccgactacatttcgttgaacgcctccttaaacgatgacgattatcacctaattgacgcaaccgctttaaagaaggtcaaaaagggcgtttactttgttaaccacgcgcggggtgcgctgattgacgaaaatgccatgttagccgcggtagaagcgggccaagttggtggttacgcagccgacaccatggaagttgaaccagtgcgggcggatcatccgttcttgaagaacgaacactttttgattacgccgcacacctctgcttacacttacgaatgcttgcacgggatgggtgaaaaatgtgtatccgatgtgcaaaacatcgttaatgaacgcccattggtacgggaattaacggcaaaactttaattgaagggtagtattaatcatgaaatatatcattggaatggatattggaaccaccagtacgaaggcggtactgtttgacctaaagggtcggattgtgcaagttgcccaccaactttatccaatcattcgcgaaaatgtggactccgccgaggaagatccggacgtgatttacgacgcgacggtggccgttttacagcaggttatccaaaccgcccattttgacgccgcgcaagatcagcttttggcaatttcgttaagtgcacagcaacattctatcatgggggttgatgacgaatttaacccggtgactaaactcgcaatttgggcggataaccgggctgaaaagtatgccgaccaagccaaacgggatggttcggggttggcactgtaccaacggacgggcgtgcccacccatcccatggcgccttactacaaattacaatggtataaacatgaagcacccgcgcggtttaaacaagctaagtactggctaggaattaaatcgtacattatttggaaatactttggccaatttttggaagaacaaccgatggcggcggccacgggattatttaacacccgggaaatgcagtgggacgtggcagctttgcaacaactaggattgcaggcctcccaattaccacaagtggtggaagccacgtatcaggtccacggtttaaatccgcaattagcaaaacaaattggaatccctgcggaaactccgtttgtaatgggatcttcggatggcgtggcgaccaccattggggttggcgcggttcggaaggggcaaattgcgattgatattggaacttcggccgcggtacggaccatggtggacgaaccccaatttgatccgaaaggccggatttactgctatccagttttgccaggcaaatggattattggcggaccaattaataatggtggagtagtgcttcgctgggctcgcgaccagtttttcaacgccgaaaaaagtaccgcggagctcctcaaccaagatccgtatgacctgttgactaagattgcgggtgaggcaccggccgggtctaaaggcttactattccatcctttcctaggtggtgaacgagccccgatttggtctggaaatgcgcggggatccttctttggattgacgcagacccatacgcgagcgcacatgttgcgggccattttagaaggaattgtctacaacttgttcacggttaacttagcgttagaagaagttatgccggaaggtgaccgacaaattttggcgaccggtggctttgcgcattcagaattatggaagcatattttggccgacgtatttgaggaaccggtgaaggtccctaagtcggttgaggggggctgcatgggcgcgatggtaatcgcccaaatcagcttaggtttggcaaaggacttgacgaaggtcgaggactttttggtaaaggatgcggtaaatacgtatgaaccaaacccagcaaactttagggcataccgtgacctgatgccaatctatattaggctgtcgagagagttggcaggtgaatacgatagtatagcggagtatcagagaacgcattagagtgctttcatccccgggtagtttccgaggattaacggaatcaagggaattaatcgcgaactttgcgattggttcccttgatttggttaaccggaagaaactggggattaaagcacgtttcgacaaagcagtagtaggaataagagcactgatcgcggatttggcgattagtgctcttatttggttgatcggagagctttgagggctggaacacgtttcggcaaaatagcagtggagcgcaagggaattaatcgcgaactttgcgattggttcccttgatttggttaaccggaagaaacaaaaaatgccgccaaccggccttaaccaggcagcatttttaattttatttacgcaacgattcccggtaaataatcggcattttaaagcattttttaaacgggatgtcgtcgtcgagttcgtcattagttagtaaatgtttcaaagtcgcaatccctaacgcggtcatttcggtgattgggctatgtacggtagttaaggatggcgaagtgtaggtggcaatgtccatgtcatcaaatccggaaacactgaccgaatgttttagattagggtgcgcgttgatcgcgtgaagggccccaattgccatgtcgtcattttcgatgaaaacgtaatccggaaagttaggccgtgccaacagttcttccattgctcggcagccacccttagccgtatattcaccctcgattgggggatgagcgaataacttggttgggtgagctgcgtcccattcttgaattgcggcaaagtaaccctgcgaacgttcctgcgtcgaagcgtaatccagggagccgcgaatcaaggctacattacggtgcccagcttgtagtgcgtgggtggtcatttcgcgggccgctgaataattgtccagccaatagttataaacgggctgaatttgcgttttgcggttgagcaccacgacgggaattttcatttgaactaaattattgatgaactcttcgtcctttacggattgactgaccaccacgacgccgtcgaaaaagctaaggcggtcgtggtcgttaatggaattgattgaaaggacgtaattttcgggtaactgttcacgaatatttaaaataatactggttaaaaagagccccgaagtcccgttttgtaaatcggtaaaaaacaggccgatcgtgtaggtccgtccttggttaagtccgcgcgcgttttggttagggacgtagcctagttggtgagcggcctccacaattttccgtcgggtagtttccttcaccttgggactcccgtttaacgcccgggaaacggtggtgtgcgaaataccaaggtgactggcaatatcaataatcgtggtccgttttgaagaattatttgtcataggatgctccttttaaattactcaagcgtagcagctccaattatacaacaaaaatgagaattaataataattcatgaaaacggttgtacaaaacggggaccgtgctataatttaattgtaaggtttcacgtgaacatttgcaatttaatcaaatattaagtggggtatcgataatggaaatcggattagttggtttgggaaaaatgggcattaatttagcccaaaacatgttgcgtcaccagcataaagtggtcggatttgatttgaataacgcgttagttgaaaaagcggtcggttatggagcaaccggagcggcttcgttagctgaaatggtgcaaaaaatgacggctccccgggtggtttgggtaatggtgccggcgggcaagccgaccgatgtagcaattgcgcagctaggcgacctgctagaggcgggagattacttaatcgacggcggaaacaccttctggaaggatagtttgcggcataaccggctaatttcggaaaaaggaatccattattttgatgccggttcgtcaggcggttggcgcggagcacttaatggcgggaatttcatgattgggggcgatgacgccgcagcctttgaaaccatccgcccattatttgaagatatttcccaagaagatggttatctctacactggtaaggctggttcaggacactatcttaaaatggttcacaacggcattgagtacggaatgatggccgcaattggggaaggttttgaagtattggaagcttcccagtttaattacgacaacgaagcggtcgctaaactgtggaaccacggctcggtagttcggagttggttgattgaacttgctcaggacgctttcagtaaggatccgcacctagctgaaattgcgggacggatgcactctaatggcgagggccaatggacggtggaagaagccatggatcagcacgttcctacaccggttatttacgcggcggttgcggagcgctaccgttcgatgcaagacgatacctttactggtaaggtggtggccgccctccggaatgaatttggcggtcacgcggttgacaaaaagtgaagttttatttacaaatagttagtaattgagaaataatgatcccttggtggtcggattgcctttggcgccggtatcaaggaagtaatgtttaaaattaggaacagtttcaacggggagtgcctggttgaggctgttttttggtaggtggcgaaccgccgaaaaaatagtttacgggatgtatttgatatctcttaaagagtataatttgggtgggtttataacgctgaacatcgcaagatgtggaagggaaggctggataatgcgatacttacgtaagtacgttacgcgtggcgactggatagcattgggatgcaccatcataaccatgtttttgttagtgaaattgattttatgagggctcacgaaggtcgccaatttttaggagcgctggtggtattcgcaattttggatttcatttgcgaacggtggattgataagtcgcccaccaagtaaaaaagggggcggggagtttgtgctattcaaattaaaatcgacagttatgcttgatccaagcataactgccgattttctgttagtacacaccaacaatccaattttttcctatattaatctagcttaatcaagcgattaagaacggcgcaccacggcaatttcaaattctgcggtaatggaatctaacggtcgttggaggagctgctcccgattttcttgcgcctgccaagttaagggcgtcatgttgaacaacgccgtaaaaagtggttggtcaagcgcaaattcatacttaacggtagtgaattctgcctgcggatagcgctcgataaagtggttctttaccggagcattatcataggtagcgtgttgtccatcggggtaaaccaggtggcgcagctcttgcagatagtggttgccgggaatgaccttaaccagtatgccgtctggggctaaggagcggtcaaactcttggtaattagcaggcgacaaaatgttgacgatggcgtctaaacgatggtcggcaaacggcaaatgcgctaagtcacccaccataaagagcggttgattttccagtgccactcctgcgctagcaatgttaatggctggtttggaaatatccaggccgactaagcttcccttcgagtggttggcaagccatttggtggtggtgccttcgccacagccggcatctagaataaggccgccggcaagtgcttcttgaacccgggcgagcatcgggtcgaaaaagcctgccgttaaaaattggtggcgataacgcagcatttcgtcagtgtattcggttttgacggggtgactaaggaaaaagaggcttccttttttcgccacgttaaaagtgtgttgattttcgcaaacgacggtaccggtttccgcggttataaatgctccctggcaaacggggcactgaaattgatttaaatgttgttggataaattgactggttaattcgattttattcaaaatatgacctcgttgttctcgtaattaagttaattctaccacggctttaaggaaggccaatggtattttagaacaactaaaattgaagaaaaattgaattgaacttaaaggttgaattaaaatataattcgcggtaaaatacctcctgtatttaaatattcgaatgtttgaatggaggacgacctgatggtggagcatagcaaggcactcgcagcttttaagaagaatatccccttgctagacgcgctttccgacgagcggcgccagcaaattatgattactttaggggaaagtgaaaaaggcttaacggttggggaattgacgaagattattggtctttcccagcccgcagtatcgcatcatttaaagcaattaaaagatttgaagttagtttcggttagaaaaaagggtactagcaacatctatcaattaacgatcggacaggctctcgatcaagtgcaaaagttggttgatattttgcggaacgataagaagttatttaattaagtcgggatagtctgattgttcattcattggatcgaatattaaaaaattattgttgagaaggggaaaagcatggttcgcaaagagtggaaatttattagaaataataagttaattttaatctccgtgctggcaattattttcattcctttcctatatagtattttcttcttgaaatcggtatgggatccatatggggatacgaaaaatttaccagtcgcagtcgttaacttagatcaacccgttaagtaccaaggccaacgacttgcggtcggtgatgaaatggtcgataacttaaagcacaaccatcaattgggatggcactttgtatcggctaaaaaggctaaagaaggaatgaaggataagaagtactacacggtagttacgatcccgaaggacttctcagctaacgccgcaacggttacggataaaaatcctaagaagatgcaactgaagtattcaacgaacgcttcgttgaactacattggtaaagttatcagtgacgtgggtactgaaaagcttaattccgaagtgcgggaacaagttacgaagtcctatgctacggcaatgtttgaccaagttaagactgccggaaaaggtttcaagcaagcttctgacggagctaagaaacttaaggatggtgcggtgcaattaaatgacggtaccaagacctacacggcaggagtttcccaactacacgacgggattgctacaatggccgtttcagttaaaccattgcaagcgggcgttgctcaattagcagatggttctagccaattgaccaatggtttagatcaattgaatggaaaaactggggcattgtcttcaggagtttcccaattggcaaatggttctggacaagtaaccaccggtgcggttgccttgagtaagggattgaacgagttacaacaaaagagcggtgcgctcgttaccggagtttcacaactaaacaacggtgctttacagttgaaggttaaggttccccaatacgtcaacggggtttaccaacttaacgatggtgtacaagaacttaacgcaaaaactggtcaattagttggcggcatcaagcaattgtcaagtggtgcgggtgctttaagtgctggagttaagcaatatacagacggtgtatcggctggtgcaggccaattacaaggtggcgtagctaaattagctaacgatactaaggatatgccaaatagcatcaacgctttgcacaacggaattgcagacattgcgaagagttccaaacaattagctgatgctaacggcaagatctcaactgggcttggccaagttgctgatcaagtaagtgcaaaggacattagtaaacaagcggctgctttgaagcaacaaatggcttctattcaaacacaattagttgcgttgaataaggcaactgctggacaaacaaatggtggcaatgccgcacaatccatcaataatcaactttcagaaattaagtctgaagtaggaagcttggcaaactcaagtaaaactacgacaagcactagcggtggcgtttctcaagcaaccattaattctaaaattgacggtgcaggattaagtgcagaagatgcagctaaagcgaagaatgccttagctggcgttgctaacggtagccaaaataagactacttcgcaaactgtagatacaaataagattgcatcaattcaaaagaagattactgacgttcaaggtcaagtaacgaagttgaatgatttagctaacaaacaagctgaaatcaataagcaagtgacgtcgttaacagcttccttccagaagttggcagctggcgcaaacgaattaactggcaacagtgatgacatgaaacaactggcagcaactttgaagaaattagctgctggttcacaagaagtcacaactaacttacaagctctttcatccggttcaaacacggtagctggtaaggtcggcgaatttgccggttcagcttctgatttgactaagggagttgctcaattagacagtggtgctaagagccttgcaagtcaaactaacaagaattcgaaggacgttaagaagttagttagcggttctcaagaattgagctcaagcttggcaatgctagacaagcaaactccaactctccaatccaagattggtcagttagctgctggtagcaaccaaatcagtgctggtacaggtgctttagctggtggaattaaccaattaagcaacggtattagcgccgcaagttcacaaatgccaaccttagtaagcggcgttagcctacttgctaacggtggtaaccaattggcagccggttcttctcaagttactggcggtttgaacaccttaaatggtcaagtaccagcgttagtttctggcgttgcgcaacttgataatggtggtcaccaattgaacactggtatccaaactcttaacagcagtaccggaacgttgatcgacggtgttaaccagttgaacactggagctgctgaactagacgctaactcaggtgccttgttagacgctactaagcaaattagcgccggcaatggcgaattatcaagcaagttagctgatggtgcaaaacaagttaacagcgtgccgcttaccaacaagacggccgaaatgtttgcggcaccaacgaagatgaaacacactaactacagttacgtaccaaactacggacatgcgttagcaccatacgtactttcactagcactttacgttggggcaatcgtcttcaactttgcttacccaattcggaaggtttccgaacgcggtggtactccaacccaatggttcttgagtaaggtttccgttggtacggtagtcgctctaggaatggcgttggttgaaaccacaatcatgatgattgctggtattcacgtagatcacgttggtcaattctacatgaccgcgattatgatttcgttagcgtcgatgtacatcgtcatgttcttgtcgatggccttcgacaacccaggacggtttgtagcgatgattctcctgatgcttcaattaggtggatcaggtggtaccttcccaatggaagtaactaaccacttctacaacgtaattcatccgttcttgccattgacttactcaatcttatcgttccgtcaggcaattacgtctggtctcggcgacggtacctttgaacaagcaatgggcgcgttgctcttgtttgcagtgattgctttggcattgctatggttcagtatgaaccaattgcaaaagcatcatttggaaaacaagtcgcaattagatgacaaccaaaagcttcaagaagttgaaagataatttaatcgcagagaggggtcgggattttccgacccctttttgtatacatagcaccaatttaaagagtattttaggcgtggtctcccacgaaaggctagcttcctgtataataaatggaaatgaggtgattagatgaaacacatgaaaaagggctcccgttggccggccaatccggttgtgtgggtcattgtggcactattggtcattttaggcggatataaatttttctatcctaaccacgtggaacctgaacacaccacggcacggcaatctagcagcactaaggtgattgacgttgaagaaggctcgtcgtccgctaaaaaggcaacgacaaaaaaacataaacataaatcaagcaaagataagctttggacaaagaaacaggatgcaaaattggcggcgttcattagtgattggcaacagacgatggggcaatcgtataccggaactaattcaggtagctcggtaaccttccaaggcgtcacgcttcccgattatttgtcaacggggacggtttacgtaaaccaacaaccagtgacgatgaaatggacgaccaataaaaaagacgacagcgattatcaagtggtcgcagcttatgccggcacccaatacttgtacttgtttactttccaccaacaaactccagaagtgttagttacctctcaagcagctagcgacggagttaactttaaggtaacggaaaatgcgcaattagttagcggttttcaaaacattgttaatggacaaagtgaatcaacggattcatcgcaacaataaaatattaaaaatgggagctttcagaattctgatctgaaagctcccatttttggttctaaacaaaaatttgctacaaaggcaaagttgcgtggtcctaaaacttattagtgttctaattttatatccgccgacactacgctgttttggtacggaaaatgtgattcggagtattcaaaaggggtgccgtcaactaaatagttgacctgactaattactaaaatggggtcccccttcttttctcctaaaaaatgaacgtcttcatccgaaactttacgagccatgatttggcgatgggatccggcaaactctaaatggtgctctttttgtaaatattcgtaaaccgatttttgaagaatttccttagtgatggtcgcaattttagttggcataatcgtttgttcgtagctgaacggtttgccatcaatcaatcgggttcgcttaattacgtagacggtctccccgtcttccagcagtaaatgttcctgctcatccttggtagcgatccgggcggttaaatgaatgtgtttgctagtgacctttttattagggtgggtcatggtcgttcccaacggcttgtcaacgtctgtattgaaatcattgttaaattgcacgtcttttcgaacgaacgtccccgccccgcgtttactataaactagtccttcaatgattaaaatctgaattgctttgctaatcgtgatgcgggtggtgttaaattcttttgccaattgattttggtctggcaacatgactcccggctgcaattcgtggttcataatttttttgcgcaaagtttgcgaaattttctcatatttatacatttatctgacaccatccttaatcaccgttaattttagaccatcttaatggtattcacaaattgataaaagtatatacttttataataaaagaatttacttttataaaaatggtgattataatgaaagcggatacaaaagaaaggtggtcataattgtgcaagcaaagttacccgatgattttttatggggaaattcaacatccagtatgcagacggaaggaggtgcacacgagggcggtaaggggccgtccgtttacgacacgtataaagcaaccgcagaaacttcggattgggacgtggcaattgataattaccatcattatgaagaagatttggatttgatggctcagcaggggatgaactgctatcgttttcagatttcttggagccgggtaaatccgcaaggcgacggagaattcaatgaagaggggattcgctattatgataatttaatcaacgcgttgttaaaacggggcattcagccgatgatctgtctgtatcattttgacatgccgttgcacttggcaaaacaatataacggctttttgagtcgccacgtggtgaatgcttttgttcgctttggtaaggaaatggttgaccggttcagcgaccgggttaagttatggattacgtttaatgagcagaacctatattcacaaacggaggcctttcggattgctggttatttaaatggcgaccgcaccgatgaagaattgcaaaggattgcgcatcacgtaatgacggctcatgttcaggttgcaaattacctgcacgaacacagtgatgctaaaattggcggaatgctggcgtttgtggagacttacccaaacagcagtttgccggaagacgtctttgctgcgcggcaaattgatgaatatttgaatcgcaatttattggacgtttgggttaacggccactattcaacggaagtatccacctatattgaacggcaccatttcgatattgattttacggatcaagatcggcaagaattcgccaaattaaagagcgacttcattgccttcagctactacgcaagtaacgtggtagatgcgaccaagattccagcaggcactatgcccaaccggtacttagattacggcgcggtagcaaatccccatctcacagcaacggaatggggctggaatatcgacccgctaggcttccgcgacgttttgacgaagacttataacgcctacgggattccgatgtttccgattgaaaatggaatcgggcatcgggaagaatttcatggacaaatgattcaagacgattaccgaattgcctaccaccgtgatcatttacgagcgctaatggcggcggtaaatgacgatggagtagcggtgctaggttatctgggatggggactgatcgacattccaagttcagcaggcaatatggaaaaacgttacggaatggtttacgttaaccggggcaatcacgagctccgcgaccttaaacgcgtgcctaaaaagagttactactggtttgcaaaagttatcaagtctaatggtgctgatttagattagaaatttttaacgggagggatttttatgggcgattcgaaaagcggatcaatcaatgatcgaatgcagaattcaaagttcattgccaaatttacggaaatttcggtaaaggtcggcaattgggtttacttacggtccttgcgggatgctttcgcagttattctgccaatgtttatcgtggccggcatcggagttttgctaaacaacgtagtgtttacttggtttttgaagggagacctgctagcgaagttccaagttgtcggtaacgcgattgttaacggaactttaaacgtagctggaattttagttgccccgatgattggctatatgctggctaaaaataaaggtttcaataatccaattgctgcggcagccatgtcgttagccagcatttttatcctaatgccgaacagcattcaactggggacggtagcgtcgggcggtgcgaaaatggcaaccgttaccggtggattgagttacttaaataccgggacccaaggaatgtttggcggaattttcgttggtttaattgcgacgggaattttcattaagctagcgtcagttaaacggcttcagattcatttaggcgaaaacgtgcccccagcagtagcggcgtcattcagtgttttacttccagcaattttattgatgtcattttttgcaattatcgctgcactgctagctggatttttcaatgctgacctaattaatttaattaaaacttggattcaagaaccattgcagggctttaacaccagcattgtcggatattgtgtaatctacaccttagctaacttcctgtttggtttaggaattcaccaaaccgttctctcaggaaccttattggatccgttggtgttggttaatatgaacgaaaacatgacggcttatgcgcatcatcaagagattcccaacatcatcaccacttcttttgttagcaactatactttagtcggtggttcgggaagcaccattgcattgattattgcaattctaattttcagtaaagtgaaatcatcacggcaaattgccggattgtcgttggcacccgggatttttaacatcaacgaaccgatgatctttggatttccaatcgttttcaaccttccaatgatcgttccgttcgtgttgttccccaccattggtagtttgattggatactttgcaaccttgtggggttgggtaagccggacggtcgtgttagttccttggactactccaccgttaatcggtccttatttatcgactgccggagattggcgttcggttatcctgcaattaattgtgattattattggcgttttcttatacctaccattcttgaaaatcagtgaacaagtggcaagaattcaagcagaagaaaaccgcgattaagaccttcgacctaggattgagttagcgaatcctaggtcttttttatcgtaatagtgtatataccaatctatatttgtacaccataaaaagttgaaatcatggaacaaaccttgctatttaaacactttaattctgaaaaatcgtccacaaaatagcaaatgtgtgttattatggggttgtaacagaaaccgcttacaaagccgatacgagggggtttacattgtgcgctatgtcacatatttggggacagatgcttacacgaatatcgcaactgatacatggatcttgaataaccttcatgcagatgaaccaatattcgcgctttggcaaaataataatgctgtcattgtaggaaaaaaccaaaatacatttggtgaagttaaccaagaatttatcgatcaacatcaaattgaagttgttcggcgagttactggaggtggggcagtttatcacgatttaggtaatctaaactttacattatttgtaccactggattcatcagctaatacggactttaagcaattttctgagccagttttgaaggcgttacataacttgggaattccagcagaagctacgggacgcaacgacttagtagttaatggcaagaagatttcaggcgtggcccagcgttacgcaaagggctacttaatgcaccacggaacgttactattcgatagcaacgttgacacgatggtgcgggcactgaacgtggcggatgaaaaatttatttcgaaagctgctaagtcagtacgcagccgtgtcggaatgattaaggaagccgcaccagaagggttgactttgcaagacttctgggaagccgtgcaatacgagctgaccgatcacggacgcgattccgagattctgttgactcctgagcaaaaacaagaaattattcggttgactgcagatcaattctcaacttgggactggaactatggtcaatcgccgaactttaattttaagaatcacgcgaagtacgatggcgggatcattgaagtccaggttcaagttgagggtggtgtcattcaagatattaactttaccggagatttcttgatgctgcgtgactggcgggacatcaaagatcagttcattggtttgccgtttgaagcggatcaaatcagaccggtctttgagaaaaaccaggatcagcagtactttggtaccatcagcgtcgatgaattaacacaattatttgaagcctaggaggggtagttatggctataaaagatgacaataaaaagattttagatttcgaccttcaaatggaagatcaagaccaaagctttccaatgctccaagtcttgaacaacgatggcgaaatcgtagatgaagacgcccttaagagagcgggattaagtgatgaccaaatggttgaactcatgaagcaaatggtattcagccggatcttgcacgaacgttcatcaaaattatccaaacaaggacggttaggtttctatgcaccaaccattggtgaagaagcttcccaaatcgcttcaaactatgcctttgaaaagggtgactggttattccctggttaccgtgacattccacaactgattatgaagggctggccaatttataaagcattcttgtggtctcgtggtcatttcgaaggtaacgaattcgaagacgttaacggatggttcccacaaatcattattggtgcccaatatgttgaagcagccggcgcagctttaggtttgaagaaacgtaataaaccaaacgttgcttatgcatatactggtgatggtggtacttcacaaggtgacttctatgaaggcatgaactttgccggcgcttaccacgctccagcagttttcttcgcacaaaataatggatacgcaatctccaccccacgtagcgtacaaactaaagcaccacaccttgcagctaaaggctgggcagctggtttgccaagtttcgtagttgatggaatggacccaattgcgatgtaccttgcagctaaagaagctcgtaagtgggctgtagatggcaatggaccagtcttcattgaaaccatcactaaccgtttaggaccgcactcaatgtcaggtgatgatccactccgttaccggactcaagaagacattgataactggactaagcgtgaaccattgattcgtttccgtaagtaccttactgatcgtgacttatggtcagaagacattgaaaacgactgggcagacattgttaactcacaaattgatgacgcagtaaaacaagctgatggcattgctaagcaaaagatctcagacttcattgaacaaaccttagaagttccgggacaagcagcgcaagatcagatcaacaaatttagaggggagggcaagtaatcatggctaaaaaaacatatatccaagcgattacagaagctcaagacttggcgcttgctaatgatgaaaacgttataatttttggtgaagatgttggtaaaaatggtggtgtatttagagctaccgatggtcttcaagaaaagtacggtgaagatcgagtattcaacactccattagcagaaagtggaattggtggtttagcaattggattgaccacccaagattaccgtcccatcatggaaatccaattcttcgggttcgtttacgaagtaatggactccattgctggacaaatggctcggggacggttccgtttccacggcactcgtaaattcccaatcgtagttcgctcgccatacggtggaggaactaagacccctgaaatgcatgcggattctctagaaggattaatggcacagactcctggattacgagtagttatgccggcaaccccagcagatgcgaagggattattgctttcttcaattgaaagtgacgatccggtaatcttcctcgaaaacttacgtttgtaccgttcaattcgtggcgaagttccagaaggttactacaccacccctctcgataaagcaaacgtagtacgtgaaggtaaagacgttaccgttgttacctatggcggcatggtacacaccagtctagcggctgcagaagaccttgctaaagaaggcattgacgttgaagtaatcgacctacggaccgtaagcccactcgaccttgacacaattggcaagagtatcgaaaagactggtcgggtggtagttgctcaagaagcacaacgtcaagctggtattggagcaatggtaatgagtgaaattagtgaacgtttcattatgagtttagatgctccaattggtcgggtagccgctccggattcagtttacccatttgcgttagctgaaaacgaatggttaccaaaagaagacgatgtaattgataagatcaaggaggtcgtaaactttgactgaaatatttaaaatgccagacatcggcgaaggtatggcagaaggcgaaattgccaactggttggtaaaagtaggcgatgatgtcaaagccgacgacgcggtggctgaagttcaaaatgataaattattgcaagaaatcctttcaccatattccggaaaggttactaaactatttgtagatgcgggaaccgtagttaaggttggcgaaccgctcatcgaatttgatggcgatggaactggcggtggtgacgacagcaaggataatgctgccgaagctgctccagcagctgacaagggcagcgacaatgcccctagcggtgatgcagaaatcttcaacatgcccgacattggtgaaggtatggcagaaggcgaaattgcgaactggttagttaaagttggcgacgaagttaaggaagacgatccagttgccgaagtacaaaacgacaagttaatgcaagaaatcctttcaccatattctggaaaggttactaagttattcgttgacgcgggaaccgtggttaaggttggcgaaccgctcatcgaatttaacggtgacggtagcggtgctggtagtggaaacgctgctccagcagcaagtgcagctcctgctaaggaaaatgccgcaccagctaataatgatgaacctactaaagttggaacggcagtggcttctaatggccaagttttggcaatgccttcggttcgtgaatatgcacggaaacacgacattgacttaatgcaagttcctgcaacgggtcgtcatggtcacattaccatggcagacgtgaagaactttagtggcggtgctgccccagctgctccaaaggctgctgaaaatgccgcaccagctcctagtgctgctccagccgcagaagctccaaaaccagctcctgcaaaaccagccccagttaaggctggtcgagtaccactttcaccaatccgtaaggcaatttcacggaacttaacccaacgtgttcaaactgttccacatgtaacgattatggacgaagttgaagtatccaaattaatggaactccgtgatcaattcaaggaacaaactaaggcgaagggttacaagctaacttacatgccatttgttgccaaagcattggcggcagcagcacgtaagtacccagaattgagtgcaacaattgatgacgaaacccaagaaatcgtctactacgaagaaactaacgtgggctttgctgtagatactgatcaaggactttttgtaccaaacgttaagaacactgcttcgaagtcaattatgcaagttgctcaagaaattgatgacttggcaatccggggccgggatggcaaattgaagcctgctgaattacaaggcggaaccgttacaatttctaacattggttctgaaagcggcagcggcttctttaccccaatcactaacccaggtgaaagctcaattcttggaattggccgcattcgcaagaccccaattgttaacgaagatggtgaattagcagttggtaataccttgaaactatcacttagcttcgaccaccgtttaatcgacggtgctctagcacaaaaaattatgaacgagctgaaggcactcttaggtaaccctgcctacatgcttatggaggtgtagtcatggttgttggcacacaagcaatcgatgttgatacgttaattattggttcaggccctggtggctacgttgccgcaattcgggcagctgaattaggccaaaaagtagtcattgtggaacgcgactttattggcggaatttgcttaaacgtgggttgtatcccatcaaaagctttgattcaagcaggacatttatacgcaactttgcaacacggcaatccgttcggggttaccgtgggtgaatccaagctcgattttgcaaaaactcaagactggaaacaacaccaagtagttgaaaaactaactggtggagttgaaatgttgttaaagaagcacaaggtagaaattgtgcgtggggaagcgtacttcaacgataacgaaacggttaacgtaattgacggagacgattcgcacatctatcgcttcaagaaagccttgattgcaactggctcacgcccagtagaaattccacactttaagtttagtggtcgggttattgattcgacaggtgcattaaacttgaagagcgttcccgaacatctcatcatcattggtggtggggtaatcggtgcagaattagctggcgcttacatgaacctcggttctaagatcaccattattgaaggtcttgaccacattttgaatggtttcgatggcgagttgattcaaccagttttgaacaacttcaagaagaacggcgtagacattatcacggaagcgactgcagtggaagctaaccaaactgataaagacgttaccgttacttacgaagttgacggaactactaaaaaagttaccggagattactgcctggtatcagttggacgccgaccaaataccgaccaaatcggcttgaataatacggacgttaagctggacaaacgtggtttgattgaagttagcgactctatgcaaacttcagtaaaacacatttacgcaattggagacgtagttgcggggcctgcgttggcgcataaagctagctatgaagcaaaagttgctgcagcagcaatgagcggtgaagacgcacacgacaagcattacgtgattcctgcagttgcgtacactaatatcgaagtagcgacggttggggaaaccccacaaacggttgcggaaaagaaactggatgctaaatctagcaagttcccatttgccgcaagtggtcgggcaatgacgatggaccagacggaaggtttcattcgtttagttactgacaaccctactggtgcgattattggtgcccaaattgttggtccagaagcatcagacttgatttctgaattaaccttagcgattgaaaatggaatcaccattcgagatatcgaattgacgattcacccacatccaacccttggtgaagaaatcatggatgctgctgaagtggctgctggtttgccaattcacatttagttaagctaaaaatgtcctaaggggacaaataccaatctgattaaaccgtttctcagagcccaaagtagggcgaagggggacggttttttaatggttagcgagggagaacaatttgtttacttttaaaccaaataagcatatattctacgtaaaaagaggaggctgaactttatgagtgaaaaaatgtgggcaatcggctttaaagaatcgttaccaattgaggaagcggatagtttggtagagtttaccactgaccgtcctgaaccaagcgggcacgatttattggttaaggtgagcgccgtttcggtaaaccctatcgatatagcagtacgaaaggggcaatccgaaccgttgcaagaaccgcgggtattaggttttgatgcggttggtacggtggtatccaaaggtgaggaagtcactttgtttgaaaatggcgaccgagttttttatgctggttcgtttaaacgagcgggtagtgacagcgagtatcaattggtcgatgaacgaattgtcgggcacgctccccaacaaatggatgatgtccatgcagcagccatgccgcttacgtccctgacggcgtgggaagcgttgtttgaacaacttcagattgatccagaggacctaaagaaaaatgcgggaaaaaccctcttgatcattaatggcgcgggcggtgtaggttcagtggcaacgcagcttgcacatttggcaggtttacgcgtgattgcttcggcatcgcgtccagaaacgattcagtggtgtttggatcacggtgcggatcaaacggttaaccatcgcaaagatttagttacggaagttcgtaatttaggggttcagcacgtggattacattttggaattgcataacattgacgcacagtgggaagcaatggtggaattgattaagccaggtggccgaatcgcttcgattacttcaacgaaaaagccggtaaacttaaccgatttaaagaggaaaagcgtaactttcgcgtgggaatggatgtttgcgaaatcttattatggaacggaagacctcgtgtcccagcacgaaaatctagaaaagattgctaaattgttgaatgaaggaaaattaaagtcaacgatgacaaaggaactccacccaatgaacgtagaaaacataaagaaggcccaccaattggtagaaagccaaaaaatgatgggtaaggtggtagttaagtagagagcggaagccgccgggtaatttttgaggattaattggatttgggccttaatcgcggtttaagcgattgaggcccaaatttgattaaccggagaagattggcggctggagctcgtttggtctatgctgcagagaattgtaagataatcgtgttttttgcgattgatgccttaatttggttagccggagggagttgggttacagaacccgtttcgactacgttagctttgcccttccccaacaatctaacaacaaaaaaacgaaggatcctgaactgaggacacttcgttttttattacctaaattttttaattaactacgtttattaagtgaaagatcaatactttttcctagagcgtacatcacaaaggccccaatgaacattaccccaaattcacctaaactaaccgttccccaagtgtagaaaaagggaacttttaaaatataggtgagttctaaggcaaccaagaagcccattaaaatggtcgtaatgataacggtaagagccaacttaacccggttgtcagttaattttcggatggcgatgattacaacgctcagggtgatgagggtggttaaagttccccacgtaatgtcaataatccctagagaagattgtaggttagcaattaatactcccaaagaaactccccaaatataacggcgatcataaaccaccaaacaatttaaaatctcagcaacccgaaattgaagcgggccgaaactaactgctgaaaaaacaaaggtaatggcgacgtatagagcagctacaattgctgatattacaatctcacggacgttcattttagttgacataaatattctcctttataacttaattagttactaaatgacgatgaccaaaggaacccggagtacggggaagtgccatcggtggaaaaatttccaacgtttctatcatatcagtttcccaggcatttctaaaggttaggtattaggtaaccattcgttaaaatagttgatttaatgatcaagaaagcctttacatttacttgaaaatgaatcatgctaatagtggaggaaaccaaaagaaagggtgtaaattagatgattaaattgaagaaccgttacttaacggtcgaaattgataacatgggtgcgcagctgacgcacgtgattgaccaaccgagtggatacgactacatttggaatggtcaagcttggcaacgtcatgccccgattctgtttccagcaattggtaagtctaaccaagatagttatgcattggaaggacaaatctattcaatgccgcaacatggctttgcccgggattttgattggcaaaaggtttcgcaaagtgaaacgacagcaaaattagaattgaaggccaatgaacaaacaaaacgaatgtttccgtttgattttacgcttcaagtagaatacgagttaaaggatcaccagctgttaactacttactacgttattaatcatgacgaacggcggatgccttacgctttaggcgcacatcccgcatttaacgttccaatagataacgacggtatttttgaaaactaccatttaacttttagtccgcaccaaaaacaaattcagcgtttaggggttaacccagtaccattccgtgatggaaagaaagctccttgggaagccattaaaaacagcgaattagctttaaatcatgaaatgtttaacgatggtttaattattttagatgcgaagaaaattgatagcgtcgttttaggttcaacacaaactgcgcatgaagttaaattgaacttcaaagacttcccataccttaccttatggacaatggagaaccgtgcggagccatttttatgcattgaaccgtttgcgggcttgccagatcaagctgctgaagagcctaccgactggaagaataaaaagggtaacaatctcctagaaccgcaggaaacccagacattcacgtattcaattgaatttaaataacaaggaggggcgcggcaatggtaacaacgccagcgccctttaccttgctaaaaaatagttaagtgaggattttacatgcaggattatcagttacaagtagatcaaatattttctgataatatgattctgccctttggcaaaccatttcaaattagtggattagctactgcaggagcgacggttaaaaccaccatcggtactcaagttgcgcgggcaattgttagaaaagatggcacgtgggattgtcaattccgaccttttaccgattatcgaacttcatttgaagttaaaattgaagttcaaaatcatcaattgaagttagaaaacgttcggtttggtcaagttttgttgattgccggacaatctaacgtaggctttcgcatgtcgcaagaccaaaattttacggaagcccaaacgtcaattcccgcaacccccatcacctattacaacgtccctcaaccggcttttgtttacgaagatggggaggttaaggaatatcaatcccgtgccacccattggcaccaagtaaagaaatctaacctgggacacgtttcggcggtgggttattacgctgcccaagaaatggcccgacaagacccgaaaatgccggtagggatcgtttgttgtaccagggacggtgcttcagcaggaacctgggtgtcggaaacatctttacgcaaagacaagctactggcaaagcgggtggtggagcctttcttaagccacattgaaaagattacggatgcgggctttaaggcagacatcgaacgttatcaccaaaacgttaaacggcataatcgattaatgtataactttatgaaaagcaatccggaggttccgattggcgaagcgctgaacattgtggggcagacgccctggccgccgccaaagacgccggacagctatttgcgacccggggcgctgtttaacgcaatggtaagaaagattcggcatttccggttcagccagctggtctggtaccaaggcgaaactgatgcagatcaacctgaaatttacgatcgactcttgcagaccttaattaacgattggcgggcaactttggcggacgtttctttaccggtatacgtagtgcaactgccaaaatatgcggacgtaaaccgtcacgcgtgggcaaaaatccgccagcagcaacttaaagtggcgcaaagccttaccgatacttacttgatttcaattgcggatacgggggagtattacaatccccatcccacggctaaaatggcggcgggccaacgaataggtcgtatcttagcgggaaaggactatcaagcaactccgcaactaggctggctgagcttagaagcggaacaaatctgttttcacttttggtatgttaaggagttacatgccacccagccacctttaatcgaagggtatgttcagcaaaaatggcaggcggtcccggcagaaattaaaggaactaacctgagagttcattttccactaggaactacccaagctcgctacgggtatagtaatgtaccgactttgacactgtttaatgaaattggtgacccagtcagcccgtttgtcgtagacttaactacgcaagagctgatttaatatttcaaaataaattgattaaaaaatgcttctcaaggaattaagaaattcttgagaagcatttttagttcgattagcggtccgaaaaatgggcttgcgcatacttaatctgaaaaacgatagtcgacatcctgaccgttatattccacggtcaagtcgtgattgtcgacaatccattcgtttcccgattcaatataaaaggtgatgtcatctacgacgatcttggcggttgattcatcgtctttatttccgggtgcaatccctaagaaaaagcttggataaaccgttgggattcccccgtaaattttggtgaatatcttgactgcgccacctggttttaaatccaattccttgataaaccactgggctgcctcactagttacggaaaatttcatgttgatttgctccccttcttaattgttgattatgcacgtcttaggttcaaaacatataaaacccttccaatactaatcctatcataaagaaatcgtttacaaaaagtaattacggatttttttgggtcaaaataaactcctaaatttaaaaatcatcgcgcgactgagcgaatatatgttaaatgcacctaatttaatttacttttaggatgaattttgttgtcttttaaataaaaaattgatggtaaaacgttttaaaaccgctttttttgatttagaggacagaagccgtaatatcgggctaatttcgctaaatcgtggactataccaaagctcttccccgcataaaatgccttgatatcaaggtttacccgggttggataaggtttgacatactggtaccaaccagtcataatatgaattggagctgaggaattcagccatttattttactgaattttgtaagcggatacagcaagcggttacaaaattcgaggatgtggaggaacgttttatgagattactgttgatgagtcacggaaatatggcgatcgaaacgctgaaaagcgcagaaatgattttaggccatattgataacatgaaggcgattggtttacaacctaaccaaggtccggaagatttacaaaaagctgccgaagagtttatcaatgacaaccctaatcaggacaagaccatggttgcggttgatttgctcggcggaactccatcaaacgtcgtggtacgcttgatggctaagtacccagatttagaagtggttagcgggttaaatctaccaatggtgattggatttgcaaaccaagtaatgatgggaatggatgttgacaaacaatcattgattagtgaggcacagaacggcgttgttgacgtaaatgctaaattgaatggataaagctaatggcaaaaacataccaatattcattaagatttgcgattgatccctacaattgggacaccgtaaaagaagcgaagttaattgatttttgtaaacaggggcaaattgataacgtggtatttttcattaaccctgaagaacttaaccaaggacatccaacgctcgcccaagtgcgggaacattggttgccaacgattaagtcagttgcggaacgtttggcgaaaatgggcatcacgaccagtctaaatccttggacgactttgatgcacagtgatcggggtcaccgcgtccccccagagctcggctttgatacgatggtcgactacttggggcacgcctcagcttcgattgcgtgtccgcaagatgatcgttgggtgaattacatcaccgcgatctatgcggagtatgcgaagctaaagcctaaagagttgtggctagaagatgattttcgtcattacaaccacacgccaattaagttagcgtgtttttgtgaccgacacatggcgctttacagcgagatgttggaaaagcccattagtcgagaagcttttgtcgcaaaaatgttgcaacctggcgaacccactcctgaacgaattgtttatcttagcgtagcgcgtgctgaaatgaaacgggtggctgccaaaatcgcggcggcagttcaccaagtttctccagctactcgtcttggtttgatgagctcgtttccggaatggcacgccgtggaaggacgagattgggacggtttattagacaaccttgctgatggacatcctcgagtaagtcgtccgcatttgccagcatataatgaagtctctcccttgaaatattcgcgagcatttgaacgatttacccgagttaccaccgaattggttggcgaaaattccgatatttaccccgaattggaaagttacatgtattccccgttcgtaaaatctaaagcgtttacaaaattgcaaatcgaaagcactcaaatggtgggggcttccgggattttactgaacttgtttgacatgatgggtaacgggattgacgaaacgtatgactacgcgcgtcttttagcggaatccaaacccttaatgaatttaggtatgcaacatcgcctgaagcaaaaccatttagcaggagtaaaggtcctcttttctccggacgcggtctttaaccttaaaaccgcggtcggtaagaaccctgaagaattactaccccaagagtattcttggttggaacttttgggaactttagggattgcttgcaaacccgaaaagtggacgttacaaagtcattttacggatgaggtactggccgttagcggacagttcttcaacaatttaactgaccggcagattaccgaattactcgaaaacaacgtggtgctaattgatggtccaagcgtccagatcttaattgatcgggggctaggtgaattagtttgcgccaaccaagtggaactgaaaaaagcacgaaccggttatcaatcgtatgagcaaattgatgggatgatcatcgacggaattcaaaatccgcgggtaacgatgctccagcacactggggactactatcaagttgattatgaaccagctgcgccggtgcaaataatttcaaacgcgtacaacgaaaacgccaagaaattagggccggcgatggcgttagtgaaccagcgtaccctaattttaccaatgaacactgatccaaaatacggttgggaatcgcaatattattcaattaaagagaaattattcaaacggattttaaatcagatcacggacttggattacgtcattgagatgccaggaacgaaactaacggccgttgccgaccaaatggttttatcaaactttacgatcgatgaccaagcgcaaattcagttacaccttactaacgcaaaggcgaaccaacactggaagctctacttccacgaaggtgcgcagttacagagtatggaggttaccgtttcaccggattcaaacgggatgttgaccattccgtaccgcctcaagggcttagaaacagtaattttattagcggagttttaaaaaatgaaggagtgagtaggatggcaattacagcagtacgaattgacggacgtttaattcacggccaagttgcaaacttgtggactaccaaattaggcgttacacggattatggtaattgacgatcaagttgcagctagtgacattgaaaaggcgggattaaaattagcgcgtccggcaggagtagatttaagtgtgcttcctgaaaaggtggcggctgaccatattaaccggggcggttatgattcccaaaaggtattcatcgtggttaaacgcccacaaatcttgttagatttagttaacgatggggtaaagcttgaagccgttaacgtgggtaacatgtcccaaactgacgaaactacccaattgactaactccattaacgttgtgcaagaagacgtggatgcattcaacgcgttgcacgaaaagggaattaagcttactcaacaaatggttcccggtgaccaagcgaacgactttatggaaattctcaagaaatttaaaccaaaaaactaattaaataaggagggattctcatgggttcaggtattgcaatttggcaagttattatattaacaatttattcaatgtggcaaatcatggatgaattgaccgttcaaaccagtttgagccaaccaatttgggctgggatcgtcgctggtttagtaatgggcgatttaaaaactggtttgttaatcggtggtagtttacaattaaccgttttaggtgtcggaacttttggtggcgcttccaagattgacgccaactccggaactgttttagcaaccgcgtttgcgattggtaccgggatgaaagcggaagttgccgtagcagctttaggggttccggtagctagtttgatgattcaaaccgatattctcgcacggtttgcgaacaccttcttccagcacagaattgataagatgatcgacgaagaaaactataagggaattgaacggaacttcctctatggttaccttccatggacgttatcacgtggtattccagtattcttagcacttgcatttggtggcccgttcgtacggacagccgttgattacatgaacaccaacctttcatggttaagtaacggtttggcaaccgccggcgcattacttccagcagttggtttcgcaatcttgcttcgttacctaccagttaagaaacattggccatacctcattttaggtttcgtaattactgcaatgctttcaactctttacaccaacatttctactttgggaacgaccattgcgggcatgaatgctaagttcactaccgtatttgcaaacttaccaatgttgggaattgccttgattggatttgcacttgcagcaatgcaatacaaccgttcggtaaaggaacaaaatatggttgctgcagcaccgaagtcagctgataacgcgacagatttagatgaacaggatggtgagattcatggcgacgaactctaaaaataaagtaacttataaactaaacgataaagacttcaaacaaatgaacatccggaacattcttttcaaccaagttggatggaactacgaacggatgcaaggttcatcatacctgtacctaatcttgccgcaattgcggaagatgtatggtgaccatactcccgaattaaaaaaaatgatgaagatgcaaaaccaattcttcaacaccagtaacttctttaacaccattatcgaagggatcgatatggctttggaagaaaaagaaggggtcgactcgctcgaaaccgttgctggtatcaaggctggtttaatgggtccgttcgccgcaattggggactcgattttcgcagccctcgttcccgcaattatgggtgcgattgccgcgaatatggcggttcaaggaaatgcctttggcgcaatcttatggatgctggttaacttcgtcatcatgtggttccggtggatccaattgaagtttgcttacaaacaaggggttagcttggttaacgaaatgcaaggccaattaaacgcattgactgacgcagcaacccttctaggggtttacgttgtgggggccttagcagctaccatggttaacacccaagttaccctcgtggcgcacttaggaaaaatgacggttaacttccaagataagattgacatgatcatgccgaagctagttcctgcattaattgttggtgcaatctactggatgctcggtaagaaacggatgacttctaccaaggcaatctttatcgtaattatcgtggcagttgtactatctgcactaggtgtaatcggaaaagcagcttaatttgcaattttagtatccgactttcctgaatctggtgtatcatattgtcattatgaaaccggtttagaaagagcggaatggttatggaatttaaatataacgaaaaacgtcccgtgtacagtcaactcgtggacgttttgcgaaaagaaatcaaaaataattatcaaccaaacgataagctgttgtctgagcgcgaaatcatgcgtaagtatgcggttagtcgcaatacggtccgggaagcgttgtctgaattagaaaacatcggctacatttatcgacaacgcggtaagggaaccttcgtagccaacatgattgattacacgcagaaaattggcgacgaatatagttttaccgagcaaatgaagtcgatgggacgcaagcccgagactcgaattttggaaatgtaccagcgggatgcggacgagtactttagtcaaaaactaaaggttccggtggggacttgtttgattaagctgaaacgtttgcgcttagcagacgggcagccgattatgattgaccgaacctaccttccgcaggctaagtttcctaatttaagtcgggatgatttagaacttaagcaacgttcactgtacgcaatctttttggaggattacggtgaaaaagtaaaagttgctgacgaacgtttgtcagtggggattatcagtgatgaggatgctaaactactgaacgttgcttctaatactgccggatttttggcgcggcgaacgacgtacaatcataagaacgaaatcatcgagtacaccattagcagtgctcggggcgaccagtttgtctacaatatcaagtatcgacactgaaggattgagaggagaattactttatgtttaacaaaacagatgatgagctaaccaagatgggagcggtgattaccactcgtgagattcaacaagaaccggaattgtgggaagaggctttgcaaaactatcaagctacaaaagcaaccattacggaatttttagaaaagattgaaaacgaattcaacgaaccggtccgggtgatctttaccggtgcgggttcctcggcctacgttggggatacggcggcgccatacctaaccgaaaatggcgaccggaaacgtttccgttttgaagcgattgacacaaccaaaattgtgtcgacgcctaaacaataccttgaaaaagacactccgactttgttagtttcctttgcccggagtggaaacagtcctgaaagtgttgcaacggttgatattgctgaaaagtacgttcgtcacctttaccaattaacgattacttgcgcaccagaaggtaaattggctcaacacgcacaaagcgacgaaaataacttagttttaatgcaacctgcgcgctcaaacgacaagggttttgccatgaccggtagttttagctgcatgttgctgactgcgttattagtctttgatgtaaaacatacggacgaccaaaaggaaagctacgtgaaggccattagtaagatggggcgtgaagtaattgaccgggtggacgaaattcaaaagattgtcgatactgattttgaaagaatcgtttacctaggttcgggagcccttggcggattgactcgcgaaacccaactaaaagttttggaactcacggctggtcaaaaggctaccgtcttcgatacttcgatgggcttccgtcacggtcccaaatcatttgttaatgaaaagaccctcctctttgattttgttagcaacgaagcttacactcgccaatatgacgttgacattttagacgaagtggccggagacgaaattgcgctggtagtgatgggagttggagtgaaatctgacaataattttgccggtgcaaacttcacctttgctaacggaaacgaccaaattccagatggctacatggccttccctgacgtaatgtttggacaaacggttgcgctattgtcatcaattaaagttaataacaccccggacactccttcggcaactggaacagttaaccgagtagttaagggcgtaaccatccacgattttaaaggttaggagcgatattttggaatactatattcacgcagcaaaatttttcttaggtagcaacgtcgaaatgggcggctacttgccagtgattgacggtaagtttgggcgttaccaaaaggaaaagcctaccggcaaaattgtggactacggtgatcaatggatagctcccggattggttgatacgcacatccatggtttgttgaaccatgatgtgatggatgccgatgctgaagggatcaacgccatgtctaagggattgttggaatgcggggtaacttcgtggctaccgactactttaactgctagttcagaccaattgaagcaggtggtccaaacgattagtgaccacgtggacgactttgaaggtgccaaggttcaagggatccattttgaaggaccttactacaccgaaaaacacaagggcgcccaaaatccaaagtattttgaaaatccgagtgttgacgaattccatgcttggcaaagcgccgcccaagggatgatccggaaaatttcgattgcccctgaacgagacggggcggtagaatttactgctaagattagttccgaaggcgtggtggttgccttagggcacagcgatgcgacctttgatcaagccaaagcctgtgtagaggcgggtgcgacgatgtttacccatacctttaatggaatgagtggacttaatcaccgcgagccagggatggccggcgcggcaatgagtttagacggggtgaccgatgaattaatttgtgacgggcaccacgttaacccatacgtcgttaaaatcttgatgcaaaccaagacttaccaaaacgttgctttggtaaccgactgtatgaaggcgggcttaatgccggacggcgactatattttgggagaattcccagttaaagtagccaacgggacggcccggctaacggatggcagcaatagtttggctggtagcattttattgctgaaggacgcggttaagaacgtggtggattggaatgtagccacacctgaacaggcaattaccatggcttcagccaatgctgccgatagtgcgggcgttggcgatcaatgtggccatattttaccaggtcgggatgccgacttcatcgtacttgaccacgaattgaacttgaacaagacgtatttagacggggttaaagtatttggttaacaaattaccttaatcacgcgaaatgaaggctaggaaactcctacaaggggggctcctagcctttttagcgttgcattagtagatccctttgatcaataaaaagaggttggtatgtatagtaccaacctctttagcgttgtcccagtatgagacaggacttcagtttgaagaagtcttattgaaagaaagtaaaaaaaggagatgaagtagccaactccttgggtagaagaatcagctacaggaaaaaatgatataacttaaacactcagtacagggaacgggctctctgtacaactaataatatagcgtgttgtaaaaacgttgtcaatagattttatttatgtttttattaattattttcttattatggtacgataagtttttctttaaatggcgggattttatttgattaacgggattttatttttatgcggtaatcgaactgacggatttggctgtatcaataatcctcaaaaacagtgacaaattttagaaaacaggtttacttttttgctactcgattgttattagtaaatgtaaggcgtcgcgacacttactaattcaatatttaagaaaagaggacagtgaaatgcaaaaaacttggttaaagacgggaatcaacttcacaatggaaggagcaggacacgataagaaggtgcgccgttcctttgccaacgtggataaagacgtcagcgctgtacaagtggaagaattagcacgggcgctcgaaatgcttttggaagatgaagtgacggaagcacaagtcgtcaccacagagcaagtaactttaaattaaaataatcggaacgttgatttatatatcgcataaaaataaatgggaggatcatttgatgaaacaactagacttagaatttttgaacgttgcgggaaagacgcaacacttaaagttaaagtatgcaaaacaagacctcgacgagggtacggtacgtttagcaatggaaaagatgattgacactaagcttttccaaaaagaaggccaattgctttacgtgacccccaaagcggcccaatacgtggaaaccttgcatgaaccaattttcgatgacagcaaactttagaaaataagcaaagcggttaggaagaaccagatggtcctttctaaccgcttttttgtagaatgcgtataaaacgcttctggcttggcacattaacaaaatgtaccaagttattttattagaaataaagggaatatttaagtttctgagtactgataaaccgtctgataatccaccacttggtgtgctggaagcactatattaccaaaattagtatggtgaacgctgtccggcagcgtttgggtttctaaggcaatcccttgataaggatgtccggctccgtttgttaggggcatatccgcggtgaacgaattagcagtgaaaactaccagaccatttcgtgcagaataaatttcaacttgacgattagccgctggtgcacgaagtactgctgcgggagcaagcaccttattgtcgactacgtaaacatcgtccaaacccttttcagtagtagcttgtaagtcgttgatacagctagctaagggtttaaaatggctgaagtcaaacggagtgccagccgttaccttgaattctcccgtaggtaatttttgctgatcaaccgataaccgttcgtggctatttaactggagctcatgatctaaaatatcggcgtttcccgtcaaattaaaataaacgtggttagtagggttgaataacacgggctggtcgaatgcctgaccgtgatactggataattacctgattgagattattcaacgtgtaggtgatcgccacctttaagtcaccaggataaccgtcactttcagctttaatagaattttcaaacgttacgcttgcggaatcagttttggtctgggtatagaagctccagttataactatgaaaaccacgaggtccaccatgtaaagtgtttgctccctcgttttgcggcagttgaattagctgttcaccttgcgtaaagctccctttactaatccgtccgcctgtccgaccaatactcatccctaagtaaaatgggttttgataatagtcagcagtatgggcaaaatttaagattaaattgtcgttaccgcaagtagctgagctaggaactaagaattcgtgccacgatgcgccttgcgataatagtgagatttggacttgacggtcgttagctagcgtaatcttttttaccgacttgccttggtattcgtcaaaatcatcaatatttactttcatgattttgctcctaaccttcaacccgtttgtcgttcttccgtaattctgcttcaatatcttctagcgagcgattacgggtttcaaatactttagcgtaaacaaaccacattgctaagaaacagagggcggcataaccaataaagaggctgccttttccaaacatgtttagcaatgatgggaaggttaacgaaacgaccgcattcgcagtccagttaacaaaactaccaaatgaatttcctaatccccgaatatttagcgggaagatttcaccgatcattacccacattacaggtccccaagttgcagagaagaccgcaatataaacggtcatggcgactacggcaattaccgctgcagtaaacgagctgtgagaatatttaagtccgtaactcatcactagcaacgaaatccccataaagaaaccaccccagaaaagcatcttccgacgatcaattttatccataattgccactgccacggcggtaacgattacgttaaagattccaattccaatatgcgcaattaaagcagcgttaaccccaaatccagcgtcagtgaaaatggttggtgcgtagtaaagtacagtattgcatcccattacctgttggaaaatggttaagccaatcgcaatgattaacgctggtcgaacgaagtgactaaataattcttttaatccgccattttcaagtttagcttgttcttgaatttggacgagttctttatcaactagcgtttgattatggttattcatttgacccaaaacatgcttagcttcttcagtatcacccgttttaactaagaaacggggactttctggtaaaactaatcctccaaggaagagcaatgcggaagggatggcggcaaaaccaagcatccagcgccaaccagtgtacatcccagagaatgtgtagttggtaatgtaggcgatcaaaattccggtcattaccattaattggaagaggctggagacggttccccgtttttctgctggcgctaattccgctaaataggttggaattaatgcggaagctgccccaacggccatccctaaaatgattcgcgataaaattaacgtccagaacccagcagcaaaagctgagccgattgaacctaagaagaaaataattgcagacaatagtagtaacttcttacgaccaaagcggtctgaagatggtccaataattaccgaacctaacatggcgcctaggagaacggcactaacgacccagccttgttgccaggcgtccaagtgcatttgtttttcaatgaatagtatggcgccggagattaccccggtatcataaccaaacagtaaaccacctaaagcaccgaagaaatatatgaaacttgcggatacttttttcattagttattcctcattcctaaatatattggcagttagttgtctgagaaaactaatgtaaatcgtaaacacattaattaaaacatatattctaaaaaatgcaagcggttccaaaaaaataattttcgaataatttagattttcatctgtaggtggtagtgctcaagccccaacagatggtgagttagcaacgatgcaccgccatataatggagcatcttcaatcatctgcgaaagctgtaatttagttggcgaattagccccagcgagctcttcatattccctaattattttagtcattaattgtgggatttcgccgataattcgcgactgtaaactaactagttcggggctgaagatttgactaacgttgaaaagcaggtagaccacggcttcggtgaactcgttcatgattttaatggctacctgatcatcggcccgatagtattcaaggaactgctgacgatcaacgtagggggttcgttttaattgcccaaattttttaatgattgcatcttcactatataatttttcgattttcattgttggactagaagcaaagccagggaaaaatagggaacgaccaatttcacctgctcgccctaattggccgtgataaagacggtcgttaataataattccagcaccgatcccattgtggacatctagtgcaattaggtttttaaacttgtgatcagtcatgtagtctcgggtggcgatggccgctagattagcttcattttcgataaaaaccggaacgtggaattctgcaagggtctgtgctaggtccacattttgcatgtcgataaagggcgaatcaatgatttggttatggtcaacaatgccgttaatggcaactgaaatccccattaattggtgttcagcagttggaattgaaattgaacgaatccgctccttcatgatttcgacaatttcataaatatctttatcgattaccgggatggaataaaaagaaatcttctccccggtcaaccagttggtcatcatccgtaaatgatggtgtccgagttcgaaactcacggtgtaaccatagtgacgattaaatttaattagaattgggcgtcgtcccccgcttctagaactatcgccgtgtccaatttctcgcacataacccatccggttcagggtcgcgtatagggacgaaatggtcgatttatttagccttaaattatttgcaatttcaatgcgtgaagttttcgggtgattaaaaagaaattgaagcattaatttaagatttaaatcacgcatcgcatcttggttaattgatttagccatatgttgtatatctcctgtttttaaaaattgtagcaccgggttcggtttcctaccccaaaaacacctcaagaggcgctcaaaagcccttagaaggctgaataagccgaaataagcgatgatacaactagtatcttatcagaaaagtaaaaaaggcaattggttaaaaaatacttgcaatttaaaaagaaagggtttacattgattgtgcaggttagttgtttgagaaaaccaactggattttatgaaagaaggatgtacaaatgtcattatttgatcgcaaaaaaatggaatatgtgggtaaccaagcaggtttaaaagcaggaaatggatttcactactataatcctgacgaagtaattcatggaaagaaaatgagcgagtggttgaagttctccgtagcatattggcacacaatggatcaacgtttagttgacccatttggagatggaacggctcaacgcccatgggacaacattaaagatccaatggaacaggctttggccaaggtagattacatgtttgacttcttagataagatgaacatcgaatactttgcgtttcatgatcgggacttggctccggaaggtgaaacccttcgggaaactaacgccaacttggacaaggtagtggataagattgttgaaaaaatgcaagaaacgggtaagaaagttctttggaatacttctagcttatttaccaacccgcgtttcgttgctggtggcgcaaccgcaccatttgctgacattttggcatattccgcagcccaaattaaacactctttggaaatcgctaaacgtgtgaactcacgtaactacgttttctggggcggtcgtgaaggttacgaatcactattaaatactgatatgaagttggaacaagatcacattgcgaagttcttccggatggctaaagattacgctaacgaaatcggctacaccggccagttcttattggaacctaaaccaaaggaaccaacttcacaccaatacgatacggatgccgcaaccacgattgccttcttgaagacgtatggtttagataaagactttaagctaaaccttgaaggtaaccacgcttatctagcaggtcatacttatgaacatgaagttcgagtagctcgtgacgcaggattgttaggttccttagatgccaacatgggtgataaattgattggctgggatattgatgaattccctaacgatgtaatggaagctaccttagttatgtatgaaatgcttaaaaacggcggtttgccaactggtggcttgaacttcgacgctaagccaagacggcaatcatttactatggaagatttattcttggcacacactgctggaatggacacctatgccgcaggtttgcgggtagctgctaagttacttgaagaccacgttttagattccgttatcgaagaccgttatagttcgttcaagtccgggattggagcagactttgaaaagggcaaagtcgactttactgattttgagaactatatcattgacaaaccacaatcagaattaattgccgcaaccaagtccggccatctggaacagttgaaagcaaccatcaataactacatgttcactgtgctaggaaaataaacattaattaaacactaagagggtggcgtgggccgcccttttattatcaggagaggtggatatcatgcaagtagttttaggggttgatttaggaaccagtgcggttaaggtttcggcagttgaccaagcgggcaaaattgtcgcccaacaaagtaaggaatatcccttaagccagcctgagccgggatttagtgaacaaaatccggaagactgggtaatggggacgaccgtggcaattaaacggttgattgatgtagacaaaattaagccaacggatattaaggggattagttattcaggacagatgcacggattggtcctcctagatgatcatcatcaggttttacgtccggcgattttatggaacgatacgcggactactcaacaatgcaaagaaattttggatgtgatgggtaaagactttattaatatcacccgtaacgtgccgctcgaaggatttactttaccgaaattattgtgggtcaaagaacacgaaccccagatttttgaggaagcagctacgttcctgctacccaaagactatgttcgttatcgcatgaccggcaagattgcgatggaatattctgacgcagctggcacggtaatgttggacgaagaaaatcggaaatggagctcccaaattgcggaagcgttccaactaccgatggaaattttccctccattaattgaatcgatcgggtttgcaggaaaaattagcgaaacctacgcatcgttttcaggattaagtacggacactcaggtttttggtggagcagctgataatgcggctggcgcgattggtgcgggaatccttaataccaaccaagtgctatcctcaatcggaacatctggggtagttttaaagtacgaagataacgcgaaagttgattaccaaggggcgttgcatttctttaaccacgcaattcctaataaatattacaccatgggggttaccttggcagccggatatagtctgagctggtttaagaaacggtttagcaacgacaatagttttactgattttgttaatgcggctaaaaaatccaccgtgggtgcgaacggcttgctatttacgccgtacatcgttggggaacggaccccgtacccggacggcgacatccggggaagttttatcgggatcgacggcacccatcgcaaagaggacttcacgagagcagtattagaaggaattgttttctccttcagggacatcatgcggatctttgcggagaagggcagtaattttgatacggttgtctccatcggcgggggtgctaaaagtgccctatggctacaaattcaggcagatatctttaataaaaaggtggttaccttgaaaaatgaacaaggtcccgggcttggtgcagcaatgatcgcagctgtaggtgtgggatggtttgattccttaaatgaatgtgccgaaaaatttgttgcgtacgaccagacgtacttacctaacgtccaaaacgttaaaaagtacgatgagctgtataacctgtataaaaaagtttacggacaaacggcagaaattagtcacggattaatgaattaccggcgtgaaatgttgtaagtagaccaaataaccacgaataaggagcggagaaaggggcgttttacccagattcccgctcttttttaaaataatttttaccagacgggagtgaaaataatggagaaatttatcccaattccagttgttgacgcaagtttatacgtttttggcgggcacatgcggacggttcccggaggatggtcattttttgaacaaaaacatcaggcgtttgagttgatgtgtgtgatcgatgggtatcaaactactgaaattaatcaatccgtttcgtatagctacggtccaggagacgtcattattattgcaccgggaacgttgcataaaaattggaatgctaatcaatttaacgatttaacttacattacctttcattttagttttgaaaatattcggttagagtcagaaattattcgtaatttggccaatacggtgatttatgctaagtcaaaattggcacaggagtcgctcaaaacggccaaagaaatcgttcgatatagcgaactaggaaaactgggagaattaggcaaagatgaagtcaacatcaagattcagctgattatgctgaattacctctatgatttgagcaaatttatcgaaagccacccggggcattgcagtaaccggttctccgaacgggaagcagaggttgctcgtcagattgcaattttaattgaaaataacatcggcaatccggagaaatttaataccttccaagatatttgcaatgaaatcaaaattagtgatggttatggttaccgaacgttcaagaaggtttacgggatgacgccgcttcattacgtagaaaagcagcgttatcggaaggctaaacttttactcagttacctagattattcggttgaagatgttgctgaaatggtaggagtgacaaattcatcaatgtttagcaaaagctttaaaaaatggagtggacaaactccacgggattaccgcaagcaattaggaaagaagcggatagtgcgttcccttaaagattcgggttattttgaatagtcagattttgacaaaaagtgggtacaaagccttctattatggcgatttgtaagcgaatacaatgatgctgtaaaacaatttagcttttaggaggctgataagatggcgagtaataacgacgtggcgaaagatgaattcgctaaattgtcttggaaggagcgggtgagttacggtgccggtgacctagcccaaaacctgatttttgggacggtgggctcgatgctgttattttacctgacaacggtatttggcatttcagcgacggtgggagcaaccatcttcctgattgtccggtgggtaaacgttttttgggatccctgggtgggagcggtagttgaccgtagccattttaaaaaaggcaagtaccggccgtttatcctatattttgggattccactgacgatttgtgcagcgttactatttttcccaattgaagcagtgcggggaaatgtaatctatgcgtttgtatcgtacttggcaacggctttaatctattcgtttgttaacatcccgtacggtgcgttaaatgcatcgttaactcgggataacgatgaggtttctgccttgactacggttcggatgaccgaagccaacattggtaatttaatggtttacacgttcttaccgttatttatccaactggcttcgccagacaagcaacttaaagatatcggattatttggaattaaattgaatttgggggaatacacttcaccacatgcgggcggcgcgtacttttccgtaatggcaatttacatgattattgggtttgcgttactattatgcacttattttggggttaaagaacgggttttgccaacccaggaagaaaccgatgccgttaaatattccgacttgtttgctgaaattaaacgtaacaagccgctgcaagtattgggaatgttctttttaattggttttacgtttatgttttttggaaatacggtttggcctttctatatgcaatataacgttggacacccagaatggatggcttcaattaacttgattggttcaattccgggaattttcctcgtattcttgtggccaattgtccggcgtaaaatcggtaaaaaacagtttttctacatcttcttagcactgtttattgtcggtcaaattattttatgggtttggcaaatgccgcaatttaggaacgctactgcgttaggttaccttggacgcttcttacaacaatgggggattacttccgcaactggttacatgtggtcgttagtaccagaagtagtttcttatggcgagtaccaatctaaaaagcgagttgcgggaattattaacgccattatgggtcttttcttcaagattgggttagccttaggtggaattattccgggctacatcaacgcgttcttccactttgatggtactaaggcagtccaaaattcctcttcactaatggggatccaatggtcaatgatctggattccgattggattggcagtagtagcaatgtggattatgagtaggtatccgttaagtgatcttgacgtaaagcaaatcaatttagaaattgaccaacgtaagacgcaaggtgaattataaatcgtttatatagaaaggataattaaaatgaaaatagttaatccagtattaccaggttttaatgccgaccctagcatgattagggttggtgacacttattatattgcaaactccacgttcgaatggtttcctggcgtgcgacttcatgagtcaaaagatatggtgcattggcaactattgccatcaccattatccacgacgacccttttagatatgaaagggaaccctgcttctggggggatttgggcacctgatttgtcgtatgccgatggtaaattctggctggtttacaccgacgtgaaggtaaccgaaggtgcatttaaagacatgaccaattatctaacaacggcaacggatattcgaggaccgtggagcgatccgattaaattaaacggggtgggcttcgatgcttcactgttccatgatcaaaatggacgtaaatatttggttcagcaaacttgggatcatcgagaatatcaccacccgtttgacggaatcacgctgacggaatttgacgtaacaaccatgaaattaaagcccgagaccgcgcgaaccatttatcgcggtacggaagttaagctagttgaaggtccacatttataccaaaaagacgactactattatctatttgcagctgaagggggtacggtatttactcaccaggaggtagtcgcccgttctaaaaccttagacgcaaactcttttgaaactgagccagacggacctttcatcactaattttgacacgcccgatatggaaatacaaaagcagggtcacggagcactagttaacacgcctagtggagaatggtactacgcatcgttatgtgcgcgaccatggaaccacgcgaacgaatcccgccacgatccccggggatggagtactttaggccgggaaaccgccattcaaaaagtagaatgggatgatcaaggatggccaagaattgtgggtggccatggcggtcaggttgaagtagaagcccctaaggacgcgattttgtctgcgggttcggctgaccattcccgccacgacgagtttgaccaaccagcattggatttagattggaatacgcttcgagtaccgttcacggctaaaatgggccataccgggaagggttatctagagctggttggtcgtggatcattagcaagtaattttgacgtttcgatgattgcccaacgctggcaggcgttcaattttactgcagaaactaaggttaaatttgatccgtttagttaccagcagatggccgggctaactaacttttataatgataaacactggtcatgggtcttcattacgtgcgatgaaaatcgtggaaaagttatcgaagtggccgaaaataatcgtggaaactacacttcttatttgaaggaccacgccattaaggttcctgacgatgttgatgaagtttggctgagaactcaagtggaaaaacaaacttactattatgagtactcttttgatggtcagaaatggcatcggattccggttgagttagatgcggccgtgttgtcagatgactatgttttacaaacttacggcggattctttaccggggcattcgttggtctagctgccgtggattattcaggttatgaagtaccagcacaatttgggtattttgattatcaagaaaaataacgtttaaattcaagaagcggaaacggtttatctgcagttttcgcttctttgtgttttggggactgataaaccgttatcatacccgacaaatacacaaccaaaacaaaccaattttatatattaacaaatcgcccaaccagtgttataacagagtcgtggggtgcaataataaaatgaacggcatggctaagctttagtcatggtcacccagtttattggaggcttttattatggcagaaacattgaagacacaacttttggataaacaaatgaaggaagtatttgattggagtgacgattcaactccagtacgtgatgcaatgtggaaccacgttatggattcgaacggtcacaacacggttaagacaattgcggaagccaagaagtgggaaagcatgagcgatgctgacctaaagaagaccgccgaagatatgttaaagtaaagcacctaagcaccactgtctcggacagataaaaatacccttgaagcagcgatatctcgtagcttcaggggtattttttacatgcaaaaattgcgtgctgaaaataatactttgacaagttaatttttaataatattaacttgcaaaatatctaataaaaatcgtatacttaagaacgataatttagtcgtcgatatcggggaaatggtgcaattttgcgccaccaaactgataacgcaatgggttattacaaagattagtttttattggaagattaagttttgattttggcaatgtggaatgttagaaatgagccttcgcatttagtgtgggtagggaagattatgtataattttcttgcgctaaacgaaggataccggttatttagttgttaacgactacgtggacgccttgattaaaatagcaaaagaataggagatattaaaatgccttttagtatggttgtaagtccaattggacaatggtttgcgcgtttttttagttttaatacgttgattattgctgcaattacgattggtgttttatgcattttaacgttggtttcatacgggattgaccgcttttttggcaggtacgaaaccaacacggcagtttatgaagagattagttggtttgtcagtctagcaattgccatgctttttatgcaggcgacttttatggctttgaatgcggatattgacaatagccaactgggttggcagtactctaatgcatagttcatcatcttgttttactgcctatacattgtgcatcgcaaaacggtgcttttgtttaacatgggtttgccaatttatatttatggtttggcaattattcggcaccagacgcagtttaacattttaaatttgttggcgatgctgcttttaatcgcaataatttgggtggtttatcggaatagtgaatggctaattgatagcgcttggtattatgcgacccagttcttatttggggttgcctggtggtcaatcttgaaggggattcgcaccatgacggttagtcaagtgctcttgctaacgtttgaatttatgctgatgatgacgattgtccatttcggaaatattgaaattcgggcaatgattaagcggtatatgaaattggaaaaggataacggctacgatttcttaactggagtacgtaaccggcggacctttaacgaggtgtccaatgaggtatttgaagtttactctaacaatgatttaccggtagccatggcgatgtttgatattgataactttaaactttttaatgatcaatatggccatcaagtgggcgatcgtgttttaaaatacgttgctcagctattttcagatgaactgttcgaacgtaaaaccaacgcgcagcttttccgagttggtggtgaagagttcacgattattttccgaaaccggacgtccgccgaagctgcaccgattgtgaaggcaattcgtgatattctagttgagaagacttttaaagttaaagacgatctcgacgtccggattacagtatcgattggggttactgaccttaaaaagagtgatcaaagtgctaaggacttttataaacgagttgacaaatatttatatcaagctaaaaataattttagaaatagtatgtctgtagagggggatgtttcgtcattaagttagagaaggacaagttggatgaattagaagctgcagtggataagttatgtttttacgaacaaccaatctttgcggtgaataacgaggataccaaggggaagctccaagagtatgaattattgttacgtgaagctggggaagataataagtttccagcggccctctttaaagaatacattcgtaataacgagagtaatcggattttctgcaattggatggccaatgaattaaaagagttggtaaaaaataagccagaccaatattttagctttaacattgacccgcaacaattattatacccaagcactatcgaggctttgaaggctttaattccataccaaaagaccttgatggtggagatcacggaagcaatcccaagtaaacggtatttcgaccaatattacaataactcaatgattgaaccaattaagcaggttcacgagctaggttttcgcatcgcaattgacgatgtttctagcggaatgaatagttttaatattgttcgtgagtatggtgaatatatcgatcggatcaagttgtcattgttgcaattacgcaacgtaagtaaagatctagtgcaagaaacggtgatgttgtggcgctcaatggcaattgataaccagattgacttgattattgaggggatcgataacctctcggtaagtgactggttagtagacaatagtattaagctacagcagggatactattggggaaggccgtgggcgattgaaaagaattagagtgtggaagataccgggtaattttcgaggattaactggatttggaggctagtcgcgggttgagcgattagcctccaaatttggttaaccggaaaaaattggtggctggaacacgttttgactaggcagcagagaagcagtttttcctaaaaaaagagactgagaatatttttctcagtctcttttttcgtattaaagattcttatccatattaaacgtcaatttcgaaagcgttaatccagtagcaagcagatcgttaaaatgcttcattgtgcgctctttcatggtagctacggtttgatggttggcttcggttaagaacttggttaattcttcaccagacaattcagcggtttgacgatcaatttcagcaacccggccacgcaagaattctttagaagcagttacgtagtccacgttcttttggatgaattggctatagtggccttccacaacggaaccaaccgcgcggtacatccagtaagcgtcgtccaaattcatggtttgcttagtagcgctgtagctaggatcagtatccgtagcgttgttaaagaacggcacgtatgggctaaatgctgggacaccgaagttaagccagaaaattgcggaacaatcttcaggcacgtcgttacgaatttgcaaaacgtgcgaattttgggtccggttcattgaaattggccggaacttcaagcgatccttgtcatcaccatgaccaaacggatcgtatttagtttcgttgtagtgcgaactcaaaatgttgcccacgtcttcaaccgtaattttacggcttgcttgacgaatgaacggtaattctgaagattgcgggtcctgttcgatttctgggttaaggtaaagttgtccataccaaacccgcggagtattgtaatgccggtctttttcggtgtcggtaccgaagatgtgacggaagttccaaccctcatggtcaggattcaaatggtatttttcaacgaattcttgaatgccttccgaccacataaagttgtcagggtcgttgaagtcaacttgttgaattgccacttggttagcagctacggcgtaagaatcgtcaggaattcgttgagcaacccagtgatgccccgtgacgatttccatgtaccatacgtcatccttgtcactaaagatgacgccgttaccttcaggagaaccatacttagcaattaacttacctaaatattctacgcccatccgcgcggaatcaatgtaaggaagtaccatggttggcatggtgtcttcagcaagcccattaggaacgagcgggtcgtacgctagggtcttagggtttccgtagacactttcggtggcactcatggcaacgttcttttcgttaaaaccactttcgtcatagattccatcacgatcaggatcgatgttaggaacggcgctatgacggtagccattggcaggtaattttgctgtaaacccgttttgtgaggagacgatggtttcgtctacgccactttcagcgggatgcatgtaaaaacggtgcggtgcgagtggcaagaaagtatcgtcgttacgagcgaccatggtcgaaccatcgattgaggctttcttaccaactaaaacggttgtgcaggctttttcagtcaaattcaggactcctttatattaattatcttctattctaacgcaaatctaataattttaggccttttataataatttttttaaaattcgccgatataatggggacggaggtggcaacggtgcaggttaaaacaatttatcaaacgatgtacgctcgaatggggaagcaaccttggttagaagaatggcaggaaacaccctgggaagtcgtgtacggagggattttagtacaaaatactagttggcgaaacgtggtccctagtttaaacaacttgaaattaaattttaacttcaatccgaagttaattttagaattaagtgacgaagaattgcagcaaaatgtccgtccgagtgggttttatacgcgaaaggcggctaccattaaaaatattttacaatgggcgaagggctacgatttttcagtttcacggattcagaatttaacttcaagccaacttcgagcggagttacttgcattacacgggattggcccagaaacggcggattacgtgatgatgtatgcatttgagcacgcgggatttatcgccgataaatacagtagaaaactttttgaaagaatgggctgcccgttacctaaaggatatgaagcagcgaaaaaaatggtggaagcagaattagatttaactccggaacagtggaagaattttcacgcgatgattgtgaatgatggaaaagagagtggaagaacccgaatagtttctgaagattaacgcaactaaggcattgaccgcggtttaagtggtcaatgccttagttgcgttaactagaagagctagattctgggactcgttttaacacgtaaataattatattaacccgttaacagcaaaaagccttcaagatattcttgaaggctttttgctgtttttaaactgaatgtagcttttccaatccccgattgatgcgtttgttcccgttatttcttcttcggtaacacgattaacttgtaaatccaagtagtcaagaggtagtaaatcagatataccaccacgaaaataattattggatattggatatggtagtacggatcgtgcaataacggtttaaacatttgaagtccaaacaaaacgtcgatgactcccaagattcctggaagagcgaacaagacgaaaatttcattgttgatactcttcttcattaaggaacgacgcgttccgaccttatttagaaggttatagcgcacggtatcttggcgagttccagaaagaatcttgaacatcaagcaacttgcaagcattgcaaggaaggcaattcctaagaaataaccgatgaactcaagaccaccgtaaattccactgagcactaggtaagctgggtaagtacctactccgctagcaaattcatctggtagtggatgggcactgttctgcatgtcgtagagcttctgtaaagtgtttcgattttcgccaatatttttgacggtgatgaggctgacggtgcccttttcaccatttaactggtcaaatttagctgttggataaaattgaggcgtggtatcgattcttgaaccgcctaggccaatgaaatccatgctatgactaacgttagtttttaaatcgtttagcgtagttttaacgcgttttgcttcaccaggatgcgcagttgtagcgtcaaatttcaccgtatagtacggatgttgttcaaattgatcttcgttgtagtaaacgtgtgagttagcaaacttttggtcgtaactagttacttggacgtccgttagcttgttaatcaattgtttttctttaggagtagggttatttagctccattgtgtaagcactctgtaatttcgccgaagaatcaatttcacgattaaaggcggaaccaaccgtaatagctcctaatgccaaggcaaatagtaacgaagtaatggttaaaatcttgttgtaatcccggatccggaacataatttgcgaaagggtgaagttgtttaacttccgctgtgcaaatccggagttctttaaccagtggatgattaacgtcatgctagagcggaaaatcaagaaactaccgactacgatagtaactaaagcaatcggaatcgcagaaagttgaaggtccataatcttagcaagcgcgtaataaccaatcccgacgaggacaattccagcaacgccagagaaaagcagtccaatgggattaatcttaattcggtcgacagtatcagtctgcttaagtagcttcaagactggcttccgaactaaagactgtaaattaaacagtgcggcaataaagaacaaaatcaagtataacaagatcgttgttagaattgccttgaaatagaccgggttgaatttatgaatttctaacccaaggtgattaaagagcagttgtgaaattccaccggttaatcctacccctaacagcaagcctaaggcggtagcaataatcccaacggtcatggtttcgaaaaccatcaaactaccaacgcgccgttttttggcacccagcatcatgaataatccataatcatgaaggcgcatattcaataggaatgaattagcgtacattacgtaaacaaacgtgatgattaccaataaaacttccccgaatataaagactgggctagcaaacttaaagttagcatttgccttgataaagccctcgttagttgccaagttggcaaacatgtagaaaattgccgaagacattaccaagccagttagtaaaaccacgtaatcgcgaaggtggtttttaatattagaaagagctagtctgagtaacattatgcaaacctcctactgttcaaacgtaccgagtttttcaagaatttcttgatagaactcagaacgtgaggttccgttgcgccgcagctcttggccaatgaccccgtctttaatgaagaggattcgttgacagaagcttgctgagaacggatcatgggtaactaagaggacggaaacgccttgcttttggttaatatccgtcaataattccaacatttctcgtgcgctattagaatccaaagctccagttggttcgtcacccaatagtaatgctggttgatgaacgatggcccgggcagcggcaacccgctgcttttgcccaccagaaagttcagttgggtatttccgcaataggtcttggattgacaaagtttctgcaactgcgtgaaccgcttgtttaatagcgctgcgacgaactccttgcaaagaaagtggtaaagcgatgttttcttccgccgtcaaagtttccaaaaggttaaaatcttggaaaataaaaccaatttctttagaacggaaatcagcgatttgatttccctttaggcgagtaacgtcctgttggttaattagtacctgtccactagttggcttatctaaagttgccaacatgttcaatagggtggttttaccggaaccagatgctcccatgatccccacaaattcccctgtttgaacatcaaaattaattccctttagtgcttcgtattgccgttcgttttttcccccataagttttacgcaagtccgaaacactaacaatattttggttgttcataaaaagtccctcccgaattacttaattacttatgtgactaactatataaataaatgagtgagatgtcaaccgtaaactttattctcaatttttgccgcaatattgttacaatggaattagtaaaagataacgatttcttcaatataaattatggggagtggccacaatgacgcataccgttggaatcatattaactatgttatacggaggtttcttgatttatagtgcacttcgaattgaagcacaggtagagacctggattatggcggctaacatcattgtgggagcgttaatgttgctaaattttatccagccgtggctagggatagccggattaatactggtgttgccggtttcgttagttaacgggcagctaatttttttcaatattaactggcctcattttgtagtccgggtgattgtgacaatcctattagtggtgtcgcttctggcttagtatcgccggattgcaggaggggtgtaactattgatgaattgaaaaatctcgtctaatgaatccgagaatagtaatttttcacgcgcgggtttggctaagaatccatttttaaccatgcggtcatagaattcttgcaaggcatcgtagtaatgggcaacgttgtaaagggcgcacggcttggcattttcaccaattaatgaccaagagtacacttctgcaatttcttcaagggtgccgggtcctccggggagtgccacgaagccatccgcaagctccatcatccgttgcttgcggaccggcatgttttcaacgacttctagtttagaaattgctgagtaactagcaccgcgatcggcaaggttctgagggatgattccttcgacgtagccgccggattctaagacagctgtggcaatttgccccattaatccgtatttgccaccaccgtatactagccccatttgatgttttgctaagtactgacctaattgttgagcagctgcggtatagcggggagattcaccttcggcagcgccacaaaatactgcgatttttttcatgaacaagaattcctttcttaatttcaaagttatagctatcttaccacgccaattcacgattttaataagtgatgatggggtggtaaaatcatctctggtacttcatgggcggatgtttggtatgcaaacctcctctttttgtttacatttaatgtaggaattagataaaaattaaaaatgttttatacatatagttggatatttggaatggttattatatgatattaatcattgagcgtacataattaatcaacatttatgggggagaaaaagttgtttattttggatgttagaggtaagcgtgaatgaaagagtttgatgaagtttctttagaatacaaaaatacgggggcgcgccgctacattactggatttgatggtttgcgcgtgttggcacttttaggagttattttctaccatctaatgccttataaggtcccgggagggtatcttggggtgccaatcttttttgcggtatctgggtacttaatcacggatatttttattcaggaatgggatcgtacggggaaaataaaattaggggctttttatttacgccggctacggaggttatatccgaccctagtcgtcgtgttggtggcgagcactgcttatatgaccatcttcgcgcataatttattgtcgcatatccgaagcataatcttgaccaacctgaccttcgtatacaactggtggctggtgggtcacgggcagtcatactttgaccggtataatggggagtcaccctttacccatttatggtatttgtcggtactcggacaatactattttatttggccgcttttactaattgtgttgttaaaaatttacacccatcgtcgggtgcaagtagcggggattttgttctcgcttagcgtgatttcagcaatgatcatggcaattctgtaccatccggacacggttaaccgcgtttattacggtacggacacccgggtagcgcccttcttgattggtgcggcgttggcttttatttggccttccactaggttgaagaaaaaccttgatttgcataaaaatgccgttgcgaacattatcggattgatcatcatggcgttaatgatcacgtcattcttcaccatgccagggacttctgcgtggccttactatggcggaatctttattttttcggtattgtcagtattgatgattgccatcattgcccatccggcttttatttggaatcgagcgttgactaatccagttttcaaatggttaggaagccggtcgtacggtatttacatgtaccaattaccggtgatggtgttttatgaacaaaaggttaccaacattgcggcgcatccagttttaaatacgatcgctccgttagtaattattttagtattgagtgaactgtcctaccggtttgttgagattccgttagcacagtttgattatcgtcatctaggccgtttcttgaaggagatgttcgatatcgaatcaggatttaaatggcgtcacgtaggtgtggcagccgtcttgtttgttaccttcgtggcaatttttggcgcagtcactgctccagaaaaagtctcgcaaaaaactgatgatttacaggctaagctcgctaaaaatagcaaggctacggaccgtaaaaatgctgtcgcgctaaaaaaacaaaaggaagcgcaaaaagaccatgccaaatctaaggataaacacgttaagttaactaagaaagaaaaggcaattgctcaaaagtatcatttaacggaccaagaaatgggcgcagctaagtcaattccattaactggagtaggcgattccgttctagaagatacgggagccgatttgcaagaaatcttcccaaccgcgtttatgtccgctaaggttggtcggcaggtggatgaagcaccgggattactaacttccatgaagaaacaaggacaactgagcgacaacgtgctaattaacttaggcgcaaatggcccggtaaatgctaaacaaatcgacgctattgaaaaggtggtcggtaagcaccggaagctcttctgggttaacgtccacgtacctacccaaacttgggaaggttcggttaaccaaaccttgaataaagctacgaagaagtatgataatctgcaaattatcgattggaacggccccgctaagaaccaaccgggttggttctacggcgaccacgttcaccctaatccagagggctcgaaagagtatgcgtcgctagtagcaaaggcaattattaaggcggtgcaatgaagggcttgaagttagggattgaaaaaattatttattaacatgagtaaatatgtcagccaaatttaaaaaagaggttgtgacaaaagtctttaaacaaaaaacggttcatgagttgaaacttcctcatgaatcgtttttattttggcgttttgacttcaatagagccaaaacgtgtgccaaaagtcagtttgttccgcttaaccaaaaattgcccattatgcctgattttggcataatgggcaattttcagttaatgctcgcaaacgacccgacttttgtcccgctctcttttttagatagcctaattattaaactttcatccccgtggcttctgcagcacaaagtggtgtttgaaagaaggcgccacgtgttcatcggcccagccctggacgtacccttgagtgacgaaagcccaaaccgtgccaaaaccaaacgaccagacttggtgattggcaatcaagctcaataccgtcattactaaaggcggtacgtaacttgcccattgggaagccgaggcacgcccgtgcaggtacttaaaacgaagaatgtaagagaggtcgtcgttagggtgcatgattaggttggcccgttggtataaggaaaccgcggtggcgacccaaaataacccaaaaatatcaataatgatatctagtgcaagctggtaggggtggctgaagttggcttgaagttcaccaatccgtaaaaaatcccgaaaaagcggcacaaaccattgtactaggtagctaaaaggtaccacgaacaggatgttgcgaacaaaacgagtccaatctattcgttgggtaagtagcattgcaagaaaggctaccgcaaccccatagatcactaacacggtccccatgacgtgattagccacggctggatccgtggaatgggttacccagtgtgcaatattaaccgcggaagccgtccaaactgcactccccatccccgtggcaatggtcagagcatttgctgcggaattaatgataattgagattgtcagccaaaagaaccttcttctggcatcttgaattttcaaacagggtcatcttccttctacgttactcggatttctggccgaaagtaaagtaaagccacggtccgattggctggataagggcgaccaataaccaaagggcgcggttaccatgttggaaactacttgcggtaagaatatctttatacgcgaggaaagttgcggtgatttcaaacgctactagcggcaaaagttcctgctgacggcgcttattaagataatgttctttggtcattgtgagcgtcctccccaactaaattataattatccctattttatcatgaaaacgatttcttggtttaagcttttgtgcgaattcgtttgaaataataaactaacccgccgatgaggaggattccagctagtaaaattgccacaacggaagcgtacgtatcaaccattgcggaaacctccgcccatgcgctgcccgctgctcgtcctaaaagaatgaggactaagttccaaattaaggtggcaatcgtggttaacaagacgaagaggagccccggcattttagccatccccgccggaattgaaattaaactccgaattacggggacaaaccgcccaaaaaagatcgttttgaagccgtggcgctggaagaaactttgtgctttggtaatgtcactatcttttaggcgcaatccccgacctaagcggctagctactagccaatgtaagcgttccggattcaagtagcgaccaattacgtataaaagcaaagcgccaataacggcaccaaccgtggcggcgattacgcttccccacaaggtcagtttagacgtgagggtcataaatcccgtaaaggtcaaaataatctctgacggaatcggcggcaaaaggttttccaaggcaatcaagagcacaattgcgaggtaaccaaagtcgttgatgaactgcgtaatttgttgttccataaaatcctccatattggggtgttttctcctattattccgggtcggttgcgagaagtcgacgaaaaacctctgacaaacgggaaacttaaacagtttttataaaatgtgacaaatgtcatggcaaagtagtgacatctagtactgaataaggaggcagcaattccctagaatatgaggtatggaggatctgctaatgaaaaatacgacgctcgtggaagtccacgaattgaagttcaattatagttcaaaaatagttttgcgcggggtgaatttaaccgtacccacgggagaaatcattggcttgattggcgaaaacggtgcgggaaaaaccactcttttaaaattgttattgggaatcttgcattctcaaagcggtgcaattcagtggaataaggttgctaaaccagaagtgaacacgatgtttcaaaataatctgaagcttgtgggggtgaccgtacgggatttattacaacttactgctgcgcaatatcgtaatccgcgcccggtagctgacgtaatggaagaattggccttaagttcgtttgcaaaacgccccttaagccggttgtcgggtggacagttgcggaaagtagcctttggactaacgttggttagcaatgcacagttgctttttttagatgaacctaccgtgggaatggatgtcaacgcacgacaaatattctggcgtaaaattgaacaaatgcgcgttcagggaaagacggttttaattaccagccattacttggcagaaattcaggaagttgccgaccgaattttgattttaaaagcaggcaaaattaagttcaatggtactttagttgaacttcagcgaggctacttaactagtcaaattagctttgtaaccaatctccctaaagctcgtttccaagggctgccgaacgtaaagcaggtgcttgtaaagggccagcaagttacgctggacaccacggatagtgatcaaacactgcgggctttggcgccgtggctaaaccaattaaataatgtaaaaatcaccgccgcttcgttagaaaacatttttaccgcgatgaccaaggaggatgaccgccatgaataaattatgggagcagttgaaatttgatggaaagcggctagtattccgcaatccctcgtttttaataatgtcgctgggaatgccagcctttttttactggctattcactaaattatttacgaatccagcaactaatgaccgtgagtttgccggtagttatttgggaagtatgatggtgtacagcttattgattaccttgcttatggggatgtctactgctttaatccgggatcgtaatgaaggattgacggtatttttgaaattaaatcaccaccgcttagacaattattacgcttcgtttttattgtggaacacccttaaaaacttcatggcaatggggattttgggaacggtcgcggcgtatctgaatgcaattactttagatccggtacaatggctgactttattgggattaattttagtggggcaaattccaattatgttgttagccgggttgctagctaacgttaagcgccaagaaacgttgggaatgttaatgaacttagtaacctttcccttggcaattgtgagcggattgtggtggcccctagaaacaatgccagaatgggtccaaaacatcgggcgacatttgcccacgtattttttaaatcatacgattggacaagtgatcaaccatgctaaaattaactggagtagcgtagtgggaattagcgagtggattttaattatggcgttggtaaccgcgggggtggcgcaattatttacgaagaggagttcagcaattaatgcgtagttttaagggaactttaaaaaagattaagtgggagacctacatttggctaatgtacttgccgtttagcgcggcattctatttaccagtccggtcgtggacggactatttttggctgatgatgatgggagcgtttctcatcgtttacatattggttaccgaggtacctaaatggcggagggtaacgattccgctggaattgctaattactgggtcgtttgccgtatggccgctaaactttttcatgattacttttactgcttggcaggttgcgttcatcctttcaacgatgccacggcgctattttgggtggtttttagtggcttactacacccttttaggagcgggagttgtgcacagtttccaaaccaacccgacgtctggggtggaatatgctatgaacgcttttggattaatttttccggtgctttctccaataatgtcgtacgggtttgcccgttcagtccaaatccgaaaacaaatgtcccaaaataatcgccggctggaaaatttaattcgacgcggggaacgggaccggatcgcccgagatttacacgacaccttgggacagagtttttccatgattacggtaaaaacggagctcgctcaaaaactattggagaaggccccggaacgagttcccgatgagcttcgcgacattgctaaaactagtcgcgccaatcttcaactggttcgtcaaatcgttgccgacttgcaccagcagaccctgagcgaagttttgttggaacagggtaaaaacttggctcaagcacgtatttttatgtttacggagcacgaagaagcggctagcaaatggccgactgaagttcagaattgcttagcggcggtaattgtagaagccataaccaacgtgatccggcattcgcgagcttcccaagtctggattaaatttaatcaggttggcgaaaattatcaccttgaagttcaggataatgggcatgccaagcggttgacccgtgagaatgctaatggaattacggggatgttgcaaagggtgcgagaacaaaatggtgaatttcagatttcaagtaattccattggaacgttagtccaagttcaattgtcaaaggagtaaattatgattacgctatttttagctgaggatcaaagcatgctgaactcggcgctaagccagttattagatttagaagataatttaaaagtcgttgggacggccagtgacgggcagacggcctgggagatgattcaaaaacaatctcctgacgtggctattttagatattgaaatgccgcggctaactggcctagcagttgcacaacgaattcacgtggaaaagctgcccacgcgcgtggtgattttaaccacctttgcccggcaaacgtattttgaacaggcggttcaagcccaagtagctgcgtacctattaaaggatagcccaagtgaagaattaattggggcgattaatcaagtgatgacgggaaaaaccatttacgatccggcactcgtgcaaagtgttttatctgcggagcaaagtccgctaacgaagcgtgagaccgaagttttaaaggtggccgccagcgggatgccgactaaggaaattgctcaacagctttttttgagtgaaggaacgattcgtaattacttatcggcaatttttagtaagctaggggtccgaaatcggcttgaagcagtcgaacttgcccagaataatcgatggatataaaaagacccaaggaattgagccagtagttgaagctctagaaaattccttgggtttttaacgtatttatttaggggagtggggcaaactgacttttggcgcacgttttggttctgttgaaggccaaacaccaaaataactttttaaggatcttttcatcctgaaaatcagttctttggttttccccagcttcatttgattatgcgttacgtagcgttagctttacaactgcctctactcgagcagtttgggggaacatgtcgattgattgaatatattccacccggtatttcttcactagtggaactaggtcgcgtgccagagtggatgggttgcaggaaacgtacgcaaagtgtttaggtgctgattttaaaatggcgtcgattagccgccggtctaaaccaacgcggggtgggtcaacaacaattccatcaggttgaaagccctccttcaaccatttcggtaacaatttttcggcagaaccgacttcatagcgagcgttagtaatgttgttaagccgggcattttcgtttgcatcagtaattgcgtcagcaatcgtgtccatcccccgaatttcttttgcctcgctagctagggataaaccgattgttcccactccagaataggcgtccacaattcgtgagtttggagtgatcgataacgcttttcgagcttcatcgtataaagtaacggtctgttggggattcaactggaagaatgcccgtgcagataaattgaaagacaatccgtcaagttcttcgcgaatcgtatcttgtccgcgaagctttacggtctggtcaccccaaattaaagattgccgtccaggattgatgttttgcatgaaggaaacaatctctggaaattgggtacttaactcgtcaatgatttccgttgcgtgtgatagttggggcgtattagtgatgaaaacaacttgagtttcctgggtagcttgggcaacccgcaccaccaatgtttttaattcaccctcgttatgatgttcgtcataaatatcaacgtcgtacttagtgaatagagcgaccgttgcccgaataattttcatggttaacggatgctggacgctgcaagttgcgaggtcaacgagttcatgggtaccttccttataaagtcctgcaccaattcggccgtcagccagccgccggatttggaactgcgctttgttgcggtaggccaccgggtcgtccatcccgatggtgggccgcagctcgtaatcttgataacccgcgggccggaacttagttagcgcttggcgaatgacgtcgcgcttaaattctagctgggcagggtaagcaaggtgttccagttcgaagccgccgacttcatcggcataggcgtcgatcggcgttacccggtcgggactcgcctttttaatttgatgtaagacaccggtaagatagcgtggatgcacttcagtgatggtggcaagcaccttttcaccaggaagcgcgcccttaatgaaacaaattgtccgctggtagtaaccgattccttcaccattgataccaagtcgtttaatcttcaacggaattacctgaccttcagcaatttgttgagcactcttgggattatggtagaagtgacgattattttgtttgctattcgttcgggattgcgaacgtggtttagatgttttaaaatttttcttgttattcataaattacctcgattattgtgttcactcaattagtcattctaacatagattgttgggaaaccagtacgggagtaaaataggtttgtcgaatgaagtaagcaataattttgaagttcactgaagtaacaaacccgattaaatcgccttttttgaactagaattgtacttcagtttgtagtaaaattaatcattaaagtgggtgaaataatggcaaaagatattgaagcagatgaatatgcaactggttcggacgtcgttgaaaaaatcgaacggatcggaagccttgccacgttaggtaactgggcaaaggaaatggaacgtagcggccataaattccaacatgatggtcgtggacgacgcatttactctgaagaagacattcagattttagaaaagatgaacgagcttttgggtgaaaaaaacacccttaaacaagcggttcaagcaactttgggagtttcatcttctagcgacgaggacgatgaagaagttgaagatgaacaggatcaagttgaaggcgatagtgttccaatggttatggacgagtcgatgaaacgcttcatcacggcccaaagtcaggatatggcggaccttaaaaaactgctaaccaaagttgttgagcaaaaccaaagctatcacgaagaaaacgctaagttagctaagaaaattgatgacttagtagaaaagaaccaaaaggccttagaacaacctaaaaaaggttggtggaaacgccactttggttaaaatttaaggtgggttcattatattaaaacatgttgaagttaactcagaagcgggtcatgcaaacgcgttttgatcagattctgaacttcaattgatgtacttaacgatactgcacaaagggactggggaactttttaggcatcttggcgatcaagatgtctatttccccagtccctttaaattactgcgaagggtgctgtaaatgtttattggttggttaaaacgcgcccgtatccggcgataaacggttgccaccaaggtgtagcatagctttctcggatcaccccacgattttgggcgtcaatcatcaaatggttgccattaaccacgatgcctacgtgatcaatggtttgaccatggttgtaggaaaagaaaactaagtcgccgggacgtaccgctgtggcgtcaatacgctgcgcttgttggaattgctgttccgcagtccggtttaagttcagccccagcgcttggcgaaaagcaaattgagttagcccagaacaatcaaaggcggtcggtccggttgcgccccacgcaaagggttgtccgaggtgctgattcaaaactgtttcgagttgattgaaagccgctggggcagccgacgcagcggaaaatgaccgggagactttgggctgcggagtttctgaaatagaggccgttaatagcggtgaattagctggtaaactatgtgcagaaactggggagtgaccgaaagaaaatgcacccatcgtcgcaattgcggtagtaaaaagtattgatctgtaattcataaaattcctcctaagttggtttcgtaggtaaatacgttagcgaggaacgaaaaatttttatttgagaaaattagcgggagaatgtaatggtaccaacaaaaatcgggattcgtcagttagtagaatttattttgcgaagcggggacctaaatcccatggcaaatagccaaaatacagcgttaaaaggtgcgcagattcaccgacggctgcaaaaaaagcggggcgcagactacgaaaaagaatacgcggtcaaacggctcgttgaggttgctgggacggaacttaccgtcgaaggacgggctgatggagtggtgattggtgacgaactttttattgaagaaattaaaacttccgacccaacgtacgatgaacttagtgaaaacacgaagacgctatattggagccaggcgaaggtttacggtgccatccttagtcaggacttagattatgagcaagtgacgattcagctgacctattatcagcgacctaccgacgacgtgttggaacaacaacaaacgtttagtcgtcaggaactgagtgaattctttgacgaattgatcaacgaataccaagaatgggtccggcggcagcgagattggcgaagtgtgcgaaaccagtctgcccaaaaactagctttcccgttttccgaatatcgggctggacaacgggagctggcggtagcagtctataaaaccatcctcacggagcaacggctattcgtggaggcaccgaccggaactggtaaaaccatttcgacgcttttccccagcatcaaggcaattggagaagcaaagatggaacgaatcttttacctaactgctaaacaaagcacccagcacgttgctgaagaggcccttgaactgatggctgaaggtggcttgaagttaaagagtattacgttaacggctaaagataagattatttttccagaagaggtgggggttaatccggaaaataatccctacatgctggggtactatgatcgcgtaaaggatgggattcaagacgtactagatcacgaaaatcaattaaccaaggaagttattcaaaagtatgcaaagaagcatacgttggacccgtttgaattctcgctagatttgtcgcttttttgtgatctgattattggcgattacaactacctgtttgatcctcgggtatatttgcaacgttacttctctaacgtggataaggggaatttctttttaatcgacgaagcgcacaacttggtatcccgttcgcgcgagatgtattcggcagaaattaacaccgaccaagtggtgaaagcccaagagctttttgaaactagtggtcacgacgttgactcttcgacggttaagcgctggttaaaccggctcggcaacgaactaacaatcattcaaaatacatttgaaaaggaaaataaagaagccttagtcgactaccaaccgttaggaccgttggaaaacgtaatgctgaagttcaacgaagcggtgcgggagtggttgcctaagcagccggatggggacttaacggaccagattttgtcggtattcttcgcgtgcagcgtctatttgaagattgcggaatattatgacgaaagttaccgaatcatcattaaaaaaacggaagtcggaattaacgtacaggaacaaatcctggatcccagtccgtaccttgatgcttcactcaaaaagggacgcggggcggtctttttttcggctaccttaagtccggttgattactaccaggaaaccttgggaagcagcgatgctttatccttgcggatggactcgccgtttgagcaacgacagcaaaatatcttgattaccgattacattgacacccggtttgccaaccgcgaggaaagtctgccacaaattgttgcttcaattgatacgttagtaagcgctaaagcgggaaattacctgattttttgcccgtcgtacgcgtatttagaccagattgccagtgcctttcgcgtacttcgcccggaagtgcaggttgaacagcaaaataaccaaatgtccccagaagaccgaacggcatttctggataaatttcggaccccgtcggcaacaaccttggtaggctttgctgtattaggcggaatcttttcggaaggaattgatttaactgacgaacaattgatcggggttggaattgtcagtgtagggttgcctggactaagcgtggaacggaatttattgcgggattatttcgacgaaaaaaacggccacggattcgaatacgcctatcagttgccgggaatgaatcatgttttgcaggcggcggggcggttaatccggacaaaacgtgatcggggaaacgtggtactcatggatcaacgttttgcgggttatcggtacttaaagctatttccgaaacattggagcaattatcgccaaatcagttcgatttttgacctaaagaaagcggttaatggcttttggcagcgttaggtaaaacgatttaccacaaattggaacggaccacaatagcaattgattggattttgaaaatcttttcaaaatctttagattttttatttacatactaaatatttgccgttatgattattacaacatctgttaataaattggattgtaagagggagatattcggtatgtatttagcagtaaatgtgattggaataatcgtatttttgggcgttgccgtcctattttctaaagaccgcaagcatattgattggaaatcagtcggtatcatggtggtaattaacattgtgttagcttggttcttagttaactctaccgttgggattaacgcagttaaggctgccgcggatggatttaaaggtttagttgatatttcgtataaaggaatttcctttgcacttgctgattgggtcgacgtaaagcaaatgaactttgtaacgagtgcgttgctaccaatcttgatgattgtgccattatttgatattttgacctacatcggcgttctcccttggattattaagtgggttggtaagggattatccttcattactcgccaaccaaagtttgaatcattctttgccgtagaaatgatgttcttaggtaatacggaagctttggcggtttctggtttacaattacggcaaatgaagtcggcgcggttagttacgatcgcaatgatgtcgatgagctgtgttacggcttcaattttaggttcgtacctattaatgatgcctggtcaatacataattgccgcggtgccaattaacattatcaacgcaattatcgtcaccacggtgctcaatccagtttcagtaacggaagaagaagatacaattgctaagatcggtaacagtgccgatactggagcaactacggaaaccatcgaatcaggttcagaagaagttgcggaagaaaccgttgctaagaagcctgctcgggaaccattcttctcgttcttaggtgattcaatcttaggcgcgggccgtttaatcttaatcattacggctaacgtaattgccttcgttgctttggcagcgttgattgatgctttattaggcaagattaacccagcactttcactagaaaacattctcggggtaattatgttcccatttgcttggctacttggtttcgatccgagtcacgctttccaaatggctcaatacatgggtactaagttagttactaacgaattcgtggttatgggtaaggtttcaccaattttgaaacacttcacaccacatttcttggcaaccctcaccgttttcttaacttcgtttgcaaacttctcaactaccggaatgattatcggagcgttcaagggcttagttgaccgggaaaagaacgatgtaatttctaaaaacgttggttacatgttgctttctggaattttagtttccttactatctgctggattcatcggcgtattcgtttggtaaactagttcaaaactaaaaaaagaaaaaagatggactcggagttcatctttttttagaatggtaatgaggacgctttcataaaaccttgggaggtaattaaatgacaacaaaaattattatggatactgatccaggaattgatgacgcagccgcaatttcggttgccatcaacaatcctgaaattgaattagaattaatcacgacggttgcgggaaacgtaacggttgataaaactacaaaaaatgctttaaaactagttaagttctttaatgcggacgtaccggtggctagtggtgctgaacaaccgcttttaaagccgtttgaagatgcggctcgggtgcacggtgaatctgggatgccgggctacgactttggtgaagaacccgcagaggtaccggctaacaacgcagtagaagttctttaccaaaccattatggctaacgatgacccaatcactttagtgccgactggttcatacactaacattgccttattattgaaggaacatcccgacgttaagggcaaaatcaagaaaattgtcgcaatgggcggcgcaatcggaatgggcaacatgaccagtgcggctgaatttaacgtctttacggatccgcatgcggctgaaattgtctatcaaagtggaattccagtagtgatggtcggcctggacgttaccatgaaggcgttgcttacgccagaaaccatcgctaccatcaaaactttaggcaagccaggggaaatgttgggagcaattttcactcactattacgaaggtaacgaaggtggaattccgatgcacgacgtaaatacgttagcgtatattttgaatcccgagatgtatcaaacggaagcgtactgggttgacgtggttaccgaaggacccgcgattggtgaaacggttgccgatatccgcggtgcttaccacgacggcaaaactaacgcagaggtatgtgtagacatcgatgcagctgctttcaataagtggtttattgcggaagttaaaaagatgcgtgcctaaatttatgccaaggcgtgaggaaagccgtacgttactaactaattaattaagcaagccccagctacgtgtgcaatgtagttgcgggctttttgtgttaaaaagctccttaatcggaaagtaagtctcgctcaaggacgattgcgtcgcgaaggcggaggttattttcgtaaattggctcaggatagtaagctgagttaacaaaatggttggtcaacactttgacacaacggaaacctaatttttggtaaaggtatagctgtgtaaaactagttgaaccagtcatgatgcgcaatttctggattcccgtcttaggggcgtgctcaatcacgaattccagtaatcggctagcaaaatgttgtcgctgaaatttaggcgtgatggccagattcataatttcagcagtttggttagtgagcgggcgtaccacaacgaggccaattaaacgttgaactgcgaccatttcaaaagcggtactacgagataggtagctggcgatgcttttcagggagggatcggccaaaagtaacagatcatagtgttgtggggtaaacgcgcttaccgggcggatggttggttgcatataatccttcctttcaagtataaattgacttattgccaaaactgggggaattgggtaaagtggagttaggaatatgaaacaattaatgtttcacaaggagagaaaagatgaatccagaaaaatttcgtcaagcacttgccgaacgagggtggacagtgagtgaccaccaaatgcggcaatttgatacctattataaacgattagtggaaacaaacgaacacgttaatttaaccgcaattacggacgaaaaggaggtttacctcaagcatttttacgactcggtaactccgctattagaggcgccacaatttttcactccgggaatcgcgttatgcgacgtgggcgcaggggcaggtttcccatcgttgcccatgaaaattttgttgcccgaattgaaagttaccatcgtcgattcattaaataaacgaattaaatttttacaggcgttggtagatgaactaggtttaactgatgtggaattggttcatgaccgagctgaaacgtttggtgctaaaaaatcggcgtaccgggctagttttgcactagttaccgcccgggcagtggcgcggttgagtgtcttaagcgaattatgtttgccgttagttaagcaaggcggccactttatcgcgctcaaggcggcccacactgaacaggagctggcaaccggacggcaagcaatcgcggttttaggcgggaaattattagaagatcggcaatttgctttgccggtgaccggcgacgaacggcatttagtggtaattgaaaagaaaaaggagacgcccaacaagtatccgcggaaaccgggaactccaagtaaagatccaattggcgagaaatagaaggttatcatgaatgagaaacaattagaaatacaattgaacgttccagaaaatgctagttaccagatggtggaagtggataagattcgtcccaatcccttccagccacggcggatttttgataagaaaaaattagcggagttggcagattccattagggagtcggggattttccaaccgttagttttacgccaaccaattgcagcgattgagcgttacgaaattatcgcgggtgaacggcgctaccgggcgagtatcattgcgggattaacaaaagttccggcaattatccgtgatttttcggatgagaccactcgcgaagctgcgatcgttgaaaatttgcaacgcgaggatttaagccctttagaagaggccgaagcgtatcaagcaatgattaaggaactgggattgacgcaggctcaagtttccgagcgtttaggcaaaagtcggccttacattgccaattacttacggttgctcggtttgccaacttccgtgaaggagcttttacaatcgggaaaaatttcaatggggcaggcgcgaaccttattagcagttaaacaagaacggcaactagaaaaactcgcccaacgtacggtgcaagaagggctgacggtgcggcagctggaaagcattgtcaaccagatcaacgcaacgaaagcgcctaaggcagaatctaaaacggcgcaacaacgcaagtctccgttcattagggagattgaaaaccagttggccgaacgtttaggaacgaaaacgttggtagtggcccactcaaaacaaaagggcaaaattgaaattaattacgaatcaatgagtgatttaaaccgtattttggaactattacatatttcactagattagggaggaagttatcatggaatacgatttgcacaacgttgtccaaatgaagaaaaaacatgcttgtggcacaaaccggtgggaaatcattcgtttaggaatggacattaagatgaaatgtttaggttgtcggcacatcgtgatgcttaaacggcgggaatttgaacagaagttgaaaaaagtaattgccgaaatgccagacgaaaacgaacgttaatatttggaacgagtaattattttgcgtaagcaatggacagaacacattatcagccactttcaattggatattgaaggatgagatgtgttcttttttataaggtggattgccgttttaatctagtcaccacctattatctagaccacttttttgataccatagaaacaagaacacgcaattttgaaaggaaagtgtaattaacatgtcattaacagctggtattgtgggcttgcccaacgtcggcaagtcgaccttatttaacgcaattacgaaggcgggcgccgaaatggcgaactatccgtttgcgacaattgaccctaacgtggggatggtagaggttcccgatgcgcggttagcacggattcaagagatcattccggcaaagaaaattgtgcacaccacctttgaatttaccgacattgcgggaattgttaagggagcaagtaagggagaaggtcttggaaacaagttcctagaaaacattcggcaagtggatgcgattgttcacgttgttcgtgcttttgatgacgacaacattacgacggtatctggtaaagtcgaccccatcgaagatattgaaactatcaatatggaattgagtttggcagacttagaaagtgttgaaaaacggttagctaaggtgcaacgggcggctaaaggccgtgacaaggatgctttggcagaattggcggtgctcgaaaaattgcatccggttcttgaagccggcaaaccagctcgggcagtggaattcgacgaagctgaaatgccaattgtgaagggcttgttcttgttgaccactaagccagtcctttacgtggctaacattgccgaagatgacatggccgatccagaaagttccaagtactttaaagaaattaaggattacgttgccgaagtggatcccgatgcccaagttctagggatttctgccgaaacggagcaagaaattgcggaacttgaagacgacgaaaaggctgaattccttgaagcagaaggaattgaagaacctggcttgaaccgtttgattcaagcttcttacaacttactaggcttgcaaaccttctttacggcaggtggtaaagaaacccgtgcttggacattcaagaagggcatgacggcaccgcaaactgcgggaattatccattcggactttgaacgcggctttatccgtgcggaaaccgtttcgtttgacgatttggataagtatggcagcatgcaagcagttcgggaagcgggacgcttgcgtctagaaggtaaggattaccacgttcaagatggcgacattatcgaattccgcttcaacgtataaaattactggatgaggagcaattaaacatgagtgaagaaccacgtaacgcgggtgcacaacagcggcatccgcattctgaacatcaacaatcgacggaattaactaagcgtaacgccgattttatgcaccgtttgcgtaaggaattacaggcaagcaaattaagtgacgaacaacgccaagctgcgttaatcgacacggaaacccaattgttagaaggacaaaaaacgggaacgaccgcaaaacaattgtttgggaccccaactgaccggtttaaagcaattgtggaaggtcctaaaaaggctaaaatggaagctcaaagcaataacatctggcttcgcgccgctgataacggccttatcttcatggccctttttgcggcaatgtacgcgttaatgatgttgatccaaccgaagtcggtgcaggcagctcctggaccagctggaattttggcaattatcttaacttcggcagtcggcggattggggattgcctatatttatcggttgtttgttaaccgtaaaaaacggccttctttgtggaagcaagccggaattaccgtattggcggtaattttgtggattattttctacacggcctttggagcactgccaccagcaattaatccgatgctgccgttggctggttacatcatattagcagttgcagccttcgctggtcggtggtatcttagacgaaagtttcacattgttggcggtttactataattttggataaataaaggagagtattgatgagtaattggaataataagtttacgaaacaaggattaacgtttgacgatgttttattaattcctggcgaaagccacgtgttgcccaacgaggcggacattacgacgcagttagcagataatttaaagcttaatattccaattattagtgcggggatggatacggtcaccgaatcggcgatgggcattgccatggctcgtcaaggtggcttaggggtcatccataaaaatatgagtgcggatcaacaagccgctgaagtacgaaaagttaaggcggcggacgttgattttgacgataatcctaaagcagcagtcgatgaccaggaccggttgttaattgctgccgctgtcggcgttactagcgacacgtttgaacgtgcggaagcgttgattgaagcgggcgtcgacgccatcgtaattgacacggctcacggtcattcagccggagttttacgtaaaattgcggaaattcgtgaacacttccctgaccaaactttaattgcgggtaacgtggctactgcagaaggcacccgggcactttttgaagcgggcgtcgacgtagtcaaagtaggaatcggacctggttcaatttgtaccacccgcgtggtagctggcgtcggggtcccccaaatcacggcgatttacgacgcggcaggcgttgctcgtgaatacggcaagcaaatcatcgcggatggtggaattaagttttctggggacattgtgaaggccttggttgctggtggaaatgccgtaatgttaggtagcatgctttccggaactgatgaaacgcccggttccatcatcgaagacggtgggaagaaatacaaagcataccggggaatgggctcggttggcgcaatggaaaaaggttctgccgaccgttatttccaaggtggcgttaacgaagctaacaaactggtaccagaaggaattgaagctcgcgtagaatataagggctcggttgccgcaatcattttccaaatgttaggcgggttacgttccggaatgggatacgtaggggctgccactatccccgatttagctgagaaagcgcaattcatccaaattactaatgctgggttggtcgaatcgcacccgcacgacgtacaaatgactaagttagctcctaattaccataaataaaaactgaacattcttcagaagccggggaaaactccttttcaggaataaaattttttggaaaatcattttggcgtgttgattttaagaaagccaaaagtcagtttgctccgcttgacctaaaatcgatcattatgccaaattcaaatttaggcataatggtcgatttttagttaatacgcatcaattacccgacttctagcacacgctctttttatccgctcaaaccttaatttctaggaggaaaatatggaaatttactacacatcgctaaccagcggaaccgctcgttactatcttggctctacggcagcgggattggcttttgtgggaacgccgaatgctgagttgactgaaatttaccaattttatccaaccgctacgttaatccaggatgagtcagctaacttgccggccaagcagcagcttgcggaatatttacaagggacgtggcgccagtttgacttgtccttggatatgaaaaatgggacggatttgcaacgtttagtctggcaagcattgttaaagattccgcggggaaccacgcttagttattctgaactagcccaacaaattaaccgctccggggccgttcgtgccgtggcaacggcggtagcgcgcaacccgcttttaatcgtggttccgtgccaccgggtgactttaaaaagcggtcagcttggtcagtatcggggaggctccccaatgaagcaccagttgcttaaattagaaggcgcttgcttataaggtcagtattttgctgtttttttaaggattactaaaaaaacgtgcttaaattcgggcatttatctttaaatttgctagactatagtaaatgagcgtaaattttaaaggggataaaccatgaaaattttagtagtcgatgatgataaggaaattgttgaattattagatatttacattaaaaacgaaggttacgaacccgtatcagcttacaatggtaaagaagcgttaaccaagttgcatactgatccggacatcaagctaatgattttagacatcatgatgccagagatggatgggatgcaggttgtgcgggaagttcgcaaagattcggaattgccaattttgatgttgtcagctaaaactgacgatatggataaaattaagggcttgctgaccggagcggacgattacgttaccaagccgttcaatccgttggaaattatggctcgggtcaaatcactattacgacggagtgaaaaggacgttaccgatgacgctcccgaaattttggacattggtccgttgacgattaatagtgattctcacgaagttaagactttggcgggcaaagcggtccagttgacggcgcttgaatttggaattttatacttgctagctagtcacccgaaccgcgttttctctgcggacgaaatttttgaacgagtttggcaacaagaaagcgtcatttccgcgaagacggtcatggttcacgtaagtcatttacgagataagattgaagaagcaacgggcggcgaaaaagtaatcgaaaccgtctggggcgttggttataaagtggtggcacactagatttttggggagcaagtgaatgaagttaacgggtcgtgaaaaatacgaattatttggcgaagggatcattaccattatccttttgctgttattaaatttatcagtttttattttgattgatggcgcgttaaaaacaaaccctgcattgtcaaatgcgattttcctagttaaaaattccatccgcattggtggaatccaaatttggagctaccaaaatatttttattgccataatgtttttagctgatctaggcgtgctgtattggcgactagaacgacgttacaaacaaatgcagttgcggcatattattgcagaattgcattacattgctaacggacactttgaccaccggattccgtttgaattgagcggggatcaccaacgggtggtggacagtgtgaattcgctagttgacagcgtaatcagttcgatggaagaagaacgggctcttaagcagtctaaggatgacctgattaccaacgtgtcccacgatttacggacgccgctgacgtcaattatcggctatctgcgtttaattgaagatcatcagtatcaaagtaccgatgatatccttaagtacacgcacacggcgtatttaaagtcggtccagatgaaatcgcttgtggaagatctgtttgaatatacgaaggttagtcaatcaaatccgaagttaaattacaataagattcacgttgactccatgttgcaacagctggcggccagttttgagctggaagctaagcaaaaggggtttgtaattacttcgacgtgcgttcccgaggatttggaaatgatgggggatgctgaaaagattggccgagtgttcaataatttgattactaacgcgttgaaatatggcgctggcggcaagcacatttacctaaacgcgcaccaaattaacgatacggttatttttgaggtggcaaatgacggacagaaggttcctgcccaagcgttaggtaagctctttgaccgtttctaccgggtggaagaatcgcgatccaaagcaaccggcgggactgggctagggttggcaattgcgcaaagcattgtcgagatgcataatggaaccatcgaggcccattcaaatgataaacgcactagttttatcatccagttgccgttaaagcaaccggtgcggggggcacagccaactagtaaatattaaaaaataaaaatagcgaagacgctagtggtcaatcgggctaattaacgtaagtggaatggtggaggccgttcgattaatggagtgtgaaaccaaagctgggtagtttgcgggcattaattgaatcccccattaatcgcgggctaggcgattggtggggatttggttaagtgcaacaaactgacttttgaagcacgttttggctctgttagacaacgatctccaatttttcagccattcgattggtggttaagttagtgaaaaatgggccagctagcgtttttaattacataggtattaaagggagtagaaatgaaaaaagtattattagtgatcgctacgctgctattatttgccactggagtcactccggccgcggcagctacgcaaacgtcgtcgttggtgaatccagagataacggcaaagtctgcgctagcgattgattcggaaacgggccaagttttgtacgagaagcacgctgatcaagtcttaccgattgcttcaatgtcgaaagtattgtcggcctacttaatcatgaaaagcgtgcaaagtggtaaaatgcggtgggaccaaccggtaaaaattaacgctgatatcgctaaaattagtgaaaatagcgaattgaccaacgttcctttgacgacgggaaagtcgtacaccgtcaaaaatctgctggatgcgtcgttaatttattccgctaacgcagcaatcatcgcgttgggaaaggcgcaagcgggcagttcgcgtaagtttgtcgacgaaatgcgtgccaccgttcgaagctggggaattaaggatgctaaattatataatgcagctggtttactagaaaatcaggttggtgctgaaaaataccctaactcacctaaaaatgctgaaaatcaaatgtcggcaaatgatatggcagtggtaatccaacacgtcttaaaagaatttccagaaattctgcagattaccaaaattcaaaagttagactttgacaccggcagtggtaaggtcacgatgattaaccataatgaattactacctggcggagcgcagtatgacaaccggtatcaacttgacgggttgaaaacgggaacctcgctagcggcgggagaagacttcgcagcaaccggaaaagtcaaccagcgccggataattagtgtggttttaggagcgaaaacggaccatcgttttaccgatacgaaggcaatttggcaagctttgatgactaatttgacggtggtaaaaacgaacctgaaaaatcaagcttccgtagtgatggattcggctaagcagcggcaggttaagttacggttggcacaaccgttggcgtattggaaagctaaaaagggcggccaaatgccgaaactcgaccaggttaagctaaagtccacaaaaactaaagctcccgtagataagaatcaggtgattgcaacgggacggcttactggcgcttcgttaagttttctaccaaataagtctgcgcgtaaggtacaattaaaaccggtacacgacgtgcaaaaggcaagttggtgggtccggttaggtcgcacaatttccggatggtttcactaggaaatttgaaaagataatgactcatttttgaaatattaaggcgagaaatcaagtgaatcgtgctcaccaagcgcgtgatttagccattctaacggggttcgcaggttttccaagctgctactattaaaaaccaaccttgcatgttaaaattagttcgtatgctttgcaaaaaattaatatattcttaaaagatctaatttttttgggaggacaaactttggaacaagttgaaacaaaggcacgttggaaggaaaccttcaaagttgcgtggccgctttgcttaagttacacaccaattggcttagcatgtggtattttattgcacgcagctggtttcaatacgttgcttaccggtttagtttctttggttatcttttccggaggagcccaatttttaattgcacagatgttaacggtgaatgcaccgattctaacgattgttttaatgctttttttccttgaattgcgttatgctttactaggatcgagtttgtcgaagtatctacagggagaaagtcatacttcaatatttacattcgcgctttcattaaatgatgaaaattacgcggtaaattatttgaaatttgctacagataagaattggacccccaacgacgcccgtcaagttgaacactggtcattactattttggaccgtggctaacgtgattggttcgttaatcgggagcgtcttgaaaattaatttgaccgtcgtggattttgcgctaactgcacttttcatttacatgattgtaatgcaagtgaagtctcgactatcattagtaatctgcatcttttctggagttctcgcagcggtttgcatgattgttactaagagtactttaggattagtaatctcaacgctgctagcttccttcaccggttttttgacggaagagttattggttaaaaagcgaccaaccagtatgtggctgcaagcaattggttcacgtaagggcggaccgattatcgaaaaaattgataagaaagaatcagatattctttaagtttggtaggagaaatcacctatggagttcagttcatttgatcatttattgattataattctcggtttttttgtggcttttgctccacgatatttgccactactgtttttttcaaaacgccagattcccgattggttcaacgattggatgaaatacgtgccgatttcattgtttacggcgctcgtcgtgaagggaatctttatttcaagtgactatactttgattacgtcaggaaacttagcgttaatcttaggcgcactagtagtaattatcattgcctactggacgcgttcgatggccgtttccgtaattgttggattggttacggtaatgattttgacgttgattatttaaataagactaaacaaaaagccgggaatttttcccggctttttaatttcaatgatgttagggtagtcgttattcatcgcagacattgttggttatgaattagcggttaacttgaataatgcgcctttggtttaatctttttgcatatgcaagatggggtaatggttgccttggccatctaattcgcttctttggtaaaccctaaatcccatatgttcatagaatccctttgcaaggggattctgctcgtttacgtcaagtttattcactgcataattggttattccatattctaataattgcttacctagtcccttaccacgatagccagcggagataaataacatttccaaaaaatgatcgttaatgcccataaaaccgacgggttgtgcatcgtcattttcaacaacgattaggtgcgcaacgctagtcaaagcctctggaatgtaaccctttattttttgaatttcatcatttgacaaaaataaatgagtcgctttaacggaactttcccacacaactaagagattttgaattaatttgggagaaggggcatttatttctactattttcatgttaacgtcctactttcaaatgattaacttgatagtaattctattggttttttgtcgaaaagtcgatgttgcttttaagactgctgcatagctgaaacaaactttaaaccccaacttcttccagttaactaaattaagggatcaatcgcataaaccgcgattaatcccttaatttttccgcctttttgcagcatggttcgaaacgaactccagccaccaatcttctccggttagcaaaaccataaaactaatcgctaaaaccacgattaatttcatgaattttcgttttttgccgcgtagctgaaccgcgttctaaaacccagctctctccggttaaccaaattaggggaccaaccgctaaattcgtggccggtcccctaattcagttatcctcaagagctacccaggttttagaatgctctatttttcatacatataatctcgcgtcattggaaggacccgaccacttgctcccttagttagcaagtattggattacgtcaatgttgccagattcaaacgaagccgcgcatgcttgtaagtacaaatcccacatccgaacgaatttttcgtcgaacatttcgcgtacttcgtcacgatgtttgttgaagttagcgtcccaaatttcagtagtccgttggtaatgccgacgcaatggttccatatcgtcaatttggagaccactgttaacaatgtgttcgatattttctaccaaaccaggtacgtatccacctgggaaaatccacttgtttagccagccgttgttagccccgccttgttgccgggtgattccgtggatcaatgcgaccccatcatcctttaagtacttagctacgttatcaaagtagatccccaagttttcctttccaacgtgttcaaacattcccacactggtaatgtagtcaaacttctcgtcgccaagttcccgataatcttgaagtcgaacttctgcgaccccgctaagtccttcttcttggatacgttggttgaccaagtcgtattgttcttggctaagggttacaccgactacctttaagttaaattctttagcggcagtaagcattagggttccccaaccacaaccgatgtctaaaagagtttttccaggttgtgggtttagtttccgaataatgtggcgaaccttattcatttgtgccgtttccaagctatcttggtcgctttcaaagtaagcacaagaataagtcattgttggatctaaccataatttatagaagtcgtttccaatatcgtagtggttttgcacatcttctttactttccttttcgccgtggccttgtttaggaagaaagtggatgaacttcttgttgtggaaaaagctgtccgcattttcgtaagcagaagtaattaacttttgtaaattaccatcgacggtgatcgtaccatccatgtacgcctccccaagggcgattgaagcattcttagtaatgcttttaatcggaatggcctttttaaaagtaatggttgcttggggttctcccgttccgtaaactgcggaacttccatcccaataattaactttaattgggatattgaatgaacgttttaaaaacgttttataaaattgtttctcaagcatgattcaggtcctttccaaaaatagttatacaactgttataacgtgtttgggtaaatatttcaaatgagaagctaatgaaaacgaattccctaatatgggtaatgaagccttacgtggtataattaagcagacacctgaatggggaggaataccgatgaaaaagtggatttgggcggttctaatttttttggtcgccggagtggttggtgggtactcagttgctcattatcacgaaaatgaactgcaatatcaacgcaacatcaccaacggacaaacggcgattgcccaaaaaaattacgcggctgccaagaattatttttcacgggccctcacaaagaagaaaaatgatcgggaagcaaccaacctcctcgaccaaactcggcaatttacccgcgcagaatctgaatttaaaagtaatgaatttaccagcgcgcggttagattaccaaaacgtgctgaaaatttcagacggctctagaacgttgaaagagcgtagtcaagcgcggatcaaattaattaaaaaaattagggctaattttaaaaaattcagtaaacaactgaagaaagctaaaaaattgaacgcggcgtgggatttttatgcgtcaaatgcgcagttagacttgctgcttagcaacgaagaatttaataagggatattatgaaaccctccatgatcaggcactaacgctgcaacggtttaataatgctgggatcgttgctgaccaaggagctttcaatagtgatacgacgccggacaataaccaaggggcggcaaataaatcctttaagccaaaggtaaagccacgctacgaagggccgactaccaccaaaccggcggcgcctaaaaagaaacctaaggacagttcttctaaagacgattctaaggataagccatcgaacaaggaatcaagcgataagccagattctgatgattcaactaattcttcatcggaaacgagtagctctggcagcagtaaaccttctcagactgaaaaagaagctgaaaacgctatggtcgaaggtccttccgcgtcctcacaaaaataatttttggcgcagttgtatttataaaattgcgcaaattttcaaaaagcgggttgtaaaaattactaagtggaactacaatatggctgtaactaaataggcgatgacgttcgccgtaaaaataattaaacattaatttgatgacgtctgttatttctaggaaattcctggggataataggcgtttttttttgtttaagagggggaatttagtaatgacactagttattgaaaatgttaaggcacgcgagatcttcgattcacggggaaatccgacggtagaagttgacgtaacgctgtctaacgggatcatgggtcgggctgcagtaccttcgggggcttctactggagaaaaggaagctgtcgagttacgagacggcggtaaacggttatctggcaaaggggtgctaaaggcgattggcaacgtaaataacaatattgcggtggctttaaagggggttgatcccttcaaccaggctaacgttgaccaaataatgattgatttagacggaactaacaataagcgtaaattaggcgccaacgcgattttaggcgtttccatggctacggcaagggcggcggccaatgcgctccacatccctctctaccggtacttagggggaactgatttagaactcccgcaaacttttcataacgtaattaacgggggcgagcacgctaataaccaaattgatattcaagaattcatgattactccggtggaacgaactagtttccgggaggggtttgaaaaaattgtcaatacctatcacgtattgaaaaaaattattgccgatgcgggttattccactgggctgggggatgaaggcggctttgcgccggatttaccttcctcagaagacgctttaaaaatgttacacgaagcgattgttaaagcaggctacgttcctgggaaagaagtggcgattgcttttgatgcggcggcctcctatttctataatcgagagaccaagaattacgattttgaaggtcggacgtacacgccacaagagctaggagagtactacggtaagctgctaaacgagtttccagaaatcatttccatcgaggatccttacggggaagaagattgggacaactttagtaaatttactagtgaatatgggcaaagagtccaaattgtggctgacgacccggtctgcacgaatccgcgcttgattcgggaagctatcaaaaaagggatggcaaattcaattttaatcaagttaaaccaaattgggacggttacggaaacgctcgaagccatccgggtagctcgcaaaaatggctatgccacgatgatgtcgcaccgttctggtgaaacggcggatacatttgttgcggactttaccgtagccacaaacgcagcgcaattaaaggcgggagcaccggcacgctcagaacgggtggaaaaatataaccagcttttgcggatcgaagaagagttaggcaaagctggcacccggctagcacactttcctaaccaaattgatctcgattaagaaaacttctttattttaggtttgtgcttagcggttaaaaattgtaaaattagaacgttagaaatttatttgaagaaagaggtattcaaacgatatggcaaaattagttttgattcgtcatggtcaaagtgaatggaacttatcaaaccaatttactggttgggttgacgttgatcttagtgatgaaggtgttaaacaagcaaaaaatgctggtaagttaattaaggaagctggtcttgaatttgaccaagcttacacttcagtattaactcgtgccatcaagactttgcactatgctttggaagaatctgaccaactttggattccagaaaccaagacatggcgtttgaacgaacgtcactacggtgcattgcaaggccaaaacaaggctaaggctgctgaaaaatggggcgacgaacaagttcatatttggcgccgttcatacgacgtacttcctccattgttagatgctagcgatgaaggttcagctgctaacgaccgtcgttacgcaaacttagacccacgcatcatccctggtggtgaaaaccttaaggtaactcttgaacgggttattcctttctgggaagatgaaattgctcctaagttgcttgacaacaagaacgttatcattgctgcacacggtaactcactccgtgctttgagcaagtacatcgaaaacatttctgatgaagacatcatgaatcttgaaatggcaactggtgaaccagttgtttacgacttcaacgacaagcttgaagttcaaagcaaaactaagcttaactaattttatttagttgagttggcgaaaagactgagggaatttttcctcagtcttttttttgttagttaagtttagtgtgttgaagttaattcggtagtatctgattgcttagctttatatcgattgtagagattgttgccaactaaagcagtaatggtgatgatgcaacccgccacctcaaataaagaaacttggtatccgttaacgattttaattataaatgaagtaattggtaccaaattcataaataaaatgccgttaatcggagtgatgattcggttgcctaagttccaagtaaagactgctatcactcccgcaaaagtaaccatgtaaatcaaagcggtgtgcacctcaacaatttgatttaaagatggaaaatgtaaccaacccaagatggtagcaatggttaacgtaataattactgaacatacgcctaataaagctgttaacgttgaatagcgtaaaatagaccattcagggaaatcagcacctccagcggtatagattacccagcataatgcgcctaaaagaattaaagttactgctaataaagtgttttgtcctgaaaagagcacggaaaagttgcctttagtaacaaccataaataccccaatggcggctactatcattgagactaaggatgctaacgtaggctttatgccgcggtaaatccaagcaacgagaacacctagtaaaggctgaattgccatcattactgaggcgatgatggaaccggaagcacccgcaagctgttggcctaaaaaaactagaaagctgaagcctgcaaatgctgcagtaccgaagacccataatttaaaaacgtggccttcagttttaaaagcgtgcgcaccttccgtaatgaataagatcaatgcaaaaataattgcaacactaccgtagcgaaaaagggtgaagtaaaagggatccataacttttaaggcaggttccataatgggaaacattccaccccatgaaagtactgatattaaacatagtaatagtccaagcgcatattttctggtcataattattctccttcatttgttagaaaagttgattaatatttatttaccttatgaatggatattaaacctatataatctttttaagaataaacgaaatggtatatggtattataagtttaaggaatacagtgttttaaaatggaggtgagcaagcaatgattggtaacgatgccctcaatctggaacttttatatatttttgtgaaggtaagcgagttaaaaagtattaatcaaagtagcgcatatttgtcgttaacacagcccgcaatcagtaaaaaaattaaacagcttgaagaatattatgaacaagagttgtttataagaagttctaaagggatggccctaacccctattggacagagggtttatttggaagcaaaacagctgatttctcaggtagagggattgaggaatgcgattcgtcaaaaagaaactaaagttaatgaattacgtctggggactctagatagtatttcgtcttatttgtatcctaacttttttgtcaaatctttaaatgcgtttaaatcaactactatcactaataggattgatgaattgattaagccctttaatcgaggaagtcttgatgtaattttcatggattcagctttcaaagatgaaataaatggaatttattcagaaaaagaggtagatgaagaaccgtattttctggtgtattctaaagataatccccttattaaccttgataaggagagtattgatccatgcactttacaaaaaatggatttgctaatgtatcctaaatattgtccgattcaccaacgtttgatacgggtttaccaagatttgcaaataaatcttcctaaaattgtagaaattgattatggtgaatcgatgattgcgatggtcgctaactccaactacataacggtattacctaagtcaatcgcaataaataaagtaacggcagacatatcacatttgaaaatgaaagaattcgaagtaacttttacaagaaaaatttcattgttttctcgagatgctcatgtaaccgaaatggttaatcgcatgatgaaataagaaagagctaaaagatgataatttatgcgcataagctaagttaacttaacttagcttatgggatgcgttgtaattaacactaaaagtgtttatcaagttttgcagagataatatattttttgttagctttgttgcatttgcacctattttgttagataatggctgtgaattaatctgtaagtattaagaggaggaagtttaatatgcaaccattaatcgttgatgatcaaatctgggaattatttcccgaagcgcagtttcaagtattggtagcgcatggcattgataaccatctagcggctatgcaaacggaacactatcaagcaatgttagacaatgccgttaaagaagcccagaaatttattactgatgatgtttttcggaataacccagtgattagtgaatggcgggatgcgtttaccaaatttaagaagaaaaaaggcgcccgttcgtcaattgaagcgttgctcaaacgagtttcccaaggaaaatcgcttagtccaattaacccgttagtcgatatttataatagtatttcgctcgaatttggcgtgccgtgtggcagcgaagatttacaaaaaatggatggtacgatgcatctcggagttgctaagggcggcgaaagtttccggccccttggagtagaagaagatgagccagcgttgccaggggaagtcatttattacgaccaaactggggctatttgccgctgctttaattggcgtgaggctcaacgcaccatgctaactgatgaaactaccgatgcggtattggttatcgaagcggttaacgctgaccaagcgcaacgtgcacaacaagctgctgaagaattacagcaacggatcaaaaccgagttaggcgtggatgcggaacgtatggttttgaagaagtaaccttggctaattttgctaagaaagtcgggttaagtatagtaaaaagacttttgacacgtgctttgagttcgaattgaaagtcaacaaattaaaaaggtttctcaagatgtaaaagttttgagaaacctttttttggtacggctcccaatattaatccgattgataagtaaacgttataaataacgataaccaataaatatttaacatagttaagcgggcgccatatactatgaatattggaagttaagtaagcttaatgaaaagagatgtaagaatgcaaaaaataaatgaaaactactttgaaggagaacgatcactgtttaatgctcgtgatttaataattgaacaagctacttttggcgaaggagagtcgcctttaaaagagagtcaaaatattgaattaatagataccgtatttaagtggaagtaccccctttggtatgcaaagcacgttaaaggagaaaggataattctagagacgatggctcgctcgggaatttggtatacgaacgatattgaacttaatgattcaactcttcaagcaccaaagcttttttgagtgtgcaatcaagttaagctaaataatattcatttttcagatgcgcaagaaaccctttggaaatgcaaccaggtaatgctgaaaaatgtgcaagctaatggtgattacttcgggatgaatagcaccaatttatatatcgaccatttggatttagtgggtaattattgtttcgacggggctaaaaatgtggaggtgcacaattcgcgactggtttctaaagatgccttttggaattgtgagaatgtcaccatttacgattccataatcagtggtgaatatttagcgtggaatactaagaatttaactttaattaattgtacaattgaaagcgaacaagggctttgttatgtagatgatttaaaaatgattaattgtcgggttttgcggactaaccttgcctttgaatattgtcggaacattgacgcagaaattactactgatgtaatgagcattaagaacccaatcagtggaaatattcgagttgcatccgttggtgaaataattatggatgatccaacaattgatccacaaaataccgtaattacccaaacaacaacacggttaccgaaaggagcgtaacgatgagtgattttgatcagataatcaaccgaaccaaaactaattccattaagtggcacgttgctaaaaatgagctgcctatgtggatagcagatatggactttaaaacgagtcctgcaattgttcaagcattacaagaaaaggttcgagatggaatttttgggtatgaagaaattccgccggcatactttaatgcggtggcaaattggtatgaacgggtgcatggttttcgtccagatcccgcatggatgacgtttgcaaccggagtagttcccgcgctttcttcagcggttcgtcggctaactgctgtaggagataatgttttagtgcaagcacctgtttacaatattttttataattcaatcgtgaataacgggcgccacgtggtttcaagtgacttactttatgacgaaaacaaacacgtctaccatgtggattgggatgatttggaagcaaaattaagtgatccactaacgaatatgatgattttatgcaacccacacaacccgattggattgatttggtcgcgggagacgttgactcgacttgcccaactctgccaacaataccacgtaaaaatttttagtgatgagattcatggagacctcacttttaatcaaacaggctatacaccaatgtttagcttaccagcagaattgattcaaaacttggtggcggcggtttctccaagcaaaacgtttaacgtggcagcaatgcatgcagcaactgtgttggtaccaaacaaaaatttgcgcgcccaaattaaccgtggattgaatagcgaagaattggcagaacccaacttggtcgcaatcccgggcacgattgcggcttacgaaaaaggacttccttggttacaagagcttaaagagtacttggtcgaaaatcgcgaactagttcacaattttatctcgcaagaagtgggtccacgggtcgccttagttgagggacaagctacttatctaatctggatagacgtcagtcaggttacaaatgattctgcaaaactagcgaagtttattcgaaaagaaactgggttaattttatcggccggaagtgtttatggtggcaatggaaatcactttttgaggatgaatgtggcttgtccaaaagaacgcctgcaagacggactgcaacggttgaaaaagggactaactgcttggcaatcgcaagctaaacgtcgtatgtaaaaacgtggaataagcgttaatcatgttttaaaattaatcattttgcaaaagaaaagggctcttcgaggaagaaattttctcgaggagtccctttattttttcttagctagacagttaattttcagtaaaagtgcagacttaagattttagataattagctaccaattcctgattttcgggccgttttttgacttcgttagttgcaatatcctgaatgacgtcggccaaagtggttttagccatttcgtcttggacaactttttgaaaatgagcgtattgagcgtttaaagcatcttggatgttgccgcctaccacgcagtccgggttcgttttggggtcaacttgaattaaattcgtgtcggcctcatcaagactgttgaaaatgtctaataaagaaatttgttctggtgcccgggttagcgctggctggggcttacccacggtggttttaatcaatccagcttttttaagtgacgccataattcggcggatgttagacgggttggtttccacactggctgcgatggcctgactagtcaacggggccgtatcgtgcagaatggcaatgtaagccaacacgtggatggtatcgctaaaacgcatggaatatttcattatcatcaactcccttctagaatttatcacttgacaatcagaattactacccttattataaacgtgtgatttataaatgtacagctaattagttaataacgaaagtgaggatttgattatgaatattttagtaacgggcgctacaggtaactttgggggatatgctttaaaagttttacaggatttagttccagaagataatctatacggccttgctcggactgaagagaagggtgctaagctaaaggaagcggggattaaagtacggattggtgattatactgattcggcaagcttgcaaaaagcttttgagggaatcgatcggttactctttgtctcgagtacaacggatggtgaccgccaagcgcaacatcgggatgtcgtcgaagcagccaaggcagcgggagtgagctacattgcgtacaccagttttggcaaggcaacggaatcaactagtccgctcgctgctgaccatcggtttaccgagcagcttattgaagaaagcggaattgcccatactttcttacggaataattggtatttggaaaacgaagcggcctttttagcagcgggcgctaaaggtggcaagttcatctatgcgggtggcaacggccaagctggctgggcacttcgtcgcgaatacgccgaagttgcggcacgagccgtttccggaaaatttgatttccctaaaatcctagaattaggtggttcacttcgtacttacgaagatttgggcgcagccttacggggagcaactggtaaagacctggaagtgatcagcgcggatgaagctaccgctgcaaaaaacctcgtcgaaaatgcgagagtaccacaaaacgtggctgaactgttggtttcctttcaacaaattgtcaaaagcggtgctttagcagtgcaacctgacgattttgaaaaatacctcggaaagcctttaaccccaatggttgacgcgattaaagaagtcttggggtagtagtttttatcacgagtaataaaaaagatgacggatcgaattagaaaattctgcaccgtcatctttttgtttacagaaaattgaatggtcgaagttacgggttagccgaactaaacccgattattatagcaatttaaccggggcttaaagtggtccttttcatcaaggtgaatttgatttagggttacgttttgaacaatgccaaattcagctacgtcaacgttgaagatggctgcaaaaattgcccgagttgtcatcccatgacaaattaatagtacggattgatcagcaaactgctgtttaaggtcttcgacaaacccgcttacccgcgcaaccagtgcggcataactttcggaatggggcgcgtagtcagcgtacttggcgttgaacataccaagacggtcaaaaacttcgggatgcttgtcgtaaattaatttttcggagaccccgtcccaatcgccaaagtccatttcagtaatccggggatcataggtgagcgcagcatcatcacctaaaagaatcttcgcggtttgtttagcacgcagcatgggactgcaaaaaacgtggtcaaactggtgccaatcgtaattttgactaacttccttagcatattcgattccggccggggataaaccgacgtcggaacgggctccggaaactaatccgcgaccgttatcttgactagtactgtgacgaacaatggttaaaagcatgggtgaatcctcctcaatggtctgataatgcgcttacatttctatgatacaagtaatttagggaaaatgaaatcgtttggttaatttttaaccggagttattttctgcacccgacgcaatccacgggaagtaacgcggtaaagcccggttttataactttgatgataggtcttttgcaacattaccgtaaatgtgcggtgccattctggtaaagctacgtattggtaagcggcaacggtctttttaaaagtagccggatccatcataaagttctcttgaccaacgactttatcggaaaagaagtagtaacggccaacgtaaccggcatagtagttattaacgtcgttagtgtgcgggtctaccagtaaaattttacggtgattgtaagtcatcgaaggttgggcaatttgttttagttgaactgggagctgttctttacccaaggtgttgttatattcgattccgtttatttctgaaaacattaaaatggtcgagaaaatcattagtaccaacgccgtaagctgataaagatttttggtaaacacgtttttaaaggaacgaaccccccgccggccaattctttgttcgaacatcgtttggtccataaccacggctaataccatagcgcctagcagaagatttaaaatcaccatgcttgataggtagcgctctaacccatcaagttgaatcgcttctgcatagggcatggaaacgaggtacatggcaaatacgctaccgtagtaaattagaaaactaacgtcgatagcaaatagtgtttttagcaatggatttttatggtgcataaggaaagtaattacaatccaaccaattaataaaccagcgttaattagcaaaaccccccgggtcgatagggcatgccaatttaatatttggtcgagaaagcgatggccaatcttgataacaacggcattgccttcgtgatgcaactgttgctggtacgcttgggtactaatttggtgcttagaaattgtcgtgaaggtgttatgaacgtgttgattccaccaaaaaaagggtagaaagccaattactgcggtaaacgcactcaaagccaagctgcaaaaccatcgttgccagcgcgtgccttcgcgattggttgcaagtgaatacagcaaataagcaaccagcattaccacgtacatggttccagaatttttaactaatagtaattcggcactaaaaagcgcggtgatgctgcattgccaaaggggatgttttcgttcggcataaattccggcaaatccagctgcggtaactacggaaaggacaaaatcaaccagtaaattattcatacgaattgcgatgttaaaaacatttattatcgcaataatgaaacaaagaaagaaaccgttcattgaacgggtacggtcgcgtagaacggcaaaaagagcgtataaactagcccagattaataaaaattgggcaaccagcatggtcccgtcgttaaaaccaacccagctaacaaattcggtaatccaaagcgcggtcgcaggcggataagacgtaaaagaaatgattgaatcgcccgcaattggaagatgcccttgggtaagcagatatttaacaatgatggcccagtgggagtagttgtcatagtgaataaggatgctttgacttagcgtgtggagcacggtaagcccgattaccaccatccagacgtcaaaataatgaattccttcgaaaggcaatttaccaatttgaaggatgataaagatgagacgaaacaagaaaaaaacgcatccaacgaagacgacggagcggatcccgaaggaaagcaggccaaccattgccaaaatatagagaaggagggtctggataactatggaagtgatccaggacaaatatttatcgatccctgccatgcgtaggatgcctgcaaaaccaatttggctcaggataaaaaagaatgctccccataagttcattacgtttacccactttctttaagtaaataattacaaatcagtttaatagctttctttagtaaaatagtttaaatagtatgtattttttagagtaaacctcacattttaattctactcgttcgaggctaaatgtaaaattgagttcatttaatgttttattgtttaattactagttaaaattgaattggcgcccgttttgaagtatgataaacgctagtgtaactaaaaaactatgttatttttaagccttaaaaaataatcataactatacgttctttaatacattaagtcacaaaaaaaacatagttttttcataattaaaaatagatatcggaggaaaccaatgaaagcttacggcatcttgattccggcattaaatcctgatgaaaaattactcgatttaattcaggagctgttagaaagttcggttcccgtacaggcactcgtggtcgttgacgatggtagtgaccagcaggcgcagccgattttccaacgtcttgcagatatggaagatgaacgtattcgtatactgcatcacgaggttaatcggggaaagggagccgcgttgaaaacgggtttcaagtacactttagaaaatttcccacaaattcaggggattgctaccatggatgcggatggacaacatccggtggatgcattagcggcttgtattcatcagtttgaaaagcatccgcaagacttaattatcggtgcacgtcaatttacaaatcaaatcccatggcggagccagtttggtaacgtattaacgcgtaaattagtgcgcatgctcactcggcaaaatatttcagatacgcaaactggtctgcgggtgattcctcgaagctacgtgaggcaattacttagttttccgggagaacgttttgaatttgagtttgacatgttgcttcgagcacggaagttccaggttaagattaccgaacaaccaatccccacaatttatttagatggcaataagtcatcacactttcgggtggttcgtgattcggtcgcaatatacgcacgttttttgaaattcgcgatgagcgggttgatttcttttctagttgatgtaggattgtttgaattaatgattgttttgatgggaaaagaattacttggagaacgaattatcgtggccacaattgtttcacgcttgctatctgcgatggttaattacacgctgaaccatcgggtggtatttggcaaacagggacgtcagaccgttattaaatacggggtgttgtttatcatccaaatgtttgcttccggatacctaactgatttagttacgggatggttaccacacagtcagggcagtgtcgcaccgttgatcgctaaaattgtggtggactttacgttatttattatcagctatcaaatccaacgtgatttgatctttaaggaaaagcgaggggctgactaatgccaaaaatcaaaaaaattagttatattttagcaattgttttgtccgttttgtacctgttatggcgggtgttttttacgattccgtggcacgcccacctctttacactaatttttgcgttgatgttggttggtagtgagattgtctctaactttacggcttacgtattgattgctttccggttaattcggcaaaagaagccggtcgattttaaaatcccggattttgatgatcgccaacccctcccggcgattgacgtgattatcgtcacccataacgaagaggtggctttattgcgtaaaaccgtgaatgcggccaaattcatgaaatatcccgaccctaagttggttaacgtggtgatcgcagacgatgggaatcgtccggaagttcgccagttagccaaggagtaccatgctaattacgttacgatggaagaaaataagcatgctaaggcgggaaacattaacaatgcattggaacagcttcatgcgccgttgtttgccatctttgacgcggatatggtacctttctccaactttttaatggagagcgtcccgttttttacggaaaattttgctgagttgcaagaagatcccgatcataccgtgccgttaggatttgtacaaacgccacaaagcttttataacgcagatattttccagttcaacctctttttgcaagatgcggtagttaacgaacaagactttttctcgcgtgacgttaacgttttaaacggtgccaatgggcatgctttatttaccgggtctaacgcagtgttcttacgggaagcggtcgataaagtgggcggtttccctacggatacaatcacggaggatttcgaattaggaaccaaaattaacagtgagggctataagagtttggcaacggtagaacccgtttcaagcggaattactccggtagatatgaagagtgttatcaagcaacggacgcgctgggctcggggagtaattcaaagttgtcgtaacctccacatctttttgaatcccaaaatcaacttaattaatcgaattattttgattaatacgtggctttactggtggtcctttttgcgccgattaatttatattgcggctccgattttgtacgctctttttaaagtgcaggtcgttaatgctaatttctgggtgctaatgattgtctgggcaccgggatatttcttgctgcactttgtactgggagatgcctccagtaatattcgtaacgaacggtggggagaaatacaagaaaccttctttgccccatacttatttttacccgtgttactggaatcaattggtattcacgccaaaaaatttaaagtaacggataaaaaagtacaattttcttggcgagacaaattgtacatcatcccgtacttaattttatggtcgctaacgttaattgcgattattaaatttaactggggaaagtgggggtcagaaattattgtgggaagtgtaattacattttggttggtaatgcacttcattaaccttagtttctgcctgtttatctcgatgaaacgagacattcatcgtcgtagcgaacggtttattcgccacgcaaatggtcgcatgcagttggcaaatggaaagtgggcggattttaaaacccgagacgtttcggatggcggtttttcgtttgaattggatgacgaccaaaatcaactagaaatgggaacggaaacgacgggaatcatctattacaaaaattatccaattcattttaagagcaaagttgtccgagtagtcgatactgaaccgaaatggtacggagtgacaattaatattgaagaccgtaaggatcaggattactacttagaactaacgtatgacggggaaaacaagttcctctctaaagaacaagataattggctaacaccgtttgaccaacttcatttgaacgtaattttgcgattgaaagaattagaacggtccgcgacgcgctttatgcggcgttcataaaagttagcttagaaatgtaggtaatggaaaaatgtcattttttggtttgattgtttttgcaatggcacagctaggatatacggggttaatccgaatgactggcgtaaacaagtacatgtcgtggattacggcaatggtcgcccaaaccttggcgttgtactttctggcaatgctaaatttattggagttcgggcttaaggccgtcgtgattgtgggttgtatcggactggttgtgcgggtcggcttgatcagttttaatcggggaaagctcccctttgaaggaatccattattttgacttttggatgctgtttttgggaattatgatgggccgcactttatatctcagtcccttaattcactacgataattattctcactgggccgtaacggttaagttcttattgtttcaagggcacttaccagccggaggcgaaaccttaatttctttcacgtcctacccgccggccgcggctttatggatcacggaatttgttagctgggttggttttagtgaaggcgccatgttagtgggacaattcctgttgatttgggcgggactatacgccctttttgctgcattacgggatcgtagtcgtactatgacagcattcttcttgtgtttcatcattgccatcagtaacgtttttaacatcgcaattcggatgaataaccttctggtagactttgttttgccagtgttggcggccgcggcttttgcgggaatttattcgtatcgtcgccatccgtggttacaatgcgtaactgctgggatttttagcgcagaactgttactaattaaaaattcggggacgatgtacgtggtgatgattggatgttatctgatgtactcgttaaccactaactatggcgttggtaagcgttggctacggatccggtttgcgtcatggcgaactgcacttactatggggctcagttatttaccctttttttggtggaaccaacacgtgcacaacacgtttcacgcagttactaaacatcagatcagcgcccaagcgtatcaaagtcagctgaaccacgaaagttctgccgtaatgggtcggatcagccaccaattcatccatcaaattttaacgttaaattccctgtctacgaggggtgttttattaattaacattggtttaatcgtggcctgggtggtgattggacttgttttacataagcgcactccgcttttaaaagtactattagccattgaccttagttttgtggtttattacgtgagtgtattggctatgtacctcgtttccatgccgtacaaggaggccattcaccttgatggactagaacgttacttatctagcatggtggttttaaacctcttcctagctgctttagcaattgcgatagcgatggatcgggcaatgtttgtacaagaaattcaaaaacgaggcgttcgttcgtttagttctctgattactaaaaacatttaccaattcacgacgcttgcactgatgatcttttcaacaattttgatgatttcagaaattgatggtgtggagtataataacgcgcatagtcaagaagcgctgccggtccagctgccccaaatcgccaagcagaccaccaagtacaaccaccaaaaagttttgttagtcgacccgcatcaagatgacgtagcaagttactacgcgggatacgttggaaaatattatttcttttcggacaacgtggtcgctcgtgaagatttcatgatgtcgccaaccgactttaaaaaattagttcaaagttaccaatacatcgcgcttccagaatggcaccgtacgtttacggtaatgttgcaaaagacctatcaccaagattatcgtactggattatttcgggtgacgcccgagggactagttaaagttaggcaagttaaaccataggcgctataattggcttaacgcttaaatgtgacaatgggtccttaaatgactaaattgattaaaaataagttgggtgaatttgatggattggcgtcgtaaaatccgcgaaatacttttgtttgcgctgattaccacggggatgagctggtgggtggcggactttttccctcatcagtttcaatttaactggggaattattgtcgtagtgaaccttatgtttgcaatcgctgtgttaacccgtaagcgataattgaaggccacggaacgttgtgaaaaaaattaagcgcaattgtggtcatttaaataacggtttatggtatagtagttatggtttttgaaaagagcactccgttttaaaaaagaagatatcaaaaattgatccatttttaattcgctgatattaaaatgggtcaatttttagcgtggagagtttgtttcaagttaccgaatttctaaaccaatagaaaagagggactacaatgtcagaaaaactcgatgaagtagataacaagagcttagatgagattaacggtagtattaaggtgccaaagaatgccggctttttcaaaacgttaatggcctataccgggccgggaatcttaatcgcggttggttacatggatccagggaattggattacgtcaatcgcgggtggtgctcaatttaaatatacgttgctgtcggtggttttgatttctagcttaattgccatgcttttacaagcaatgtcggcaaggttaggaattgtaaccggaaaggatttagcgcagttaactcgggagcgtactagcaaacgagtcggatttatgctgtgggtggttgctgaattagcaattatggcgaccgacattgcggaaattattggttcagggattgcgcttgagctattattccacattccactaattatcggaatcttgattaccgcagcggatgtattgattttgctattgctaatgcgcttaggcttccggaaaattgaggcgattgtagcgacattggtaatggtgatcttaattgtttttgcttacgaagttttcctttcggatcctagtatttcgggaatcattaaaggttacgtgcctgcaccagtaattttgcagaacaattcaatgctatatttatcattgggaatcgtgggggcaaccgtaatgcctcacgacctttacctaggatcttcgatttcgcaaacgcgtgaaattgaccgccgggatcgtaaaaacgtggctcaagcaattcgtttttccacgattgactctaatatgcaactatttttggcgtttatcgtcaacagtttgctcttgattttaggggcggctttgttttacggaaccgatagctcgttaggtcgatttgtggacttgttcaatgcgcttagtgacaatcaaattgttggagcaattgctagtccaatgttgagtatgctatttgcggtagcgttgctcgcgtctggacaaagttcaacgattaccggaaccctttccggacaaattatcatggaaggtttcattcgcctgagggttccgttgtgggtacaacggttggtaacccgtttgctctcggtggcaccggttttgatttttgcgatttactatcatggtgacgaagccaagattgaaaatctattgactttctcccaagtgttcctcagtgttgcgttgccattcgcggtaattccgttggtaatgtataccagtagtaaaaaactgatgggtgagtttgctaaccgtcagtgggtgaagtggtgtgcttggattgctacaataatattgattttattgaacatttatctgatcttacaaactttaggaatagttaaatgaagttaaaaatgaacttcaattgaagttaaaaattagttttataagcgggctgtcagggatttctggcagcctgttttttaggttccgtaactaaggaatcgcgcattaaaatgctttttgccagtttggtaaagcccacggattaattaattttcaggtgaataattaattattcattctatgagaccgtaaaatcttccaaagagatttacacacgcttgctttttttagtgtacactattccttaaaacaatttatcaatttaggtgtggttgacataatgaataaaaagaaagttacgatcaaagacgttgccaaagctgccggggtttccgttaccacggtttcccaagctttaaatgggaacggctctcgtttctctccaagaacgatcaaacggattcaacgcgctaaagaaaaactgggttacgaaccagattactttgcgcagcggatgattatgaagaaaagtaagatgatcggggtgttggttccggacattactaatccctttttcaacagcttagttcgcgggattgaaaacgtattataccaatatgatttcatgacaatgctttgcaacgcggatatggatcaaggcaaggaagaccgttatttaacggaacttacccaccggggagtcgatgggtttatcattgctagctcgtcaatttctaacgaggcaattcaaaaaattctgcgcggcgaaaaatttccttttatcgttttagaccaaaaaaagtcggagggaatcagcgacgcggtccttaccgacgatttttctggtggacaacaagcggcccaacatttatgggatttaggtcaccggcaagtcgccgttgtaatgcctgaaaacgccacggaaaatattcaaaatcgacttcgcggcttccaaacggtatttggggaagacgagattgttcgcgtagacgccgagctatccaaaaagagtggacgtaaagcggcccaagcggtaattaattcgcccgcgacggcgatttttgcggtaaacgatcaaattgccttagggttatacctcgggctggctgatcagggatgccgaattcctgaagattacagcgtaattgggtacgataacattgatatgtgcgaatacgtggtcccccagttaactacgattgcgcagccaatttttgaattagggcaaactacggcaaaaatgttaattgatcgaatcgaaaagcctaacaaacaatgggaagaagagttgttgccggttcaattagtaaaacgattttctactgcccgtttgaattaatttaagtgttgtgctatatttctattatgtctttaaaacgttttcatgcggaaggcatttttatttttttgtttagtaaaacgttttacctaaaataaatggcaatttttataactcaggaggaaaacaagttgagtacggtaacgattattggaagtattaatttagatcgcacaattcgggttaagcaaatgcccaaacctggagaaacgatgcatacaaaagaaatcttctccgctgggggcggcaagggcgcaaaccaagcggtggcagctaagcgttccgaagcaaaaaccaattttattggtgcagtaggaaacgatgatgctggccgggcaatgttagatttactagaacatgaagacattgaccttagtggagttactactttggacaatcaggcaactggtcaagcatacattgtggttgacgacgctggtgaaaatgaaattatgcttcatgccggtgcaaacatggcctttactccggattacgtagcatctaaagcagacgtgattaaaaatagtgatttcgttattgctcaatttgaaactgggttggaagcaactactaaggcttttgaaatcgctcacgaagcgggtgtaaaaacaattttgaatccggctcccgcaattgaaaaggttccggatgatttgctagccgtaacggatatgattattcctaacgaaacggaaactgaaatcctcactggaattgaagtcactgacgaagctagcatggtgaaggctgctaaagctttgcatgaccaaggaattaaggccgtgttaatcaccattggtagtaagggaactttctacagcgttaatggtgaaaccgggatcgttcccgcatttaaggtgaaggccgtcgacactacttcagccggagatactttcattggtgccatgagcacggttttgaatccagactttagcaatcttaaagacgcaatcctttatggtaataaggcgtcatcattgacggtgcaacgctttggtgcgcaaccatcgattccatacaagaaagaattaaattaacgaaggggtgcggaaaaaatgaaaaaaacaaaagtaatcaattcagatatttcacgggtaattgcccaaatgggtcactttgataagttaagcattggtgacgcgggtatgccagtaccagcaggaactgaaaaaatcgacttagcagttgataatggaattccaagctttactcaagtacttttgaacgttttagaagaattagaagtacaacgaatttacttagcggaagaaatcaagaccgaaaatcctaagatgttggaaagcattcaagaaataatgcctaacgtgccggttactttcattccacactcagaaatgaagcaagacttaaacaactgtcgcgcgttcattcggacgggagaaatgacgccttattcaaatatcattttggaaagtggcgtagtattttaattacccttaaggggattgagcagttagatagtcaatattaactacgataaaagatttccattgacctattgaaggcgtattattaatatgtttggtcaacgccataggaattaaccgaggctgcggaagcaatgttcccagcctctttatttaagggggaaaaagtatgaatgcaacagcaattttaatcggtcttggaccgttgattgggtggggactgtttcctaccctagcatctaaaatcggcggtcgtccggttgaccagattgtcgggaccgcttttggtactttcatttttgcgttggtagtcgcaatggtgaacggcctaagcttacctaccggttggaacttagttttaaccatcgcttctggaattggttgggcaagtgctgaaattattacatttaagagttttgcaatgattggttcatcacgtgcaatgccaattactacggcgtttcaactcttgggagcttcgttatggggcgtgatcgccttaggaaactggccaggaatcacggctaaaatcgttggtggaatcgcgttaatcatgatcatttttggtgcttccttgacggtttggtcggaacacaaaacaaaggaaaattccaagttaatcacccaagcagtgggttggttagcagtcggggaaatcggatactgggtatattcggcggctcctcaagcaactccagttgacgggatgcacgctttcttgccacaggcgattggaatggtaattgtgggcgttgtctacgccgtcttcctttcgatgaagggtgaaaaatcggccttaactgaagcagtttcttataaacaaatcatttcgggctttttctttgcctttgcagcgttgacttacttgatttcggcacaaccaaacatgaatggtttggcaactggtttcatcttgtcacaaacgtcagtagttttggcaaccttaaccggaatttggttcttaggtcaaaaaaagacgccaaaagaaatggccgttacgattgctggtttagtactaattctagtagcagcaaccattacggtaatgatttaatccaattaaactaaagtgtaaccaatttagataaagctcctcaaggatgaaaatccttggggagcttttttgtaatgccaggaggaggatggatttttatgtataagtaattagttttagtatgataagtgttttcggttgattggaaccgttttcctagtatactcgtaagtgtaaggaatttttagaaaggaagcgaaaaaatggtgagctacaagtttttacagccatacacgtttaaaaatggggcacaagtcaaaaatcgagtggtgattccgccaatgaccatccaatctagtttagaagacggatcggtttcccgagacgacctattctacgcagggttgcgcgctggaggagtaggcatgtttattagcccggttgctaacgtcacggataacggcaaagggtttgaaggcgaactttcggttgcggacgaccgcttcattccgggattggctaaattagccgcaaccatgaaaaaaggtggcactaaggcaattttgcagatttttcatgccggacggatgtcaaatagcaaagttttacggggcacccaaccggttagcgcaagtgcggtagccgctccgcgagaaggaatggaaactcctcgagaattgtcagaaattgaaattgagcaaatcatcaaagcctttggcgaagctacccgacgagcaattcaagcagggtttgacggggtcgaaattcacggtgccaatacgtatttgattcaacaatttttctcaccgcattccaaccggcgcacggatcactggggtggctcggtggaaaaacggatgaactttgggctggcagtcgttcaggctgcacatcgtgcggttgccaaatatgctggagaccactttatgctaggctatcgtatttcaccagaagagattgaagagcctggaatacgtctagcgggcaccctgcaatttatcgacgaattggctgaccaaccgctggattatctccacgtttcgatggggaacgtatggcgaaagtcattaaacgacgacagtgaaaaactgcccaccattttgcgtattaaaaaacaagtgcataatcgtttaccaattatcggagttggttcggtagaaacgccagccgacgcggaaaaggtgatggacgaagggattgacttcgttgctttgggccgtgaatcgctgcgcgaaccgcaatgggttgaaaaagttacgcggggccacgaagacgctattcgttaccaggtggatccggacgcactagacgaattaggtctaaacccggcgttaatggatttcttgggtcaaattgggacagatctgcgttttattggtgccgatcgcgaaaaaaggtcaggtgacagtgtcgtttttgaccgttaaatttcacgaactaagggaaattatgtcaaaagttgggtggtttataaacattcactgaaaggcgcccattatgccaaatttaggcgtgatggttgcttttaggttaagcggagagggccaggtagagtgcttaatgatgtggttcagcacctttaggttcttcttcaacttatccttggtttagcagttggtgatggttgaaatagcggtacttattgaagttaaattaagttaaaataaacgtgttgaacttcaattttagaaatgattggggaagaatatggaaattcgtacgcttaaatatttttggacgattgctgaagagggaaccatttctaaggctgcaaaagccctgcatatcactcaaccaacgcttagtcgccagctaagggagctggaaaatgaactaggaacctccttatttattcgggggcgtcgtaaattacagttaacggattctggtttgtttttgaaaactcgtgcggaagaaattttacaattaacgcaacaaaccaacctcgagtttgaaaatcggcgaaagcaactgtttagcgggcgaattgccattggatgcgtggaagctgataattcggatacgctagctttgattttagaaaagtttgtgcaagactacccacaggtgacgtttaccgtctacagtggtactagcgacgacattaccacgcgattggacaaggggcttttagacgtagcggtcctgttaaaaccggtcgcgaccgagaaatatggggaaatcaccctgccccgcaccgaaagatggggattactggtttcaaaagattcttcctgggctaaaaagaatgctattcagccagctgatctacgagaaatgcctttatttatcgcgcaaaggccggaggttcggcagctagttactaaatggagtggcattgactacgcacagctaaaagtggtaggaaatttcaatttaattttcaacgttttagcgttagttaaacgccaagttggacaagcttttggaattgaaggggcgaccgcgcaaattcgtccagaaggggtcaaatttattccgctgcaaccagaagtaaaaaccaattgcgtactagtttggcgacgagaacgaaatttaaccccggtagttaatgaatttattaattactttaaggatgcctttggagcataccataataacaaataagtattttacgtatactaaaaacagccgtaacattatccatgttgataaagttgcggtttttttatgggacaaagtgaccgctctttatcctcgccatttaagacggacaagactaagagaaactttaacgaataaatacttgaatttgaaaggattttaaaaatgaaaaatgaagcaattaaagctgggggaatttttcctattggacccaagaacgatgcttacgcaaaatattttgtcggccaaagttatctacagaacttggtagccgaccctcagattgacgtaggagtgggtaacgtaacttttgaaccgggatgccgcaataactggcatatccaccacaatggctttcaaattttattagttatcggcggcgaaggttggtaccaagaagaaggaaaaccggcgcagcatcttacaaccggtgacgtggtggttactcacgagggcgtcaagcactggcacggtgcaactaaggacagctggtttacccacgtggcaattaccgcaggaactccagaatggttagagcccgttagtgaagaacaatatgcagcagttgaggaggatgaatagaatggcaaaaaaacaaacggctggacatgaacagttaggcgacttagcacctaaatttgcagaactcaatgatgacgtattatttggggaagtatggtcgcgtgaaagtcagctttcggcgcgggaccggagtatgattacttgcgcgagtttactaactcaaggagcgttccctcaattggaagcacatatgaaaatggctaagaccaatggcgtaactaaagatgaaatggtggaattagttactcacctcgcattttacgcgggttggccaaaggcttggtcagcatttggactagttaagaagatttttgattaataaagtagtgtagattaatttttaaacctaattaaggacaatcaatttgaaagcacgttttaagaatgctaatctattttgagacgtgctttttactggtgggcaaaaattagattagtacggctaaaataaactccaacccctagtttccgtcggttaaccaaaaaagaacgctaatcgcataatccgcgattaacgttcttttttaattgatcctcgagagttgcctgggattcggaatgtgctatatttccacgcaataaccctcatagtcacagttggggcaccctagccaacgagtctttggtgaatgttttgcccagaaaaattcgccaaacgctggcttgaagtatgcttcgcattgcgggcagacatactcaaccgagcggtagtatgcgtatacggcaattgccaccgcaactataatggggcaaaaagcggccaccaccacccaccagttactactggaaatgccataccaaattgccaatatttctaaaatatcaattaggcccccgaaaacaaacaacgcgcttcgttttctggttaaactacgtcgccgacgaatgctttcctcaataccaataaaggaattaggcgtaatgggaatttgatcagttaaccagtgtttaatttcaccaatcgtttttaaagtatcctcttgttgtttaatcttttgcttcaattgtagttcttcttggttaagcaaagtttggagcacttcgtcaaaattcgggctgtttaaaagctccttaatattattcaaagaaagtccgagcgatttcaagaaagtaattaattctaattgttctaattcatggtcggtataaacacgccgacccgcttctgaaagtttagcaggggaaagcagttgtcgccggtcgtaatactgaaccgtgcggatacttacccctacttttttggctagttcaccagtggaataattagccattaaaactcacctccatgcttatttatatctaattacgtaagaggattagcaagcagtatttagttattaagtatattttaacttcaattgaagttaaatacgattgcgttttatatgcaatggtggtaaattaaatctgtggtaagtgagtaattactcaccaaataaaaatgggaggaaatcgtgatggaaaaagtggttactttaaccaaaattgcgaagagttttggtaaattacaagtcttaaaagacatcaacttagaaatcaatgttggagaaattctaggtttgattggtccttccggatccggtaaatcaaccattatcaagatcgcgttagggatggaaaatgccgatcaaggagaagcaaaaatattcggccaaacgatgcccaatcggcagctattagctcaaattggttacatggcgcaaacggacgctttgtatttaagcttgacggggcgcgaaaatttgaaattttacgctcagatgaaggggattaaccggcaagcgatgactgatcaaattgcccacgttgtggatgtggtggacttaaatgaagctattgaccagccagtccaaggttactcaggcggaatgatgcgccggctttctttagcaattgcgcttctaggagatccgcaacttttaattttagacgaacccaccgtgggcatcgatccagccttacgtcgacaaatttggcgggagttaaagcaaattaaggaagcgggacgcagcattttaatcacaactcacgtaatggatgaagctgaacaagtcgatcaggtggcgcttattttagacggcgacgtaattgctctggatgctcctagcaagcttgaggaacagtaccaagtacccactattgaagacgtctttttgaaagcagagggggctaaataatgttacgaattttagcaattagccaacgagttttaagggaattagttagggataaacgaacgattgcgctaatgtttttagcaccaattttaattttggtactgttaagctttatctttaataacaatgcgtcgactaaggttaacgtagcaactgtcggagtgactaaaaagatgaatcaagacttagaaaacgttaagcactttaaagtaaaggaatatgatagtcaagccgcagcgcggaaagctttagataatcaacgagcagatgcgattatcaaacgttccggtgtagactacaccatcacgtacgcgaatacagacgctaccaaaacttcggcagttaaactggccttcaacaacgtaaggacgcttgaaaatgttcaggagttaaaaaatgttttacaacggagtattaagacaaacgctgagcttcaagcgaagttggcgcaagttactcaccaaacttccccaaataaagcaatcccggccaacaaggcgtcttcaaaaggaaaggttaccagtaaatacgtttatggggattcagatactaacttttttgataaaatcttgccgattttaatgggttttttcgtctttttctttgttttcttagtttcgggaatggcgcttttaaaagaacgtaccagtggaactttggaccgtttgttagccacgcccgttaaacgcagtgaaattgttctcggttacatgattagctacggaataattgccgttttacagaccgtggtaattgttttagtaactattcaacttttaggagccgaagtagtggggagcgtttttaacatcatcatagttaacttgttgttggcgttagttgcgttatcgtttggaatactattatctacgtttgccaactcagagttccagatgatgcaatttatccccattgtcgtggtgccgcaagtattcttcgcagggatcatcccgttagatacgatggcggattgggtgcaaaaaatttcctacgtaatcccccttaagtatgcgggagatgcggttagttccatcatgatgtacggaactggtctaacaaagttagggggagaccttggtatattactaggatttcttgtagtattgactatgttaaatattgtcggactacggcgttatcggaaggtatgaacatggacggaagagtatttgaaaattacaaaaaatggcttcaagaacaagagatgcctaaaggaaagcgaaattccctattagctgccctggatttatttgcgaggtatggctacgatggaacttcaacggcgcaggtagcagaagcggcgggggtgagccaggccacgatttttaagtattttaaaaccaagcaagatttactaaaagcaatcatcaaaccagtactagaaaacttttttccggtttatcgggatgacttgctagcagaactagcgcaatataattcgcttgaaaaattagttcactttttggtgcaaaatcggtaccgttttatggtggaaaatggtgatgcagcaatgattctattaacggaggtgctcactaatgaagaggttcgacagctcttcattgcgacgataagtgatccagaacactcgctagtacagggcttgaaccgtgctttgcgacaaacaggggaagtacgccccgagctggatgctgcggcaactgtacgaacgattattgggcagctggcggtttactttttacaacaacgctttgcgcataacggaaatgaagcggatgatttgaagttaattgaaggtcaaattgtgcgagcactacgtaaataacacattgtggagaggaatacggaatggaagacattttgcgagttattggttcaattgcacgcgagttagattcaattgctaacgtggaattcaaagaaattaacctcaccaaggggcaatttttataccttgcccgggtttgtgaaaatccaggcattattcaaggagaattagctgaacttctgcgagttgaccggaccacggcagcgcgagcattgcgtaaattagaagatcaaggattgattagtcgacaatttacggcagataaccaaaaaattaaacgcctttacccaaccgaaaaggggcggtccgtttaccccattatcaagcgggaaaacgagtattctaacgcaaccgccttgcaaggtctctctgaagaagaagttaaacaggttcgtaatttattacttcgggtggaaaaaaacgttaatgctgactggcattacgttaagaacggaaaccatcgcgattattgaggtgaaattgaatgacaattgaagttcaaccgattcgagaacgagatctagccaacttacgcaggataagcattgaaacttttggcgcgacttttggaccctacaatgcggaagtagatttacagcagcattatcaacgagcgtataatgttgatcaacttcgtcgggaattattgaatccagaatcgcaattcttttttgcaaaaattgataatgaaattgccgggtacttgaaaatcaacgttggggatgcacaatctgaaccgatgggagcgcaagttttggaagtggaacggatttatgtacgaccgtcttttcaacgccgaggcataggcacttgcttaattaagcaagctgaacaacttgcttacgcagctcataaaactcaaatttggctaggagtttgggagaataataaaaaagcccagcatttttaccagatgcagggctttaaacaagttggggaccaccgttttcagttaggaaaatcggaacaacgcgatttaattctaatgaagccggttaataacatttccgaaggttaaattaaaattccagcacagtggtcgatttcatgttggatgatttcagcgatccagccactaaaatgctgggtctgttttttgaagttcaaatcttggtattgaacctcaatttctttgtaacgagtggttgaacgttcgccagttaatgaaagacagccttccttagcttgataaggatggctttttttggttaatttaggattcagcatggcaatgttcatcacgccgatggatacggcaataatttgttttttaaccccaatcatgttggcggctaaaccaactgcccgatcggcattggctgctaaagtatccacaagatccaaagccgttgataaatcagctcgagttgcaggaactgacttttgggataagaaattttggtcacggacaatatttttctgcataagctctccttaaatagcgttttaaccattttaccacccttgactttagggagggaagctcgtaggattaagaaaaaattaacgaatcgctttaaatcaattctgtgaggttgataagcaagtttacatcaaaataaagatgtgcatttaaggtacggcggtgccttaactactttggcctttggtggagcggttcagtaaggagccatcataatgaaaacaccggtaatgattgcgttggattttgaaagtgtagaagaattacaaagctttttaaaacaatttccgtcacatcttaagttaactgtgaaaattggaatggagttgttttatggacagggccctcaaattgtacggaacctgcgtcaaaagggacacgctgtttttttagatttaaaattgcatgatattcctaacacggtggaaaaagccatgtttcaattaggaaagttaggaattcaatacactacggtccatgcgttaggtggaaaaccaatgattcaggcggctaagcgcggattaatggcaggtgctcgggcagcgaaggttcccgcccctaagctattagcggtaacggaacttacgtcaatttcggagcgccagttgcaagaagagcaaaatgtgcccttgaaaatgaatgaacaggtccaaaaattagcccaacttgctgaaaatgcgggtgcagatggggtgatttgttcaccgcacgaagttgcccaactaaaaccggtactcccggcagattttttgtacgtcactccaggaattaggatgcccgacgcaaagaaggacgaccagcagcgggtgatgacgcccgcggaagcccaaaaggcaggaagctctgctttggtagtcggcaggccaattactaaagcggctgaccccgtggtggcctaccaaaaaatagtggaaagcatgcaagattaagcgtcaaatgcaggctaagctgctggcatggctacggacggcttatttattgaagaatagtagatgaaaatacaagagtggagcgcaagccaggtagtttgtgaacagtaactaaaaaatcgactattatgtctaaattgggcataatagtcgattttgggttaaacggaaccaactgacttttgcaagttggttcgcaaccttaggaatttggttgatggcttttatacagaaagataaggtgcgctcaaaggagttttactccgcttaagcgatcgttttcacgctacttgaaaacttatagcaagctttcaatcacgtctaaaacaccatcatggtcattatcaaaacgagtctggtgttgggtaacttctttcacaatgggatatccgcttttcattgcgtaaccatttggggtcatttgaagcatcttaaggtcattttcgttatcaccaaacgtaactaattctgcgggagccacccgataattagccattagatgctttagagcgctcgctttatcaacgtggctaaatccgattaactcggtattaaatcccgaacttaggctagtcagttgaggatctagtttttgacgcagattttgaattttacttgtcaaatccgcgctgtccgcaaaactaaccgcaattttcacaatggggtctgtaataccggtttgcgcaaaattacgtaaattctttactagacgaatttctttataaaatttatgcaaaaagtcgacgatctcttgcggggtggtttgatcaatatacgaactggctaacccgcaaacgttaatcattacttcatcagcgccaaagttttcaaaaatagtgtcaatggtttgttgaactagcggaacgggaagttgctccacgtctaagagttggtcgccagagtaaataattgaaccgttttgggagataaaatccatttggttggcgtacggggtaaataaggcccgcaaacgttcatgttgagaaccgctagccgctacaaaatgaattttttgtcgttgcatttcattgaacagttctttaaaccggtctttattataagtgttttggttattaagaaaggtttgatccatatctgtcgcaatcatttttatcacgattgtcacctaatttctaaaagttatatacttagtttaaaacaattctttggcaatagtaaagctgatttataactgttatgcttgggtaatagaaaggaatttaagatatgaaaaaaacaaattttttaaaactagcagtatcttggaaatcgtgggcggatcccttaacttagttggtggggccttgattttagctgctgggatagttgggttagctaaacctcgaaaatgattgcggcgtaccaatataaatacacaaaatatttaacggggttcattctaaatgttgctattcagtgtattaagtgttagtatgatgtcaaagaacgctaaagtggatagaaaagcggttaaatttagcgatggtgctcgatagcgcctttttagattaactggtttcctaataagaaaccgcttacgcgtttataaaatgatcacatccaaagtagaggaaggtgtcacttatggcattaactgagctagtgaacggaactaaactaccaaaacaaataattagtacggcgttaggggttagtcgccttcatgatgcgctttggtcaggttaccgtcatttttatgaagagattaaggacactgacgatgacaatgaggacccttatgcccattttccgatgactaaggaaccgcatggcgatattgcggtaactttaaaaatgtaccgacaacctaaactaaaacgtaaaaatctttatattacggttaattttgcgaaaaaagttaatgacaagccttcgtttgaggaagccattgaagatgctttccaaacaatgaagtttgattattttgacgctttattgcttgatcaagcggtatttggtgacgatgacgagttaatgaccgagctgtggcattctttagaagagttgtatgaaaaaggatgtgtaggcgcactaggcgtggctaactttagcattgaacaggttgaaaaacttaggaaaaaagctacggttgccccgatgatttttaagacggggtattttccaatgtcgttaaacgacgatatttacgactattgccaacaaaatcatttgcaaataatggcggattttccctttctagattatagctttgttgacttacccacgatgggcaaaattgcttctaagtaccaggtggaaaacgacgagttgatgtgtcaatatgcgcaacaacgacacgttatgccaataattaaaaagttttgggtgctccatgctcacaacccgctggaacaaaactacaagattacgattaacgatctgcatcgtctagagcggttggacaatgcgtctaacgaagattggctaccgcttaaagattacgggatttttaaaattttccaatcacgagcaatcgaccacgaccggatggaacgcagcggcgaagaacactactcgggcttcccaccgtttgtgttttaagatggttggttggcgaaccttaagtaaagcaaactgatccgcgtcccacgtttaggcgcgactaagaatgaataacaatttaaaagcttctcaagagtgatctaaaaattcttgaggggcttttttgttttttggttccagtttcttgtagttagccaattttgcgcctcaatcgctatcccacgtttaggtagcaggttttgctaaacggactaccgaaatgtgtgaagtaatctagcgccttccggttaaccaaaatccggcgtcaaccgcctaaccgcgcgcttaatgccgtattttcgctaatctgcgagactttcctggatgatggcaccctctggaagtcttcctatattactatccacccttacgaataagtaattaattccataagcatattctttgttgaagcgtatccacctatgctatcttaatgatgaaccaatgaacaacgggttcgttggtcaatctttagattacgagaggagtgtttgttatgttgggatggatttggtcattaattattggtggtatcatcggtgcaatcgccggggcacttacaagtcgtgatttaccagcaggctggcttggtaacattgttgctggtttagtcggagcttggttaggacaaagcttactaggttcatggggaccttccttagctggaatggcattgattccgtcaatcctcggtgcggtaattttagtagtgattgtctcgataatcttcggcatgcgcaagaagggttaggggtgatttcatgaatcgaaccagtaaatctttattgagtttgatggcagtaatcacgttgcttctaactttatggtttatcgcaacggaagtttacattccgtatctaaccgatttctttgaaacgttgaggacgtctaacgcacaggtaatggaagttatcgcaattgtctttagcatactggttgccttgtttgcgttagtaatgctcggaattgcattaatgagtcggacaagtgagaaagatttgaagttgcaggatggacatggtaacttgaccgttccaaagaaatccatggaacaaattattaataaggcagttgctgaagaccatcacgtaggtaacattgataccaaggtgcgggttcgcagcaaggatcacttgcaagcaaaagtcagcgtggaagatttgtccaatgacaactaccgggtcaatgcacgagatattcaacgttcagtacaagagagtgtgcagcgccacctaggaatgaagagcgatgttaaagtccaaatcattccgcggcaacactcgaagaagtcactgaaggtcgtttagaaaggcgggatggcaaatgaaaagtgaagttttaggagcaatcatcgcaatgattttcggcattatctgggtcacgattggctttggtagcgcggtattagttggtttacttgccttaatcgggttcttactcggtaagtacggcagaagcctgctatcacaattgatttcagaagtaatgtcagccttgaacatggatcgcaagcaaagctaaggaggttttgtcaatggccaagaaaacagataagaataaaccattaagatcattaatgggtctaatggtggtatcaagcttatggtttgtttggaagaatcgtcgcaaatttaaggaggcgttgaaccatggataaaccaagaatcgcgcaaactagtttgtcatttgacgaaggggtaatcgaaaaaattgcgggactagcttctcgtaaagtcgatgggattctctcatttgacggtggattctttgacaacatcaccgacaagattcgtaacaaggtggatccaactcaaggaatcaaagctgaagttggcgaaaaacaggtatcgctagagatgaatgctaaggtggaatacggttacgatattcgagaaatttttactcaagtatgcgacgtaattagcgaggaagttgaacgtttgaccggtttgaaggtcattgaattgaatttccacgtaagtgacgtactaagcaagaaagagtggaaagaacaaaacaatcgtaaacctaattcagacttagcgcctcgtccagaagctaagtaactattcacgcgaagggagcaatgacacatggaaaataaaatcgcaaaatcagaaaacaagatggcaaaaccagaaactaaattaacgtttgacgacgaagttttagcaaaaattgctggcaaaactgctaacggagtagacggtgttttaagtcttgaaggtaatatttttgaaaaagtaactgatcgaatttctaagggcgacgatccaactacgggagttaacgttgacgttgacgacgaaaaccattccgtttccttaaagatggatgccatccttgaatacgggaagaacgcccaagcaatctttgacaagatgattgataagattacttctgcagtgaaggaaatcaccaacatggaagtatcagaaatcaaacttaatgttaaagacgtgctaacccgtgaagaatgggctgaaaagaacaacaaggatcgtcagcaacgtgacgacaagcactaaaattttaaaaaagacctaactgaaacctatggggggatttcggttaggtcttttttagtggattagtgttcccacatccggccgtcgagctcgttttcgagttggtcggcccgtttttgttgttcttggatgaggtcgcccaatgctacgtagaaggctttttgttggtaagtggttgcttgttgggcaagctggcgagcttgttccaatagccatgtagtttcggtttggtccattaggaatcctcctccttttttaacatagacaggttccacgccaggtcatcgagctcgctttgccgattttctaagctctctaagacttggtttagggtgacggaggtggggtctgctttagtgatttggtgccgcagctggtcgctaaaccaagccacctgaccggcaaaatgttcaaaattaggattgtttacgtactgttggtaacgaacgaggagccgttgttgggcttctggagtcaagtagagaaattgatgaacggccatcatcggcagataacgcatccgtaacttatgggcgagcgcttcaaacgggcgcattagttcagacatcgtatactgttcggctcccccggcttggaaatcagcagctgcttcgcctgcggtaaccactaaacccagttctttatcagctaacgcataacgatttccggtggcaaaacgcacggtcagaacttgatcaagccaattttttaaaaggcccggtgcgccgtaccagtagagcggaaattggaagataatccgatcgtgttcggttaaaagctgctgttcttgagttacgtcaaattcagcagggagcggatgccaagtaaccgtggtgaagtcttcaacggccgccttaaaaaaaggctgggtggtagaacttgctagtttaggatgggcgaccaccactaaggttttcataattaatcctcctcatggaaaacttgttgcgcggttgccagcatgtcgggtgcaatcgactccttggtgaaccgctgaatgggtgctaacgaatgacgttgactgaagttcatcttttccgttgccacaatcatcactaattggttgttttcggtcaaaaataattggccaggtttttgaaaatgaccgcgagtatgtttaccgtttcgccaagcgtgaattttaatggttgatttaaaacgataattgccggaagagtctagctccaacggaacgccataataacgggtgacggggtacttattcttcatttttgaaaaccccgggttctgataattctcggtaaatggtttgtaagttttgttctactttataaatcgtattggcgtcgtcaactaaccgatcggcaaaatccgctacctttgcggaaggaacgttggttttataacgcagcttgtgttccaaactggcccacatatccattccgacggtgcggatttgaatttctaccggggtttccacgggaccggttgataaaaagaccggaacctttacgaccaggtgtagactacggtagccgcttggcttgggatcccgaatgtaatccttcactttgagtaaagtgacgtcgtcttgggaaatcaggttttccttgatggtgtagacgtcgctgatgtagttggtgattacccgaatgcccccgatgtcaaagatattgttttctaccgcggcaatcgtctttggtagatgcttctttttcattttattaaagagggagtcgaccgatttcatccgttgttccatgtgatgaatgggattatggttgtactcattctcgtattcgccgtcgaggttttccagcttggtccccacttcgttaactgcggattggcataaccggtagtaacgcattaagttccttagctccgtaacgtgctcgggcccgatgacccgctctaaatcatcgttgatttgacgaatgttaaacatgttgttccgttctaaaatcatttttgcgaactccttttaaaaattagcatcatctcccacattataaaggaaaagatcgattcaggtaaatcaaagagggagattacttgtgattgtatccgctttcaactagaatctaattgtgaggaaagaaaacgaaaaggagtggcatgatgaaaaaaattattaacgacccgaagcaagttgtcgaagaaatgcttcaggggatggtgaaaagttatccagattatttaaaacgcattccagaaaccggggtggtttaccgcacggatttggctaaaattgctggcaaagtcggcatcgttagcggtggcggaagtgggcacgaacccgcgcacgctggctttgtcggtgcggggatgctgagtgcagcggtttgtggcgaggtctttacttctccgactcccgaccaaatttttgaagcaattaagcaagtaaattctggtgctggcgtatttttagtgattaaaaactattctggcgacgtgatgaatttcgaaatggcacaggatatggcggaaatggaagagattcccgttaaatcgatcgtggtcgatgacgacgttgcggtagaaaatagtacttatacgcaaggtcgtcggggagttgccggcactattttaatgcataaaattttgggcgcggcagccgaccaaggggctagtttggatgaaattgcggatttagctacggcagtattgcctaatttgaagaccgtggcggttgctttaggtggtgcgacggttcccgaagtgggtaaacccggatttgtcttggcagacgacgaaattgaatacggagtggggatccacggtgaaccaggttatcgacgggaaaaattacagccgtctaagaaattggcaaatgagctaattgaaaagttaaggtcggaattccggtttcggaagggcgacgccgtagcggtattggtaaatggtatgggggcaaccccgcttatggaacagtacgtttttatgaatgatgtgctagatcagttagccgaagaaggtttgcgcgtccggttcagtaaagtcgggaacctcatgacttcgttagacatggccggagtttcattgaccattcttaaaattaaggacgattgggtcgataaattaaattatgcgactcacacgattgcatggtagttgaagggagcggattgatttgttaacagtggaagacgtaaaaaagtggatggaaaaatttaatcaggagattcaggcccagcacgcttatttaagtgaattggacaccccaatcggggatggtgaccatggaaataacatggcccgcggaatgaatgctgtaatggaagccctggatgggaaggattttccagatttgccagcaatttttaaaacgattgcgatgagtttgattagcaaggttggcggagcctctggtcctttatttggaaccgccttcatcgaaatggcgaaggctaataccggtgacgtacacgagctcctggtggccgccaccgctggagtacaaaagcggggcaaggcaattttgggcgaaaaaacaatggtggacgtctgggagccaatttcagaaaaggctacgttcactgccgaggatgttgaccgggcggttgaaaacactaagccaatgattgccaagaagggccgggcgtcttaccttggtgaacgctcggtaggtcatttagatccgggagccgtttccaccggttacttactgaagactttactagcagtggaggcgaaataatggaatacggaattgtgattgtttcgcacgtcgccgaaattgcgcaaggcgtgcagcgcttaatcaaacaagttgcccaggacgttccggtaacaaccgctggcggactcgctaacggtgaggtgggtaccgagatgcaacgcatcatgcaggcgtttgacgacaatgcggcagacaagctgctcgcgttctacgatttaggcagtgcgaagatgaatttagagatggccatggaaatgaccactaaagaagttaaactgtacgacacggctttggtcgaaagtgcgtataccgcagcggctttattacaagtcaacactaagattgacgacgtggaggaacaactccaggatttgaaaattaaataggcgctccgtagttaggaactattattaacgaaatcaaaacttgagttttatcggctaactgccggtaaggctgggttttgtttttttatcgtaatttatttagttttgatgttgacaaacgaactaaatgattttattatttagttcgttaaataaaaagtaaactaaataagttgaacggaggaactttaataatgcataaagatgaaattttagacaacttgatgaaaatcactcaccaaccttttttggtttttgcgaaccgggtagaagaaaaaacggataacacgttcgaaactttgaaactactagctaaggaagaaaacgtaactgcgggccggatctcagaatttttagacatcaaaccgtccagcgtaacccagattattaaaaaattagaacaagccggtaccgtagttcgcgaaaaatcgcctagcgattctcgcgtaaccatcattaaaattacggataaaggaaccgaaagcttaaaaactcacgaatccatcggggggactttaaaagacgtcttgtttaaggatttttcggacgacgagttaaccaatttggctgactatttaaaacggatggttgaaaacatggacggggatgaattcaaagaaaaatttagtgaagtgttcagcaacgatcgtcgttgggaacaatttggcaaaatgagcccgcattttgaaagagcccgcgaacaaatgcttcggcataaccatttcggaagaatgcgtcccggcgatttcaggggctttggtggttttgatgattggaagaaaggacggcgctaaaattggcagcaaacgcacgttttaacgattcgatccgtaaagatcgtactaaatttaattttagacagtttttcgggttgattaagaaaactagccctaagtacctacttttagtgtggggggtaattttattagcaattagttcaggggtccaagtctacgtgcccaagttggcctccacgttagttaataactttactaaaggcgtagattactcgctattagcaaaagtggttttactgtttgtggcttcggcaattttttcggcgattggcgggacgattctcggaatctttggggaaaacgtcatccagaatttacggaaaacgttgtgggaaaggttgaccctcctaaaagttagttattttgataccgtaaaggccggcgaaatttcgagtcggttagttaacgacaccaaccaggttaaacagcttttggcggttacctttccccaaaccctagccagcattattaccgtggtagggaccgtctacatgatgattcggatggattggcacatgactttagcaatggtaattgccgttcccgtggtggtcattttaatgattccggtaatggcatttggtacgaaggtcggccacgtacggcaagacgcgctggcactatttaacgggattgttagcgaaacgctcagtgaaattaggttggtaaaaacttctaacgcggaaaaccaagctcaagagcacgctgataaggaaattaaccgcttgtttaaaattgggaaaaaagaagccgtttttgatgcggcgatgcagcccattatgatgatggttttcatgagcatgatctttggtcttttggcgtatggaattcaccgaattgcaattggggtgatgtcaattggtaccctaatgagttttttgatgtacctgtttaatttgattggggcattgccaattattgcaacgctattttcagaaatggcaaaagcttctggctccacaagaagggttgaagaattgttggaagaagtaccagaagacttcaatcatggtgaaatgttagatttggctgataaagatttaacggtggaacacgttgacttcgcttacgcagatgctcctgaagaagaagtcttaaaagacatttcatttgaggctaaacctaaccaagtgattgcgtttgcaggcccttctggcggcggaaaatcaaccatctttagcttgttagaacgtttctatgaaccaacgcacggggaaattaagtttaacaacactaatattcaagacattcggttaactaattatcgtaaacaaattggatttgtgtcccaagattcggccatgatggcggggacgatccgtgataaccttacgtacggtttggacgacgactttacggatgagcaactgtgggaagtgctagatttagcgtatgcaaggaaatttgttgaagaaatgcctaaccaattggataccgaagttggcgaacgaggcgtaaaaatttctggcggacagcggcaacgaatcgcgattgccagggcatttctccggaacccgaaaattttaatgcttgatgaagcgacggctagtttggattcagaatcggaaatgaaggttcaaaatgccttagccaacttaatgaaggggcgcactacgctagtaattgcccaccgtttgtcgacaatcgtggacagcgaccaaatttactttgtggaaaatgggcaaattacgggttcgggaacgcatcaagagttagttgcttcccacccaatgtacgctaagtacgtgaacgaacagtttaaggtagctaccgcgtaaaataattaggtcgtaaaaaacttttgcgctttttagtagcctaatgaggaaaaaagtaaaaagacgggaaaaactaaagaaatgcttttcaaggatggaaagattcttaaagaaagagctgttggagtggattgccttcaacggcgtcaaaaacgtgtacaaaagtcagtttaacccgcctaactaaaaaatcgaccgtgatgtaaattcatcacggtcgatttttagttaacgttcgtaaactatccgactttggccccgctctttttggttagtagagtgaaaagtcagttaaggtgcgggtaagtttccggcttaccctaaccattaacggttttaatttacttcatttgataaaggtgagggcctttttcagcgatccccgcctctaaaatttccatgttccataaggcttgctcgttggaaactaatttggggtcgccgttggtaagggtagcggcgatggagtcgtaaacccgaccataatctccattaatggtaggaatctgtttttcaatccagtcgccattctggtttttatacttgaccaccccaaattgactaggagcgtcaattccaaaatgatcgtcgcctggcatgatgccaagctttaagtcgttttcctgctggtcaatgtcgtacttaacgtaggttccgttagttccgtgaagtaagaaacgagggtagggacgcgcagctaacggattgctgaccacggtcgccttaaaattatcgtagaatagctgcgtttcataaaaatcatcgacggaactagcggggttttgaattgcccggatatcgtagttaactgtctgaggtttgccaaaaagccccaaaatttggtcaagcatgtggacgcccaagccgtaaaattggccatcgacttgggaaccttcatgaaggctgtcatcgggacggtacttatcaaaatgggattcaagcaacaagggttggcccacgtagccgcgttcaattacctttttgagggtcaagtagtcgctatcaaaacgtcggttttggtaaggcatcgccagtaattttttggcatcagctagtgcaaaaagttctctagcctcggcttggttggctacgaaaggtttttcgattaaaacatttttgccgtgttctaacgcagattttccgtattcaaagtgggtggccggcggcgtacaaaccgtaactaactgaacctccgagtcgtttaaaacctgctcaaggtcgtcggtaaagatggtgctaggaccataaaatccttgctctttttccggatgacgccggtggttgtaaatatatttgattttgatgtcgcgttctttaatgtaggggatgtggtaacggttggcacttttaccaaatccaataatcgccattgtcagtgacataattaagctccttttctattaaaaaaggactggacaacgaggttgtcacagtccttaatgtcaaatcgggttccaattcctagtccttttggctaacggaatttgcccactctttaaaaattaattgttttcttctgtattaatacggttaatttctaacagcaagtcaaccgcacgttccatggtttgaaccgaaacgtattcgtaacggctgtgcatgttttcgccacctgcaaagaggttaggggttggaattcccatgaaggaaatcttagaaccgtctgtaccaccacgaacggggtaaatgtccggcttgatgtccaagttttccatggccttcttagcgatgttaactggcgtcatgtctttttcgagaatttcacgcatgttgtagtattggtcgtgaacttccacgttgacccggtcttcaccaaattcggcgttcatcttttcagcaatatccttcatggtttgcttacgctcttcgaacttttgccggtcgtgatcacgaataatgtaaactaactgagcgtggtcaggtgtcccagtcatcttaaagaggtggtagaagccttcgcggtcttcagtttcttctggacgatcatgttctggcaattggttgtggtagtcaattccaacttgcaaagcgttgaccatgagacccttagcaaccgccgtgtgaacttcgttaccttgaatttcaatcgttgcttgggcagcgttgaaggtttcgtattcaagttcgccaagggggccgccatcaacggtgtaagcgtacttagtgttgaagtccttagcgtcgaaatgatctgcaccagtaccggtttcttcgtcaggggcaaatccaatccggatttcaccgtgttttacttcggggtgttccttatagtagtccaacatggtcatgatgtcggcaactccagacttgtcgtcagcacctaacagagtgagtccgtcggtagtaactaagtcgtggccggcatacttcttcaaacttggaaagacggaaggtttcaaaacccacttgccgtcgccgctcaagtcaatgtcagattcaccgtcgtagtttttgtgaacttgaggttggatattttcagcgttgaaatcagctgtatcaacgtgtgaaatgtatccaattacgggagtgttgccatcgtcgttagctggcaacgttccaactacgtaaccggaagatggttgggtgtgaacgtccactacgccaacttcttctaattcttttgctaaagtttttaagaattcaacttctttaggatcggtgggaactgtacttgaattagggtttgaacgagtatttacttttacatatcttagaaaacggggaagcaatgtttcatattttgccatttttctcagctccttttaatttatagtactatcttacaacatctatttcttttaacaagttttaatcctcattaaaacaataaagaattcggttacagctggagggcctacactggcacgattgtacaagaaagtgttatatatgttatagtagcacccaatgcctctgagaccgaatgtatggaaactaagttgttttagagaacaaataaggagatgtttaaatacaaatgttacttgaaatgagccatctgtcaaaggtttatcctgggaacaaagtggccgttgatgactttaatctaaacgtcgaaaaaggtgagtttatctgctttatcggaacttccggttcgggaaaaaccaccacaatgagaatgattaaccggatgcttaagcagacatcggggacgattaaaatcaatgggcaagatatcgccaagatggatccggttaaacttcgtcgtaagattggttatgtaatccaaaatattgggttaatgccccacatgaccattcgggaaaatattacccttgtaccaaaattattgaagtggcccgaagaaaaacgcaatgagcgggctaaagaaatgattaaactggttgatttgccagaagaatatttggatcgttatccatcccaactttctggtgggcaacaacagcgaatcggggtagtacgggcgctagcagcggatcaagatattattttaatggatgaaccgtttggcgcacttgacccgattacccgggaagatttacaagacctcgttaaggacttacaagaacggttaggtaagaccttcatcttcgttacccacgatatggatgaagcattacgcctttccagccggatcgtagtcatgaccggtggaaagcaagtccaagtagatactcccgaaaacattctacgtcatccagccaatgatttcgtggctaacttaattggacaagaccgtttgatccaagctaagccaagtatcacgaccgttgggcaagtggcgaataagccagcatcaattgcgattgatcagccggtagtgcgggcacttgacattatgcacagtcggcgagttgatacgctattagttactgacgccgaagaacgcctaaagggaattgtcagcatcgaaaaggttgacgaatattaccattctggcaaaaccgttggggaaatcatggatccgcgggtattttacgttaacgaagattccattattcgggacaccgtagatcgcattttaaaacgtggtttccgaaacgtgccggtagttgataagaagggccggttaaccggaattgttacccgggcgaccctcgtagacgtggtttatgacgcactctttaccgatgattcaatcgttgcggacggaaacaattcaagccaaaccacaaaggagtctactaagaaagatggtgatcaataatgatcaacttcttaaatcagtacggtgcggacattcttagcaagactggacaacacatttatatttcagcggttgcccttgcgcttgggattatcgtggcggtgcccctcgggatgctgcttacgcgggctcctaaaatttcaggggcggtaattggacttgccagcgtgatgcaaaccatcccagcgcttgccttgttggccatcatgattccaatttttggaattgggtccactccggccatcgtggcgctattcatttactcattactacctattttacggaacacttatctgggattaaccagtgtagaccctgcgctaattgatgcggcaaaggggatgggaatgaacagtttccaacggatgtggaaagtggaactccaattagcccttccggtaattatggcgggggttcgtttatcagcaacctacgtaattgcctggacggcgttagcttcctatattggagcgggtggtttaggtgacttgattttcaacggtttgaacttataccgttccgacttgattttaggcggatcgattccggtaattatcttggcattagttgccgatttccttttaggcaaacttgaagccaaactaacccccaaaacaacgcaggaggtgggctagatgttaaaaaaattactgaagctgatcctaccgctaggcgtgttaaccgtaatgctttcgggctgcggctggcctggtttgaacggcacctcgagagatacggtgcggattgcagcccaaaatactactgaacagcaaattatgggcgcaatgattcaacagttaattgaacatgatacaaatttaaatgcggaagtaatcaacaacttgggctcgggaacggttagttttcaagctcaaaaacgtgacgaagcggatttaacttcgattcgctttagcggaaccgactaccagaccattttgcacggtccccaaggtaagtcgccgcaagcagtgaacgattacgtaaacaaggaattcgaccggcgttacgacatgacgtacttcccaacttacgggttcgcggacacttaccaatttatggtaacgcaggactttgcgaagaaacatcatattgaaacggtcagcgatttgaagaaaattgctcctaaaatgaaggtcggaatcgaccaaacttggttaagccgaaagggtgatggttacgaagactttaagaagcgttacggcttccagtttggacacgtatacccaatgcaaatgggattgctctacaatgctctagcaagcaacaagatggacgcggtcctcggttattctacggacggccgggtacgcagctaccatttgaaattgcttaaggatgaccggcaattcttcccgccgtacagcgcaagtgtcgttgttaataacaaggcgttgaagaagtatccgcaattagcacccgttttacacaagttagacgggaaaatttcgttggaaacaatgcaagaattgaattaccaagttgataacaatttgaaagaaccatcggtggtagctagcgaatttcttaaggcgcaccactactttgaaggagggaagcactaatgcaaagtatgaatatttggcaacaactgttctattacttctcgcataatggaatgtacgtgctttcggaattcagtcgccactttttgatttccatttacggggtcattttagcggcaatcgtggggattcccattgggattttcatcgcgaaaaaccgaaagattagtgattgggtgattggtttggcaaacgtaattcaaaccatcccatccctagcgatgctttcgattttaatgcttgggttaggcttaggagtatctaccgtaatcgtgacggtcttcctatatgctttactgccaatcattaaaaacacttatacggggatgttgaacgtaaacgatgcatacctcgatgccggtaaggggatggggatgaccaaactccaagtgctttggatgattgaaattcccctgtcattatcggtaattttagccgggattcggaacgccatggtattggcgatcgggattaccgcgatcggaaccttcgtgggtgctggtggtctgggagacattattatccgcggaaccaacgccacaaacgggggcgcgattatccttgccggagcgttgccaactgctttaatggcgatcattgttgatttggtgcttggcgcactagaaaatcggcttcggcgccggacgctttaaaatatacatgaatttaaccaacgagctaagagaaatcttggctcgttttttgttctattgcaaggtagtcgaaacgtgttttgcgccccagccctctgcggctaacccaatcccgacatcaatcgccaaattcgtggttaacggaattcgctctactgcaatgtagtcgaaacgtgttttgcaccccagctctctgcggctaacccaatctcgtcatcaatcgccaaacccgcgattaatgacgagattcagttagtcctcaagagctacccggggtgcaaaacactctgagcctttttctttccttcccccacccacctttgctatgctttaattaccaaaaactatctataaatctaaggaggcgcttatgcacactaaatccacatccgatgactatggcgcgggtcactctccctcgcctcatttttatcgtttaactactgcggaggtcgctcaaattctccgcaccgattccgaggcaggactcaccgcctcggaagcccaacgacgcttagccgtggacgggcccaacgctttgaccgaaaagaagaccagcaatttaacgcgttttttaaagcaattcaacaacagtattatctacattttgattgttgctgcaattgccacctttatgttgcgagagtattcagattcgatcgttatcggaatggtggtaattattaacgcgctaattggttatttccaagaggtaaaggcttccagcgcggtggacaaaattaaacagctgctacaggtggaagctacggtggtccgcgatgggcaacgacttgacgttcccgctgaagacctagtggcgggtgacctagtctttttagaggcgggggaccacgtgccggcagatctccggatcgtggacgcggataatttgaaaattcaagaagctgcgctcactggcgaagcagattctgttttaaaaactcctacggcgcttaaggaagaaactcccttaggagaccggactaactcggcgtttgcttcgaccgcggttactaacgggagcggtcttggaatcgtggtggccaccgcggaacaaaccgaaattggtcaaattagttccagcgtcaagaccgttaagagtaaaaccactccgttaatgcgggaaattaacggattaggaaagtacatttcgtacggaatcgtcattgtagccatgttagtggggatttacggctacctgactaaaatctactcgttacctgttttagtcattgcgttgatcacgatgatcgtgggatccctaccagaaggactgcccgcaagtacctcggtagttttagctatgggaattaacaaaatgaccaagcaaaacgcaatcgtaaagtccttgccagccgtggaaacgctaggctcggtaaacgtaatcgccaccgacaagaccgggacgttaactaaaaacgaaatgacggtggaatccgttgttaccaaacaacacgaatttgaagttacgggaacgggataccacccggaaggcacggtgtgtttgaatggtcagccggtggaactatccgaacacccggatttacaaaaattgatcttggctggttactacgctaacgatacggaattaacgcaaactgatggtcagtggcaaattaacggggaacctaccgacggggcctttttgaccttggcgaacaaagcctttcagcaacgagttcccgagtggaccgaagtggacatgattccgtttgactcggactaccgctacatcgcggagttaagtcaaagtgcaactggcgaaaaattgatttacgtaaagggttctcctgacaaactttttgaaatggttaaggacgatcccgattttaatttgacggagtggtacgaccgggtctcccaaattgcacaaaaagggcaacgcgtggtggcggtcgcttataaggaagctccagcagagcaaaccaccttaacccatgcagatttgcaaacaggaatgcaatttttaggggtggcggggataattgatccccctcgagaagaaacgattgcggcgttgcacgacatgcggaatgccggagtgaaggtcaagatgatcactggagaccatccggaaactgcgacggcaattgcgcaaaaattagggttggacgaccaaattagggcaattactggtgcagaaattgaccgtttggacgatgaaaccttgcaaaaggttattcaaaactataacgtttttgcgcgaaccacgccgaataataagctacgcattgtggaagcttaccaagctaacggattggtcaccgcaatgacgggggacggggtaaatgatgcacccgccttgaaacgcgccgacattggaattgcgatggggattaagggaactgacgtggcaaaggaatcggccgatatgattctcaccgacgataactttgcgaccctttccaaagcgattcgcgaaggtcgccgggtttacgacaacattaagaagacgatccgcttcttgttaccaactagttttgcggaagggttaatcgtgctcctatcgatcattagccaacaggaattgccgttggtaccgacccaattactctggattaacatggtgtcggcaatcacgattcaatttgctttcttgtttgaacccgcagaagagggcattatgcaacggcgaccgcgtcccgcgggaagggcgttcttaaaccgggcggacgtaatccaaattatttacgtttcgattttaattgccggactaggaatggtcggtttcgattggctccgtggtcagggaatcagcgaattagtggctagcacggtgacggtaaacatcatcgtctttggtaaaattttctacctcttcaatattcgaacaccgaagccagcactttctacggatgttttccgtaattggcatattttttggataatcggggttctattagtgttacaattgggattaacttatttaccgttcatgcaggcaatcttcagcactgcggcaatgagcggcatgcaatggttgattccggtcgtggctggaattgtagtcctcgtggtgaccgaagtcgataagtacttccacccgggacactttaagcaagtccatgcagattaacttgcagaatatagatcgtaagaggagaaaatatgagtttacttgaagtccaaaacgtgcataaatcttattatttaggcgacgaagaattcaaggtcctcaaggggattaacttgaaattcgatcgtggagaatttgtctcgattttaggtgaatcgggtggcggaaaatcgaccttgatgaacattatcgggggcttggaccaccagtacgaaggcgatgtggtctacaacggtcaatcgcttcattccgcaaagcccaaggtgttagacgcttaccggcgggaaaacatcggctttattttccaaagtttcaacttgattagtcacctgaatattttagataacgtgctcgtttccttggaaatgacctcgctatcccatgctcaacgagtggcccgggctaaggaactgttgacccgggtggggttgaaagaccacatgcggaaacatcctaaccaattatcggggggccaaaagcaacgggtcgccattgcccgggctttagcaggagatccggacgtgatcatcgccgacgagcccaccggtgcgttagatagtcaaaatacccaagaggttctcgaaattttggcatcgattgctaaggatggcaaactagtaattgcggttacccattctcaagaagtagctgattttggtacccgagtggttcatttggatgacggggtgatccacggtgaagctaacttgcgggatccttatccggttcctgcggcagaaaaaggttttcagcccaagcatttgacctttggggccgcgttacaaatggcgctcaagcacatgggatacaatttaaaacgcaacctgttgattattttcggcgcttcgatcgggatcttttcggtgatcttaatgctgggattaggtaacggggtgactgggtacatgaacgaccagatttcgtcgcaaattaacccgaccgcggtgcaggttagcaaaaacgccactcccgaacaaatgcaagatggccaaggaatcacgatggcggatgcggattaccgccgcttccagaagatggaccatgttaagtcggtcgaacgcggttattatctgcaatcggctaaggtggttaaggaaaagaagtcaacgaccttacaagttttacagacttggaataagactgagcgggtcaacgacattaaatacggacacttgccacacgcaaatgaaatcttgttagataaggcgtcagcgaagaagttggacaagcattacaaaaacgtagtcggcaaaaaagtgaccatttttgtaaccaccgttgatgaccaaaaacggccagtgcaattgcaaaaagaagtcacggtttcgggggtaattacgtccgggaccagcgccattaactacaacactttaaagggaatgtttacggaccaaaagctttcctttagtcctaacttcctcacggttaacgttgatcaagttacgaacgttaaggacgttcaaaacaagattaagggttataagcatcaggtgaagggcaagcaacgggcaacctacgcaattaccggcgtaggagcaatcctagactcgttaaacacctacattatgctggccttctacgttctagcgggaattgcgggaatttcactactagtttcggcaatcatgatcatcgtggtactttacattagtgttaccgaacggaccaaagaaattgggatccttcgggcaattggcgcacggcgaaaagacatccgtaacttgtttgtttccgaagcctttttcctcggtttgttctctagtgtgcttggttcggtgctcgccttgttagctcaatggggtgccaaccagttgtcacagaaacacattgactttgcgatcatcggaattactccgggatacattacttttggagtgattatcagcgtggtaattagcctcttggcggcctttacgccgtcccgtaaggcttctaaactggatccggtggaagctttggcaacggaataaaattaaaaatctaagtaagtggctctgacttaaggctaggaaatttgtttcctggccttttttggtgcgcttttgaaaataatgttcgttaaaatcggtcataaaaaccgtttttaattaaatatatttcgtgataatataaaaagaatgaaagggagtggggataattaactataaaaaaattattaagggttccttcttttcggctgaatcaacccaaaaagttaattttgttaaggacgcgttagtggtgattgacgaaaagggaatgattgatgatatcgtcttgcccaaagaggtcaaatatcgcgatcttttagtaaaagctcagaccgctaaaaagttaatcgaattagccgacgatgaatacctcttgccaggctttattgatttacatattcacgctccccaatggccgcaagcagggatggcgttagataaaccattgaacgaatggctagacgaatatacttttccgttggaagccaagtaccaagatacagattttgctagaaaaagttatcaccacttagtgcgtaatttagttaataacggcaccactaccgcgctgtatttcggcacaattcatgaagcagcaaacttagttttagcggaggaatgcaaccagctcgggcaacgggcgtttattggtcaggtagtaatggataaccctgagcaaaccccagcctactaccgcaatgcttctaccaaaacagcaataaatagtacggtcaattttattgaaaaaatccaagaaaagttttcaaaagcaccaatttttccagtggtcactccgcgatttattccgagttgtttggatgaaacgttactggaattaggcaagttagcacgggaacgcaatttgctgattcaatcccactgtagtgaaagcgattgggaacacggctatgtaatggaacggtttggtaaatcagatgcaaaagttcttcaggaaatggatctgctcaccgaccgctcgattatggcgcacgggacgttgttaggagaagctgaattagcaattttccaacagactcacgccgccattgcccattgtccaatttctaacgcctactttggaaacgcggtactcccggtcagaaaaattttagagaaaataacggttgggttaggttcggacatttcaggcggtttttctgctagcatttaccgaaacattcaacaggcaattatttccgctagaatgcttgaagacggggtagataaccgggtggctgctgagcagcggggcgtagctaattcgcggatttctgcagcacaagcattttatatggcaacggtcaacggggcccgcgcgctccacatcccggccggtcagatcaagcggggatgttacgctgatttgcaaattgtaagggacggcttggcggagatttcttcaaccgctccgacagatattttttcaaggttaatgtatcaaaccaacccagacgatatttcaaaagtattgattgctggaaatttagttagtcaaaagtaagcataggagaagtatttcaataatggaagaaaaacatagtaacttatttatcgggcccgacgataaaattggtaatggtgaggcaagtttattaggattacagcacgttttggcaatggacgtctacgttccgccggtcattttagcaatgatgttgtcgatgtcctttagcgaaaaaatgggacttttacaggtggctttcttagcagccggaattgggaccatcattcaaaccgctgttttcatgaaaatgccaatttcccaggggccttcttttgttccgctgacggcagcgtcggggattgtcctcgctagcggtggcctccaaaaagggatggctaccttgctgggagcgctcatcgtgggagcaattttgcttgtattattgggaatatccggtgttttttacaagattattcaaactttggtgccggcgcttgtggggggcaccatcataacttgcgtgggactatcgctgatccccactgcgttaaacagtaatatttttcaagctagcggcaacatcaaccaaaacataattttagctggaattacggcagtcacgctcttgatttcgatttcaattagcattcactttcctagtttacaaagggtttttagaactggagcaatcatcattgcgttattagctggtacggttgcggcaaccatgatgggacgcttcgactggagtaccgttaaacaagcggcgtggtttagcttaccgcaaggcaccgtcttgcattacggagtcaccttttcaccaaccgcaattttaacttttatcattatttacgcgattctaacgaccgaaacaacgggaacttggtttgcgatgggggcggtcactaaccatcaaatcaccaacaaacagtggaaccgcggcttggttggggaaggaattagttgtctaattgctgctctattaggatctacgcccgtaacgggttattccacaaatgccggaattatttcaattaccggtgttgccagtaaacgggtgttcatttcagctggaatctggttcatcgtgctcggcttctttactaagatttcggcgtttctgtccgccattccagccccagtgattggcggcgtgtttgcgattatctgcgtaaccattatgctaaacggcttgcgagttatccgtaacctccaagaaaaagatggcgacatatacgtaattgggattccgattgttttgaccttcgcactagtattaattcccacaacggtggtgaaggaagcccctcagatggtacaatatttactaggctcgccaattgcggttgcggccatggtggcaatcattttgaatttggtgatgtccaccggaaaaaataagtaaacctgcttaaccaagccgatgcgacagcttcagtaaaagaaagttgctcggatatggtaggtatgttagattaaaaagattaaaggatattgaggctgggaaaccattttggactgttgaattcagcagtgccagaacgtgtgccaaaagtcagtttgttctgcttaaccaaatcccccatcgaccgcctagattgcgattaatgggggattcagttaatgctcgtaaataccgacttttgtcccactctcttttatttttgccttttgttagtatatggaggaaatcaatgataactgtaacggatatgagcatgcaattttcagaccgaaaattgtacagcgacgttaatttaaaatttaccccgggcaattgctacgggattatcggcgcaaacggggccggtaagtcaacctttttgaaaattttagaaggaaaattacaaccgacgtcgggaaacgttagcatttcgcctaacgaacggatgtcgagtttgaaccaggaccactacgcgttcgaagaatttacggtaatggataccgttattcaaggtcaccaaaagttgtaccaagtgatgcaagaaaaggacgcgctctatgctaagcctgatttctcggacgaagacgggatgaaggctgcggaattggaagcagaatttgcggaaatggacggctggaatgccgaagcagaagcttcccaattattgcaacagctcggaatcggcgaagaattacattacagcaagatgagtgagctgactgaaggccaacgcatcaaggtgttactcggccaggcgttatttggcaagccggatattttgatcctagatgagccgacaaacgggttggatccgcaatcaatcagctggttagaaaactttttggcagattttccgaacatcgtgatcgtggtttcccatgaccgccatttcttaaactcggtctgcacgatgatgtgcgacgttgattacggcaaaattgaattgtttgtgggaaactatgatttctggatggaatctagtgcgcttgctaagcgattagcagaaaacgccaacgctaaaaaagaagaacagatcaagcaattacaagaatttgtggcgcgatttagcgcaaacgcctcgaaatcaaaacaggcgaccgcccggaagaagcagttggaaaaaattacgctggacgacattaaaccatcttcgcgtaaatatccgttcatccggtttaacccagctcgtgagctaggtaatgacttggttcgggttgataaggttagcaaatcaattgatggtgtaaagattttggataacattacctttacaattcgtcccggagaaaaggccgcaatcttaagtcgcaatgacttagcaaccacggtgatgatgcagatcctggcgggtgaactagaaccagaccaaggttcggttacttggggacaaactactgaacgtagttacattcctcgcgatattaatccgtactttactgacgaaaacttggacattcttgagtggctgcggcaatacgctgacaaagaagaaagtgacaacaccttcttacgcggtttcttaggtaagatgctcttttctggggaagacgtgttgaaaaacgtaacgaaactttccgggggcgaaaaggttcgctgcatgatttcaaaaatgatgttaagcaaggccaacgttttgcttttagatgacccaactaatcaccttgacttggaatcaattaccgcgttaaacgaagggttaaccgaatttaagagttccatcattatgacttctcacgatcatgaatttattcaaacgactgctgatcacattattgaagtgtcggatcgcggagtggtagaacgggcagataccacctacgacgaatttttacagcacgaagtcgttcaacaacaagttgaacaattataccgtgcagattaagttcgagggcacaactttttcaccgtaatatattgtaaagtatagggtttatgtgttaacattttaagcgttgccttgactataattattagtgtgttaaaatttaatagtgtttaaggttttagcgagttaggaagaaaagaggagaaacaatggaacaagcagatatttcatttattgcacaagcatacaataagagtatcaagttgattggaacgttgctagaaagtaaaatctctgatccacaagtatcttttgatatgtttatgatcatgcatataatcgaacaatctggtagtgaaccaattactttgagtgaaattgcggagacacaagaagtaacgaagagtgcaatctcacgtaaagtaggaactttacttgacctaggtttaatcgaacaaaagagtgatcgggtagaccggcggaagaagtatttaacgctaactaaccgcggtcgcgaattatactggaaaaatgataagatcttcaaagaaatgttagacgacgtggctaaacgttacggtaaggacgatttcttgaagacacttgaacacatcaataagattgttgaagttattaaagacacgatggaagattaactaaaagctaccgtaaaaagcagggcaaaggtcctgtctttttatttatcaagacgaaattctttactaagagaatagtttttagatataatcttgagtaatatgcaaattaatatgttggtgaggttactgagatggagaataatttgacaaacaagcaggtgggaaaaggaattttttgggccctcattgcttcctgtatgtggggaatttctggtacggtattgcaggtaatctctcagggagaaagtattccggcttcgtggtttttgtcagcacggacgagtggagcaggagttctcttactcattatcagctttatcaagtaccggatgcgcatttttgacgtttttaaatcattacgaaccgttttatggttatttgcttacgcaatttttggtttaatggctaatttattaaccttctacatgagtgtgcaggaaggaaacgcatctgcagccacgattttacaatacttaagtccgctgttcattgttttgggcagtctggttttcaaacacgaacggccgatgcgtagtgatttaatcgcgttcgtgattgccatgttaggggtattcttggcgattacccacggcaatattcatagtttagcaatttcaaacagtgctttaatctgggggattctctctggggtaacggccgcgttttacgttgttttgcctaagccaatcaccaaagaccattctccaatgatcgtcttgggttgggcgttaatcattggcggaattttgttcaatattcaccaaccggtatgggttaacacccctgaaattacgacgcgattggtattgtcaatggctaccgtaattttagtcggaaccatcttgccattctgggcattgttacatagcttgaactttgctccatcggcagtggttagcattttggacgctgtgcaaccggtagtgacctttgtactaagcttgttgttcttaaacttgaagttcaacatcaccgaattaattggctcaatcctagtgattgtagcgattacgattattcaaaagttccggtcggagccctgaagatagcataatgtaaattaagaaaagcgtgggacaaaagtcggatagtttgcgagcattaactggaaattggccatgatgcctgaatttggcatcatggccaatttttggttaagcggaaaaaactgtcttttggcacacgttttggctctattgaagccaaaaaattaaaacaactttttaaggaccttttcaccctcgaaaagttttttttagtttttgcccagcttttttagttaaaacggctttaaaatgaagttcaaaccaccttcaatccaagttcatgaagtgctaaaattagtgtttcttaataaacccataaaaattatgtttggtgagcgaaaaatttataacgagtacgttccctagtatataattagggtatgaaaatccaagggggatgcgcatatgagtgaagagagaactttgattttagttaaaccagacggagtgcaatgtggacacgtaggccacgtgctttcccgaattgaaaatcggcgttatgaaattaaggcgttgaagatgattaacgcgactaaggaacaacttcggcaacactattcccaactggtggataaaccatattatccaggaattgaagaatttatgacgagtggaccattggtagcgattattgcggagggtgatgaaattatcgaaactttccggaagatggcgggaccaacgaatccaagtaaagcaatgccaggaacgattaggggcgactttgcaagggcatggggaccaggcccaattaagaatgtggtccacagctcggatagtaaagaaagcgcagaaaaagaaattaagatttggtttccggaaagaaattagagcgtgacagacaccgggtaatttttgaggcttaacagaattgtgccattaatcgcgggttgggcgattgatggcacaatttagttaaccggagaaaattggtgtctttcacgcgtttcaactacatagcaatagaacgttagggactaattgcgggttaagcaattggtccctaatttagttagccggagagagctggatttcaaaacacgtttcgactacacagcagtggagcggaagaaaattaacctcaggtgctttttatttgcaaaatcaaggcgttttttgccaaataaatttggtcaaagaaagtcaaataaaaagtttgactttctttgaccaatgtactacaataagaaagtgaagagatgaggtaaacaaaaacctcatcgatcattttggttatttggaaaggggttttgttttatggctaatgaaatgatgaatcgtaggaatgatatgtgggatccattctttgaccgtttagcacgtggatttttcaacgacagctggaacgcaactccaactagcttaaagactgacgttagtgaatcggacaaggattacaatgttaagattgatgttccgggcattgacaagaaggacattaagctaaactaccaagatggtgttttgaatgttgaagttaagaaagatagtttcgcagatcatgaagacaaggaacacaacgttaccatgactgaacggaactacggaatcatgcacagaagctactccttgccaggggttaaggcaagcgatatcaaggctaaggttgataacggtgtgttgagtattacactaccaaagaccaatgatgattctagttcaggaattgaaattgaatagtgattagtttgctagaagtgcgggaatcgcattagtttaaagcaaagggcgtccatagatgaaaatctgtgggcgcctttttttaatcagttcttttgaacaaaaggggagttaaaaaatcagttggtttcgcgtaacccaaaaacgaccattatgccaaatttaggcgtaatggtcgtttctgggttaatgcttaccagttgcccggcatctgtcccaggttaataagcataatgggttaaaaacctcgctaattatagtaaactatgcgaaattggtaatatttttaatcggggtcgctatcgtaaattttcatcaaggctggtttgccataataatagccttggcgtaggtcaattttcattcggtctgcccaagcatcgtcttggtcatcctcgatgccttcaagaataaagcgcatcttatgctcagcggcgattttttgccagaacgcaacgtggtgttcggcgttggtttcactcaagtgctctttataattttgtaaagcgtacttgagttcactagtataaggcaacagtgattttatctctggccaagtgttaattccgctacccacgtcgtcaaggcaaaattgaattcctaaatcattcaaattttgtaccgtaggaatcagttcttggttagttaccgcgggatttactgcatcttcaattagctcaataactagcttgactggtcgtaaaacggcctgggccataatgagtgcatgaatgagatgttggtcttgaatttgatggcggtcaacgttgacggaaactgagccgacctttaacgatagttcttttaccgtggcaattagggtatcggccatcgttttggcaggaatcgcggaaaatgatttgggcattcgccaagcgccgtcccggtactgtttaattaatagttcgtaacctagtacggattgcgcaacggtattcaattgtggttggatgaagaatctaaacattaaagacaatactcctcgaatttgaattgtgatgcaaaaaaattaatgctatacaacttttttgatgtatcgtaaattaactattataattgtttcgttatgaaatgataacttttgggaatagatttttaggaatattaaaactgtctatagtatagaccatttaggaggaaaaatgaaagtagcaattatcggatgtacccatgccggaaccgctgcggttcgtgaaattattagacaagatcccactaccgaggtaaatatttatgaaagaaacgataacatttcgtttctttcctgtgggattgccttgtatttaaatggccgggttaagcaacttgaagatatgttttacgatagtgccgaagacatccgtaccgaaaacattcacgtaaatctgcgtcatgacatgatccggattaaccggcagaaaaaagagttaatggtgcaagacatggatgatttcaccgttaagcgggaaaagtatgacaaaattattatgtgtaccggttcaatggtgtccttaccgcccattaagggagttaaccatgcacgggtaatgttatgtaaaaactatgagcaagcgcaacttttgcacgaaaaagtgaaggatgcacggcgagtcgccttagtaggtggcggttacgttaacatcgaattggctgaaagtttggtggatactaaccacgaagtcaccctttttcaaagccacgaagatattttaaataattacgtggacaccccgttgagtgctaaagttattaaactattgaatgatcaccacgtgaaggtggaaaccaacagcaaggtggtttcatttaccgataaagtcagcgagttattggttacgaccgcggatggccgcgagtttgctaccgacgtggcggtggtgtcgaccgggtttgttccggttaccgacttattgcgtggggaagtgaaaatggaccggcgcggggcaatcatcactaatgaatatgggcaaagctcggatcctgacatttacgtggcgggggacttacggactattcattacaaccctaccaacgctcccgaatacatccccttagccacgaacgccgtccgccagggtactttagctggaatcaacatctttggcaaccagtggccggaaatgggcgctcaggggacctcggcaattgccctttttggacacaccttagcgatgactggtttaacctatcaacgggcgttaaatgcgggcatcgatgcagattatgtcttatttgaagataactatcgtccagaatttatgccgtcgaccactaaaataacgagtataatggtttacgaaaaaaagagtttgcgaattttaggggcccaattctatagcaaacacgatgtttcacagtcggccaacctaatttctttagcaattcaaaaccagaatacgcttaaggacttggcatttgtggatatgctattccaaccgtattacgaccggccgtttaactttattaacttggctgcccaagctgggttacgtaaaattggactgctttaaacaaatttagtgaggaagcggaatgttagatgagtaaaactgaacgagcaaaaatgacggcgggagaaccctatcagcagtttgatccggaattaattgaacggcggaaattcatacgtcaacaaattcagcaactaaatcaagaggttgataatgagcggcgtaatcaaggatttaaaaaactgctcggtgacgtgggcgatgatttttttgtcgaaagtgactttaaatttgattacggatggaatattcacattggtaaccacttttacggcaactacgacatgaccttcttagacacgtgccccatcacaattggcgaacactgttactttggtcccaatgtcgggctttacacgccgatccatcccttggatcccgtccaacggaacgccgacgttgaaatgggcgcgcccattacaattggggatagctgctggtttggtggccgggtgaccgtcttgcccggggtaacgttgggcaacaacgtcgtggtcggtgctggttcagtggtcaccaaaagctttggtgataacgtggtaattgcgggaaatccggcccggatcatcaagactatcgactaaatttggactttttgtaatttagtagtaacataataaacgacaggtatgacgaacttcgggtaaaaccgatcgagcaacgctatgcaggtgtaaattaaatacgccagccgcgttgcttttttaataccgcagtcttagaactattgggaggaattttttatcttacacagtaagaatgtcgatcgagctgtctttttaccaacgatggtattattcgggattgtttccataatcctgatcgtaggcggcccagccgttcagcaattaatgaacgcgttgttgtcattcgttaccagcaaatatgaatggatgtatgtttccatttatgtgatcaactttgttttcttcttgttcttgatttttagtaaatacggcaagattcgatttggcaaagctgatcctgatcacgattttagcggttttcaatggggaagcatggtgtttgcgacggcaattgatgccagcattttgatgctgagtgcctcggatccgttgcaatacctgcaacaccccgcgtttggtgccaagcccctgtccaaagcggcgtttgcttacgcgaacgtagttggggaatttaattggggtccgatggcctggatgatgtttgggaccgcgacaatcgcgattggctatacgatgtacgtgaaaaaaattccggtgcggcggttgagtaccgtaattcccgttttgcgcggtgaccagctgtacaaaaaggtgttgcgacaattaatcgactttctcgtggtgtttggcatcatgggtggcattggttcgtcgattgggatggaaatcccggtcattgcccgcgttttgagtattatcgtgggcatcaaggatactttgtatctgaagttgtttttgttctttattctattaattttattctcactaacggtttacgctgggttaaacaaggggattaaaaagttatctgcttggcacatttacctggcaatcattttcttagcgattgtccttttggttggtcctactaaattcttggtaggttcagaaggacagacgctaaaattaatggggcaacacttcacggcgctatcctttaacaaggctaatgctggtacgaacggatttgcccaacatcaaaccctcttttactggggctggtggttagcttacatgccggtaatgggcttgttcattgcccggatttcgcacggaaaaatgattcggcaaatcatcattggaatgatgacttacggagttggcgggtgtctttccttttacgcagtcctcgggggctacgcattgtggttacaacaatccggtacgttgaacatcgtgcacattttaaatacgcaggggcaagcagcagtgcaagcggccttgattaccaccttgccaatgaataaattgatgctgattttgttctgcgtctcgtgctttatctttttggcaaccacgatttcgtcttctgcatttatcgtgtcgtcctttactagtctggacttatctaacggacggcagcctagtcgttggaaccggatgacttgggtcgttgtatttatcttcttctcactgggaatcgtgattgtcggcgggttcgaagtcgttcaagcaatttgtacggtggccggcttcccattgattttcgtgtgtgcgttgctgttgtactccatctacaaggacgttaccagctacgcgccaatgcaagcgaaggttcctaccagctacttgccagtcgttcgcttacggccgatgcaacgcttagtcttcaatcaccacttattgcacaaccttggccaagatgatttctaaaaggaagacttttaggaaaattcggcttacaataggtatgtaaccaatatttgatgaagggatgagtttctatggcaaaagtagaaagctttgaattagaccataccaaggttaaagcaccttacgtacggttgatcgctgttgaagaaggcagcaagggtgaccaaatttccaattttgacttacgacttgttcaaccaaacgaaaacgcaattccaacggcaggcttgcacactattgaacatctgctagctggattaatgcgggatcgcatggacggaattattgattgttcaccatttggttgccggacagggttccatttaatcgtttggggtacgccaacgactacggaagtggccaaagcgttgaagggttctttagaagcaatcgcaaacgacattaagtgggaagacgttccgggaactgacatttacagttgcggaaattatcgggaccactcgttattctccgcaaaggaatgggctaagaagattcttgcggacggcattagtgaccaaccatttgaacgaaacgtgatttaatcattaattaaatagcaatttaaagaaagagcggtgaccaacttagtcacggctctttttgaacgggaaaaccggttttcccaaaaattaccattttgcatgataagacaggaaaattatttcgtggtagtatgtaagaatatgaaaacacgcaaaggagatgagcgccaatggatgctaaaaacaaaaagactttatggattctgatcgctggaaacctattgatctgtttgggaatcgggctggtaattccggtaactcccttcatcaaaaactattaccactattccacaactcaaatggggattatgacgtcgttatttgccttttcgcaattcattgcgtctcctttagttggccggctttcggaccggatcggacggaaaccgttgattgtagcgggattatttttgtacgccgtgtccgaagtgatttttgcgttatctaattcgctgatctggtttaacgtatcccgggtaattgggggattgtcggcggcgttattcgtgccaacttccatggcgttggctgctgacgtaaccacgcccgcacaacgtgcccgagtgattggctggatctcggcggcctttagcggcgggctaatccttggacccggaattggcggtgttttggcaaacattagctataaaacgcctttctgggccgctgcagcgctaggactaatttcgacaattttcacttacgcggtaatgccgaaaatggaagtcattcgtgaaattgcccatgaagaacatgacgatgagccccaagcggttaaaaagacgggcgcgctccgcgacgtcttaaccgcaccgctaatcatcttgtttacgatgattttcgtggcggcgtttggcctccagggctttgaaagtatctatagtatttacgtaaaccaggtatttaactttgggttaggaaccattgcgttggtgttaacctttaatggaattttttctttgattttacaggtgtttatttttgattggctggttcggaaaatgggcgaagttaacttaatcggagcgtgcttcctcattggagcgattttcgtcttttggattacccaggcgcacactcaaattgaagtaattattgccacattggtagtcttctcggcctttgacattttgcggccagcaatcaccaccttgttaactaaggaaggcaaaaataaccaaggcttaattaacggattgaacatgtcattaactagcgttgggaacgtaatcggcccgattttagctggaatgttgatggattacaatacccacattccatacctattggtagcgttgattctgttcatctcttacgggatcactttcgcggttaaacgcgtgatgaaacacgaagcacaatattaaaataaaaaaacgtgggacaaagatctggtagtttacaagcatcaactgagaattgaccattatgcctaaatttggcatagtggtcaatttttggttaagcggaacaaattggcttttggctctatgaaagccgaaacaccaaaaccatttttaaaaatctttccatccttgaaaagcattactttagttttccccacgcttttttgtttgaagattttttggaggggatgcgagattgtgatacatactccacaccccaactttttccgattaaccaaaataaggcaccaatcgcattttacgcaattggtgccttagcttttaatggttttattgctatgctatatagccaaaatgtgctccagccttcaaggctctacggtcaaccaaattagccgtctaatcgccagcccagcgattagccgactaatccagttgatcctcaagccttacccgaaggcttccgcactctattgaaaatgtgctccacaccctaaccccttccggctaaccaaaataaggcaccaatcgcattttatgcgtttggtgccttatttaagttagtcctcaggagttatccggggtgctccgcactctattttcttcatgcaattcttccagcttccttgcattttccgtgactcgcttcttacttagcgggtagaagaatagtagcaataatgccgctactgacaaacacaccgttggaattcccgtcgccaagttgtagatccggtgaattaccgtggcactttgttccgcaccaccaccggttgacgactgatagccgatgaaggtcaacataaatcctccaaaaccacccgcaattgcttgagcaactttccgggcgaaggagttgactccgtacacgattccatcttcccggacgccagttagtacttcgtgattatcaattacgtcggtaatgaacgcccaaaccatcaggttaaacattcccgcacctaacgagccaaagaacagcataactaggtagaagctcgtgctttgggtgtggacaactagtaggatgccgtacattagggctccaaagagcagcgctacgatggaagtttctttccgcccaaaccgtttggtaaggaaattgctaaacggtgccagcaaaattacggtcgcaaagttgaaaatcaacgcaatcgacattgcggccttatccttaaagtagtcgttaaagaggtaggaaatcatggttccagataggttttggttaattacgatcatgatatcaattagaactaaaacaattaaggctttattttcgagcattccctgaactagccgagaaagtgggacttttgcacttttttcggtccgaatccgttcggtagtgaggtgaatggtcaattcataacagccccagcctagaaaagcacataccacgaccacccagaagaatcgggtccccgaaatcttttgggtagcgccaatgtagataaatagcgggataatgtaactggtaatcgcacttcctaacgcagatcccagcgcccggaaggttgaaagggaggtcttgtcgttagggtcgctactaattgcggccgccattgaaccgtaggggatgttcacgcaggagtaaaagattccccagccaaggtacgtaatgaacacaaaaacgagccgaatcggtaacgcccagtccttaactaccggcacaaatagaagaaccaaaaagatgaggagcggatactgcatccgagacatccaaggtttgaaacggccgcttttatgtaatttactgttatcgaccaaccggcccacggtaatgtcagcgaacgcgtccacgaaccgcgcgattaagaaaagaattcccacttgggcaccagttaaaccaagcacgttggtgtagaaaatcattaagaaggaattgacaacgttaaacgagaagttattaccaatgtcaccaaacatgtagccgactttatccttaatgttaaaaggggctgcgtcgatggtgaccgttttttgggttttgtccaatgtacttcacatccttaaaattaagttggaataattgctaaactacttcacaagtacactgtaagaatagcacctaaagaaagcgttttcaataaaacgatgtaacttggcaaaaaaatgcaattgccttggataagggttgattttatgggcaaaacaaggagaaagtaaaaatttgttcacgtaaaacatttgatattgacagcgctttcatcgggttataaagtaagtgcataactgagacattacataatggatgaatattccgaagacggggtggcacgcaatgaaaactagcactaaagtattggaaataaataatcaaaatgattttttggatgtaattacgaatggagcacgttttcgaatttatttattggatgaaaatattattcgcattaaggggacttttgcggatgattttgcgcctgaacaatcttacgcgctggtaaaaacggcgtgggcggatgcgaccgacgaactgctgggggatgagcggcagcgggtgactccgatttccattaccgtaacggagctagcggatcattattgcgtaactaacggaaagtatgttttaaatattttcaaagagccgttttactttgaaattgtggacgaaaacggccgggtagttcaccaagatttgcctaatcgggcgtttgtggaagacgactttggtcgtgaataccactatagtcggatgggtgatacgaacaaattttatgggtttggggaaaaatccggtaaattaaataaatttaaacgacggatgcggatgcacaataccgattcactggggtggaacgcgcaaaaatcagatccgctttataaaatgattccgttctacattgattttgatcctgctaatcaggtcgcgagcggcttgttttacaacactgcgcgggattcggtttttgatatggattgtgagcacagcaattattggttgcggtatagctattttcagtgtgacggaggtgatttagacgtcttctttattggtgggccaacgattaaaaaggtggtggaacactatacggatttgaccgggaaatcggcaatggtaccgatggcttcttttggctacatgggttcgaccatgttttatacggaactagccgagcacgcggatgacgcgattattgactttgtggaaacttgtaaacaaaatgacattccgtgcgacggtttcttcctgtcttcgggctacacatccggaaaggacgggaagcgttacgttttcaattggaataaaaaacgatttcctgatccacaaaagttcgttgccgaattgaaggcccgcggtgttttactagcacctaatatcaaaccggggatgttaaccacccacccgctagcaaagagttttcaacagaaagcggcctacgtgaaaacggcggatggtcaagcaagtcaaaccgaccaattctggggcgggccagcctattttgtggactttacgagtgctgacgggcgagcagcttggaaaaccgagatgaaaaaagcgctaatctctttaggaattacgtcaatttggaatgataataacgaatatgaaatcaatgataaccaagcgcagattgatgcggaaggcctgcaccggacgattggcgaagttaaaccgattatgtcaactatgatggctaaggcagcacaagaagcgattaacgaagcggctcctgaccaacggccgtacttgattaaccgggccggttttgcgggaattcagcgttacgcgcaaacttgggctggcgataactatacaagttggacgaatttgaaatataatattccgacgattttgggaatgggattatccggagtagctaatcagggatgtgatatcggtggctttgacggcccgcttccggaacccgagcttttcgtacggtgggtccaaaacggaatttttcaaccccggttttcgattcattcttgtaatacggataacaccgttacggagccttggacgtatccagcgtatacccattacgtacgcgacgccattaaattgcggtactccttgatcccgtacttctattcgttactcgacgaagcggctacggtaggttccccaatcatgcggcccctcgtttatgaatttcaggaagatccgcaagtagctgaagaaagctttgagtttatgttgggaccagcgctcctagtggctaacgtggtggaaccgcaacaaacaaccaaagcaatctatttaccaaagggcgcacggtggtttgatttacacacccaccaatattatgacggcgggcaaaccatcacggttccggttgacttaaacagcattccgatgtttttacgaagcggaggtattttacccaccagtccgggactcaataatatccataacgaaccggttgaaaagttgcggattttggtagaacctagtgaagctggaaaatttactttgtacgaagacgacgggatttctaacgattaccggacgggggatttgttaagaacccacattcaggtgacgccgggtagtcaaggagttactttagattttcagcgggaaggcagttacgcgaccaaagttaaggagctagagttggtagttggatgccctgcggtggcaccagtggcggtgatgatagcgggaaacgaagtgccgagatatctcaacgccgcacggtttgcaacggctgcgaagggttggtactacagtggggaaactaaacagacggcgattcggtttgccaatcctgacgctgtaaaatttagcgtagcgattaactttagcgttaaggaccttatttcaatttaatgtaccgaaattttaaagtgaattggccagcccctttccaaataagagtgaaggcggtagaacagggggtaaattatgccactgaatatctttttaaggccaaaagatatacaatagaactgtaaaagattggaggagtattcatgttaaataaatttagccgttacgcagatttaaaacaggtggcgctcactttaattgaaatggatgcggttccaaatgtggagctacggttagcgcaaatcatcgcccggggaatcgatgacacgtttattccagaaaatgttaacccagaagaaatcgacgagtatctaagaacccgcgcgttgcacttttggttttacccatctatgcatatgaataaggtggttcctaaattggcaagggaagtcgctgataaatgggaaattcaacagggtgataagccgatgttagaggcgtgtctagaaacggtgatgtcgtattatccggacgcggctgattataaagtagactctacgttggtaacgtctgatgaaatagatccctaccagactcatccgatcgatactaacttaggaatttatctagctagcaatcctgctacggaggacttagccaccatagacggctttgacgtagcaaaaattaacgggtatctaaacagtcaaggcattcccgggattcctggtgtacgtctaaaacgtagtagagcttaaatgaaacaagcaaaattaggattgggaaacttcccgatcctttttatgtggggaattgcagggtttagacggacggtgctttgctgcggagtcgaaacgtgctctgaaacctagctttctccggttaaccaaattctgacgctcttatgcaagatagtcgaaataagctccagccccaagcttcctgcggctaacccaattcaagcttcaatcgccgagcccgcgattaaaccttgaattctcgggtgctttgctgcggagtcgaaacgcgctatagaacccaaatctttccggttaactaaattctggcttcaatcgcccaacccgcgattaaatccagaattttgttaatcctcgagatttacccgggttctacagcgctctgtagtataataatcctcatcaaccccaatctacattaatataggaggacaccatggctaaaaaacaacctacccgtgcagaagttcccgttgacctaacttggaacgttgcggacatttttgctacggagacagactttcacgacgcaattgccgccgttaagtctcaaattgaagacattcaaaaacttgctcaaaaaggaatacaaaatgcccatgatttacttgcggctactaaattactctacgagagtgaagaagcagtcctaaaaatttatggctacgctgcgcgcgtcaatgacggcgatacggcagacccgcatggcaacgatcttttaaaccaagcactgttggtcttaaataaatgggaggctgccgttgcattctacgatccggcaattacaaacctttctgctgaacaactcgaccagttcctagaaactgaaccagcactaaaacaatacgaatttaatctccggcgcgtgcaagcccaagcggcacatacattaacgccaagcgaagaaaagttattggcccaattacaaccagctatcgacgatgcggcagaaatttctgctaagttggacgatgccgacttagatttcgggatgatcaaagatgaaaatggggaagaggtccaattgaccaacgctactgcaagtgaatttgcactttcaccaaatcaagaaatgcggatgaaagctagccgccaagttgccaaggcgtatcggtccatgcggaataccttcgcggctacgcttcgcagtcacgtgcacgcacagaacattatggctgaaattcgccactttaagagtgcgcgcgaaatgaacttaagtgatcaaaagattcccgaaacggtttatgatacgttaattgaaactacgcatgaacacttagatttgatgcacgattactatgctttccggaagtcgttcttaggcttgaaagatatgtatcaatttgatcggcacgttccgttagttgcggacgccaagttgagtttgtcgtttgaagaaggcaaaaaagcaacgatggccgcgttggcaccgttaggcaaggattatcaagcacatttacaaactgaatttgaccagcgttggattgacgttgcagaaaataaggggaaacgaagcggtggctatgaagacgatgtttacggagtgcatccgtatattttgctaaactggaacgatatttatgatagtacttctactttagctcatgaatcaggtcatgctttacaaagtgtttacaccgatcaagcgcaacctttctggtattcacaatacccgatttttattgcagaaattgcctctacgttaaatgaaagcttactcaaccattacatgctggaaaagcatgccgatgatccccaaatcaaagcctttattttaactcaggatgtggataactttattggcacagtttaccggcaaaccctctttgcagagtttgaacactttatttacagcgaagatgctaaaggaacgaccctcacccccgatttgatggctcagaaatttaacgggcttttcaaaacttataatggggcagcggtcagtgacttaccgtggaaggacgatacttgggcacaaattccgcacttctattatgactattacgtataccaatacgcgacttccaaggcgattgcgacggcgttggcagacgacatcatcaaccaaaaaccgggcgcggtcgaacgttataaggaattcctgtcagcaggtgcaagtaattatccagtggaaattgttaaacgagcaggaattgacgttacgaaacgtgactatcttgaccaagcgtttgtggattttggggataaggttaaggaattaaaagaattattaaagtaattggggaaaatcccatataaaaattaacatctgttgttaataactaagagatcagttattaacagcagatttttttgtggaaaaaagcactatgaacgttgttgtcaggaagcaggtaatctacgatgattgcagttgaataattttgtaaggggtttcgctcgcttatttcataacgttgattatacaattagattgtaaaatgttgaacaattagtttggttaaaggaggtttgtaatggttaataatctacgttacataattaagaaatgtttggtgatcgcgggggcaattattgctacactgttgatcaccacccaattagcgatggcggcgcagaaaaatgtgcgcgggacagccattgaatgggggaattctacttgggcgttagcagatgacggcgaattaatgtcaatgggcggtgatattggacaagcgccaccactacatgatgttctaagtaacaatggaattgaacctgggcaagtaaaaagtattgaatttactaaggccactagtgctcatgatattactgatatgttggaaaacctgcctaatttacagaaaattactaagataagtaattttcattattcgggtaatggtgatcaaatgtttcgtgataacacggttttagaatctattgattttaagggttttgatactagcaaaataaccagtatgagttttatgttcttcaatactggttttaaaagtttggatttaagtggttttgatactagtcaagttacgtcaatgtacgggatgtttgataatgcaggtaaattgagctctttaaatataaaaaatttcgacacacgtaaagttgatagcatgggctttatgtttaataatgttatcgcccatgatcttgatgtgtcttctttcaatactagtaatgttaataatatggaagggatgtttgatggcacttctgtagataaattagatttacgtaattttgatacttcaaaagttggtacgatggaatatatgtttttaaattctgcagtttcgcagttagatatttcttcatttactattggtgatgaagtaaatacatctactatgcttcaaggtacaaatcatctaaaacaactagctctaggtaaaaagagtcaattaaaggatgatatgaatattccggacgttcctaccactgatggttacaccggccactggcaaaacgtgggtaacggcaccattgatgaccctgccggcagtcacgtttggacttcggcagagttaatgtctcaatttgatgctccaacgatgggcgacgacaccttcgtatggcaacggaaaccggcgacaatcaatattggtgaaattaccgattataaaaacgatccggtcctgagcaagtatgtccccacggcagtggatccgctacacccatatcgttacaacgtggtgctaaacaacgactatcctttttacaccaaggttgaagatggccagacggaaaaggacaatgtcgccaatttaggggataagtcgggagcgacggtctatagtcaagctgaaatgcccggtacgtatacttacccaactagtaaacgagctgggcaagcggctaaatttattaaggtaagtttcgatggcagtaaatggtactgggttgaccaacatgcccttaacctagatctaaaatcacgttacccagcggtgaatgatgaagggattgctttgatagatgatcaatttttaggtagtactaatacctatgggattattagtggcgatttcaactcacaaatgattgataatgcctataatccggacggtcaaatcatttaccaaagcttcgccaaagaaagtgattttacggcagaaaaagatcctactcaggctttaaaagcttttaacgacaatttagaccgagcggcgaaaagttggaatgacgctttaggggagaaggtattcattaaagccacggataccgacaagaaggttactttaaaggtggttgctaatcctcagggagcaggaagcgcgacgttaagcggaaatacggggattgatgctagtctggtagaaaaaggagctttggatcctgatggtgagaattatgacatcaacgtgctatttattacgatgcgtcatgaattagggcacagtttagggctcaaccatacgtctaatggccaatattatggaatgccagatggatatcaattcagcattgatgatgacgtaatgaatgctattttgcaccattacgagaatggtcatccaaatactcaaaaaacgatcaccaaagaggacgtgagtgcgattaaattaatcttatccaaccacaattttgaaaacccacaaccgcaaactaagaaggtagtaactaccaagcagattgatcgggcagtttccaaattctaagaacaaaaacaacattgatattaaaaagaacggagaccaaagtgcatagtttttggcctccgtttttgtctaagtatttataattctagcagattcaccaatccatagttgaaatggtggaattctacctaatttttagcggaaaaaggacgaccccttaaaaataatgaaatgggtccttataagttggacaggattatagattaggtaaatcaatcaatttgtaacgttggtagaaatgtttatttaaaatatcctgtagcatggttttttcatcacgagaatcagcttcgtcaaataagcgcaagttgttttcagttaaaacgactgtcaaaaactccatgaccacttggcgactgccagaaagatagtcaaagggcactgaactttgattatccaaaaacacaagttgatagccttgagcaaacttaataaaaggtctattttttcgtgaaattacgacgctttcaattctaggatggttagctagatattcgtaagcctcgtggagaaaagataataaatcttgttcacaatctactaacttaacgctgattcctgaccaacgcaattttttatataacgagaaggagaattctttccgggggacaaggagtacttgtcggctactgatttgctgatgagtgattttgggatgctccaaatgtggagcattaacaaacagtgttttagtagtggaatcaggagctctatttcttaacttaattgcaactacgttatccccataaggcaatggttcgggtaaagaagcgcgaatttctgactgatccttactattaatgaaaataatttcttgagtattttcatcaaagtcccagctaccgtattcatttggaatgaaacctactttggtaggaatttctaatcgaccgttttcgtggaaaataacagcaaagaacgcatctatagaatccttatctcctccgtctaaagttaccaccattggataggaaacggaacttgttctagttattagcatccaaatccgattttcaatcagcttgtatacatgtactttgtctatcattgattatttctcctactgtttacttatatctaaaccatgaattactgtgctctcaatgttcaaagaaaagggaagtaacttcacgaccatgtactaggttgatcgctaaaaaatggtaaacaacataattaaaaagcgccatattgtattgtccaaaacgataaattttattaccttgtttaactttaagtccggcttcggtaatcgactttggcataattcttaagtactcaagcggtgtgactatggaaaccgctgtgatttcaggatctagcgttggtaactggatagcgtttctgcaaatgaaatctttaatgaactgtggattttcatcgctgataactaatagtgaaaaagataggaaagttgtctcaactctcatatataaaatatcgtcttttatgttatcaaaaaggatagttaagcagtgttatgtcgcctttatcgggtgtgataatattccctatttcaggacgcttttgtaagaaataaaaagctataaaatacgataaaagaagacggatagctttaggtagttgtgatgcttagggccaacttggttaggcttgttagtcaattaagtagtaagggatactatgtacttctagagatttggtttggctagaggatttgacaagaatgtctacattatgagttcctcgtggtgcaaaatatcctccatttgagtaatggatatgctaatatcaacgccaggttcgactcacattttgtttcttcctgtacgagtttacatagcagcttattactaaataatattgatatttttttgggcactccatccacatgttcaagtatatacgttagcgaaatatatgcgtatcacctttttgataaatgataaaaaattagtttaagttagagattggaaatgtttttcgaattgttattaactctttcttatagacgattttgtaatcaattttcgaaattaggacactaaaaactggaataaggaaaacataactctttaattaggtactgacaaaaaacaacattgatattaaaaagaacggagaccaaggtgcatagattttggtctccgtttgtgtatgattatttagagttctggcaggcccaccgtttcatagcgggtattaaagcttttaagtagtactacttgaagcattttctctgcactttgatgactcttgatgttgagtaacgtattttttcagaaggaattgaaagtaatgattacatacgtaaccgacgactgcctaaaaaagtgatcaaagagatcatccaaggataataatcgccgcttagaagaaaatttaaatgatgtttgtgatttttatttgggtgcaaatacttctgcaatttcatatcgattagcaaatttgttaagaataatatcttgaagcatttcctcttcatttcgatagtcgtctcgatttaatagccgtttattattctcggataaaacgaccgttaataattcaagaaccaatgcccgttcacccgaaaaatatttgtacgatggttgattatctttattagcgaaaagtatcttctcttcttccgacaattcaactatgggttgacctacctgagaaatcactacttcttctaattgagggtgaacaattaggtactgatatacttcgttaaagaaatcaattatagaatttttagcattaattagtttaatatcaaaatttagaaaagctaagtcttggaatagttcaaattcataaacgctacgtggacaaaaaaacatgtgggtccccccaatgatgcgtttttttattgcatatttatcaacgtgaggttcatgagagaaaacttcatttttatctgaaattaattgcatcttaaacccaccaccaaaccaacggacaggaagctttgcacgtctgctaatttggttctggttgtttaggaatacgatttcttgagtatcttcatcaaaatcccagtatcggtattcgtcgggttcaaaagctacgttagtagggaaagtaattctcccattccgccgaaagcaaagtgctaacatgcctgagccagtcttagtgccaatgaatagggtagtaaaagtttttttaggggtgatttcacgatatttccaaaaacggtcgcaaattagatcttttacttcttctttatttaacattgttaaaaactccttatttgtgcttaaaccatgcgctacttggctcttgataaccatccattatcgtagtaacctctcgaccatggattaaacgttcaccaaagtacttgtaagcaacgtaattagaaattgccatttcaacgtcacttaattgataagcatcgtccccctggctaatttttaattgggcatcggtaattattttgaccatgattcctaaatattcgattaatactgcacgggtaccaaccataacgcccaggtttaaagtcgggagcagtccgttttctctgataaagtcttcaatacactgaaggtcttcatgccaagtgattacaggagtggcaaatatgtaaaaactttcgtctcccatatataaaattccctcttcaactttatcaaacggataattaagcattgtgacgtctcccgcatctgttaacgcagctttttcaatttcgggatgtttttgtaaaaattcaaaggccattaaaattcggtgaaagtacaaagttagattagggtagtgagaaaacagatccatatgaacaatatgagctcctgtatcggactcttggctttctgagttagtcagcacgtaatatggcacgtgaaattgtgataaggattctgcttgggttttagttttagcgggaatatctacatgactattatcctgcccgtaatgaggatcgtacatattaacaatgaattcactgatcacgatatttttttcaactttcatataaaactcctttattactgtgggtaatggacccaggtgttcattatggtgcccgcatttgccatagcacttaaaggcgtagcgtcataagggtgaccatgtaatggcaacttaacccacatagtgatttacgcaagaggctattaaatatgcgctagtgtatagcgatcttggtattgcttattcaaagtgtctaataatagttcatcttcagtgcggtgatcgtcaaggttaagcaaacgcttattattttctgacaatattaagattaataattccatgatgcgagcccgattgccagcaaagtaggtaaacgagggacgttggtcatcttcaaggaatacgagctggttttcttttggaagtttgaccaccggttgcccatccttagcaattaccactttttctaattggggatgttgggcaaggtattcataaactttatcgaaaaaatttaaaattgagccctgataatcaagtactttaaggttaaaattttcacgactgatatcgtggaacaatgccatattaaatgattggcgaggggtgaaatacatattttttccaccaagtactcggttagttgtttgttgtgcatcaatccgcgtatcactaataaaaataccgtcttttccgtcaaataattggattttaagactatcatttaaccaattaacggggagtttcccacgtgcgctaatttgcccattagttccaattaataaaatttcttgcttttcttcatcaaaatcccagtgtgcgtactcctgcggaacaaatgctaatttgttaggaaaagtaattcttccgtctggctcaaactggatggctaaaaagccatccgtaggacctcttccaataaaaactagaacgaaatcattattatcggttacgatgttatacatccaaaagcgattacaaattattttttttaattctcttttagttaacaatgcggtgcactccttatgacggtaatgattaatcagttattgtgtaatgatacgaggaattcttgtagttgtcggatagttttaaatataaattaagagtaaccactcgcaaaaccagtggtgcaaggttgcatttaatccccttaatcgctactatgagaaaatataatcatagtaaaagttataccatgtttagtatagtggttatccttcgtcgtgtctacgaaatgaagaaatcttttaaagttattgtgtagtcaaatgaaacaaagctatgtggtaatatagtttgatttagtttcgataacgacctttggtttggcatagaatacaatatcgtacttaataattttgtgagctgctgtgttagatataaagattgtttgattgcttttctatagaaaaaatttattgtagctattatatgtttaatggcattgatgccagctaacgggaagttaaacattttttacatagataagaaattcttttaagaaaagcagatctcgctcgatcattttccaaagtgacctgagaaagcatgctaagctaaccaggataatcatttatatggttaaaggtttaaaagtactagcttatggtcaaaaagatgacaataattgagaaatcgcatctttaattcaatctgtctttaaaataaaaaggaaattaattcgttgttagacgaaataatctcctcaatagctttaatctacattctgttggattaatttatttagcataaacggattagaaattggttaattactgttattgaaggtattcgcagcgattaataaatttattatgtaaaacctcacccagtaactcattaaccgtacggttatcatcaggagataattgacgcttattattctcagtaattaccgtggtaagtaattccattattactgcgcgacttcctgcacaatagtcaaaagcagttgttatttcagaagaggctaataacacgtgattaagctcttttggtaaattgatgtcgagttctgaggcagcgttgcgagaaattataatattagttaaatgaggttgatccatgaggtactccataatttcttgcagaaattctgttaaatcattttggtggtcaactggataaactggatagcctcgtcttgcaaaatgctgagttaccccctgtttaaagtggtcgcgaggaataaagatcatagtttgaccggctatcgtagggttacgaatttcaaaagcatcgtagtgtgggaaatttaaaaggaattcaacatttttagagttgcccttatcgtccttattaaaaaccatggtgtcaacgttgtaatagaattctttttgcggtagttgtaatcttttttcagcttgttcgtctttacttagaataacaacttcttgtgtgtcgacgtcgaagtcccatttatagtaatcactaggaataaaacccaacttggtagggaaattgatttttccattttcgccaaactcaagggtgagataactaaattcatcatcaggatctatatttaaagttaaaatgcctgcatgaatgtcatagagtttttctttaagtacgaattggaaaaaccataggcgattacaaataaaatccttcacttcatttttgtctaaaatcataataattactccttatttatgtttaaaccaggcgctgcttgtggattgaaatccttgcaagatggtgctaacttctcgtccgtgaaccagccgatctgcgaaataacggtaggcaacgtaattaccaatctccatatcatatttacctaatgctgcagattcgtcaccttgctggatttttaatgaactttcggtaataagcttgagaatgattcccagaaattctagcaaaattgcgcgagtaccgatgataaggcccatgttaacggtaggcagcatttgatgttcagcaatgaatttttttataaagtatggcgaattgttagtatttattatccaagtatcacctaaaagcccccattcatcacccatatataaggtgtcgtcttggatgttgtcgaacggataatttaacatagttacatcgctagcatccgttaaggcagctttttcaatttcaggatgggcctgtaaaaagtcgtatgccataaggaggcggtagaaaaatattgatattccaaaataatgttgaaaaagttctatattgactatatggaatttatccttatctactacttgatctggactgtttgttagaacataaaaagggacgtcatgttcggctaatgattgagcctgttcttttactctttcggaaacatcgagattggtattatcataatcatgataaacgttatccatgttaataataaattcagttatcactacgttaggttcaacttgcatattggtacctccatttacattaaatttgtttattgagaaatgatcaagaaattatagattagataattctattaagtcataacggcctgagaagtaagtgtttataacgtcgtataacatcgtttcgtcatcgtgttggtccccagcaccgaattgacgtaagttattttcggataaaaccataaccagaaattctaagatggcagcacgtttcccagaaagatagtcaaatgaaacttggttttgtttactttgaaacgctaacgtatgttcggtgctaaaagccgttttaggtatgtttttgcgggatatcacgacgtcttcaatttggggatgaagaactagatattcgtaaaccccattaaaaaaatctagtgtttttttagcgtgatcaatgattttgacattaaaaccattccaacgtaatagaccaaaaagagggtaatcaaaagctgttcgtggaataaagaacgtccgatatgtttcaattgctcttttagtgatcgcgaaatgatctagatgtggatcgttaataaacatattttcactatcactatctgaagatgaaagttgtaatttaagggcactagcacctgatccgtaaggcagtttttcgggtaaactcgctcggagtttgggtttaccatctgtaccaacaaaaattattttttgagacgcttcatcaaaatcccattttccatattccttagggataaatccaacgttagttggaacctctaattcaccattttcacgaaaaatgatggaaaagaaacccacgaaagagtcgttttcattcttagcaaatgtaataacttctggagcagcagatttatgcgcacgatgctgcagaatccaaagtcggtttcgaattaattggtatacttgtattttgtttaccacgatgttctatcctcgccttcaattgttcttcttaattaaaatttggaatatcaattaatttatagcgattttcaaatttggtagtgagaaggttttgcaacattgttacgtcgtcatgttgaacattatcgttaaataggcgtaagttattctcggataaaaccataattagaaattctaagatggcagcacgttttccagaaaggtagtcgaaggcagcctgattgtgttcctttcgaaatgctagcgttcgttcggcagtgaaaatagtttcaggaatattattactggatatcacgatattctcaatttgaggatgacgaattaaatattcataaatctcgttaaaaaagtttagtaacttttcaccatgatcgatgattttgacattaaatccgagccaacgtaacttaccaaaaagtgagtattcaaaattttctcgcggaataaagtatgtttgataattttctactgaccttttagtgattgcaaagtggtctagatgtggatcattaacgaacattcttatacgagcatcgtttggcaacggggttttgatctgcatggcaacgagcttatctccataaggtagtgattcaggtaagctagctaccgtttgaaattgtccatccttactaatgaaaaggatttcctgtgttttctcgtcaaaatcccagctgccatattctgcgggcacgaaaccaacagttgtgggaacttctaatcgtccgttttcgtgaaagataatgcagaagaaaatttcatctgataattctttatttccaattagggttaaaaggactggctgattaaatttagatttccgatattgtaaaatccaaatacgatttcgaactagttgatatacttgagctttatctaacattttgttttctccatttttacttgtgcttaaaccatgcgctactatgtttttggtagccaaagaaaagggaactaacttccctgccgtggactaagcgatcattaaaatatttgtaggcaacgtagtttgaaatagccatttcataatgtccaatctggtagtctttatttccttttttaaactttaatttagcttcggtaattaagttgaccataatccctaaatattcaattaatgttgctcgcgttcctgccatcacaccaagattcagagttggtaaagaattagcgttttcaaaaatgaaatctttaatatattgagggttttcgtcattaatgactagccaggaataaaataagaaggttgtttcatcacccatatatagagtgttgtctttaatattgtcaaaagggtaattcaacatcgttacgtcccctgcatcagttagaacggctttttcgatttctgggtgagcttgcaagaaataaaaagccataaaaattcgataaaaatacagggtcatatcggggtagcttcgataaatattatctaaatcaacgtggataatatttaagttgccctttttttcttggctaggttcattggttaagacatagtatggaacttggaaacgagctagtgattgagtttgcttggctaccttgctagaaatgtcgacatcactagtatcttcatgatgaagcaaatcatccatttgggtgaaaaattcgctaatcaccacgtttggttcaacttgcatttaaaattcctccatatgtttttcacagctaattaataatttgtcaactaggtttccctataaattataaacgctatcgaaatatgtgcgtgtcaattttttagtgttttattaaaaactattaaataatctagaaaactgaaaacctaatactagctaagtaagaaagatgtttaaaattcactatgtaacggtgaagtgaagcattaattttgctgaaatgatagccctttctatataatcatatatgagaagtgattcacatatatgattaaggggatgatttaaatgaagcagagaagcagagggatagttggaagttttgtattaatattttttgcaattatatttattttattctttactacctcagcaagggcggcagttgattctaatgtacgaggaaatgctataacttggggggattcttattggacgctagccaatagtggagaacttattttagctaacggtgaaattggacatgctccggcattaaacaaggtattagaagataatggaattgatcctaaaatggtgaagagcattgaatttacaaaaccgactagtgccagttcaattgtagggatgtttggtcatttacctaatttacagagtatcgaagggttagataaattagcttattcgggtaatgcagcgcagatgttccgaggagattcagcaattaggtcagtcgattttaacaaatttaacactagtaaaatcaccaacatgacttatatgttctggggagcagggtttgaaaacctagatctccagaactttaatactagtaatgtgactagcctttatgggatgtttaacggtacttcaaatttacggactttgaatgttggtaattttgatacaggcaaagttaatagcatggactatctattctatggttcaggaattgtagagttagatttatcgggatggaatactagtaatgtcaccagtatgattcaaatgttttataattgtcggaacttagattcagttaatgtaacctcttttgataccactaaagtaacttcaatgtatgaaatgttttctggggcggcattgactaaattggacttgtcttctttcaaaattgaaaaaattgaaactaccaaaatgtttagtaatgcaaggaatctaaaacaacttaaattgggaaagagatctcagttgagttccgatatgcaactaccggaggtcccttctacaggaatgtatactggtcattggcaaaatgtgggtggagggacaatcgatgagccaatgggggaccatatctggacttcggcagaactattgaaaaactttgatgccgtaacgatgggaaatgacacctttatttggcaaaaaagagcatcttccaaaattaataccggaacagttagtgattacgctactgatgaaatgctgactaaatatgtttctaccgcttcgaagccgttaaagccgtaccggtataacgtagttctaaataatagttatcatttttatactaaggtggaagatggacaatccgaaaacgaaaatcaagccgacttaggtgatcgaaccggggctactgtatataatcaggcagaaatgcctgtacaatatactgagggggaccgagacggtgaaaaaactaaatacgtaaaagttagctttgacggtgaaaaatggtattgggtggaccaacatgctttgaatttagatttgaagtcccagtatcctaaagtaaatggtgagggagctgccttacttgacgatatttttttaggttcaacggccacttttggatttgggggtcctagtgacagagtaaattcacaaatgattgataacgcgttcaatcctgatggtaagattatttataaaagttttgcgaaagaaagtgattttactaccgaggatgatcgaaataaagctttaaaggcctttaatgataatttagatagagcagctaagagttggaatgatgcgttaggagccacaattttagttaagtcatctacaacaaatgaaagggttactctcagggtgggagcgaacgctgcaggagcaggtagtcaaacactgagtggtaacacgggaattgattcaaaattagttgagcatgctttagaccctaattctaaaaattatgaaattaatttgttatttattactatgagacatgaattaggacatagtttgggattagaacactcttctaatgggcagtactatggtatgcctgatggataccagtttgcaattgatgatgacgtgatgaacgcccttttggtgtacggatccagcaatgattattatccttacacgcaaaaagtaattactaaacatgatattaatgcaattaaattaattttagcaaatcataattttgaaaacccacaacccgaaacgaagattactaactttactaaaaaggttgatcgagcaatagaaaaatgaaatataaataaaagaagagtatagaacaaaagtttggtgatttatgagtattaactaaaaatcgatcattatgcctgaattgggcacaatgatcgatttcgggttagaggaaataaactggtttttggcgctattaaagtcagcgcactaaaataattttcgaaaaaatgttcatctgtgataaaacttcttagtttgttcgcatacgttttaatgagtgcgcagttgtaaactacggtaacacgttaaataacaaggcacctaacgcaccgccgaccatcggaccaaatacgggaacccaactatacgcccagtcggaattgcccttattggcaatggggaggatggcgtgggcgatccgcggacctaaatcccgcgccgggttaattgcgtaaccggtcgttcctccaagtgataaaccaatggcggtgattaaaatgccgaccacgatcggattcaaaccatcagtgaagttgcctcgggtgaaagctaacagagcgaacactaaaacgaaagttccaattacttcactgatgaagttcatcgcgtaattacggattgccggtccggtagcaaagattcctcgaatggcatcggcatccttagtggcttgccagtggggatagtaatggatccaaacgcataccccgccaaggatgccacccaaagtttgggcaatgcagtaaggaatcacgttggcccaggcaaacttaccggccattgccatccctagggttacggctgggttcaaatgagctgggcttagaaaggcggaggtatacacccctaaggtaactgctaatccccaaccaagcgagattgcgatccaccccgcgccctctgcttttgattttttcagagttacgccagcaacgacaccgtccccaagtaaaattaagatgaatgtgccgacaaattcgccgactaactgcatccataaattagtttccatatctaaacttactcctatctcagataatctaggtgggcttcagcgattacgtcttgaagttcttgactatgttgttgtttttgttccgcactccagttgaagtagcgggccatttcgtcaaccactccttgttgaaggtcggcgatggcgtcgtggtggaagaggaggtggttagtccgccggagcaagtaatctacgggggtcaaggtcatttcttcttccattgagtagtgcagactgatagtttctgcgaggcttaagccaggtgcagccggcaaacgaccgatttgactaaagacccgggccgcgttggatccgaagaggttggcaatcttttccgcttcgggtttggaaaggccgctttcgataccttgcttagcaaagaatgacaaggtggcgtccacgttttgcgggtcgatatccccaccggaaacttggagatgcttggagtcgatcgaattgaagttccggttgaagcgttgcttaagcaatttagcgattaaggcaatcgcccccgcggccatcttccggtaatcggtgattttaccgccagcaagggtgattaggccgtcctgagccacatctaatgaactaccccgggaaactgcagaagggttcggtttattttcggaaagggtgctttctaagtgattaagcacgtcttctacgtcttcgcgactaactaattgtttttcgtatttatccacaatcgcaattacgtcgtcaaaactttgtgcggtaattttaccggaattgccaccgttgtaatcggagctaccgttagaagcaattagtggccgtaaacctgcccagctagcttccacgtcgtcaatggtgatttctgcttctggatagcggtcgttgattgtcttcaaaaggtaatccacgtcagcttgttcaacccgcgggtgaaggaaatcaccctggtagtcggtatcggtggttccaaagtaggttttaccttcccgcggaatcgcaaagaccatccgaccgtcttgttgtccagagtcaaagtaggttggttgaggtacgttgagccgagaacgatcgactactaaatgaacccccttggtaggccgcatttgcggagttacttcgaggtggtcgtccatttcgcggataaagtcggaccacggcccggtggtgttgattacgagacgagcgtggatgtcaaattcttcgccagttaagaggtcctttacgttgaccccgctgacgttgccgttttcgtcgtgcaaaatgtgttgggcctttacgtgactaaccatcaagcccccgttttcgtgagcttttttgatgttttcaattacgaggcgggcgtcgttattccggtaatccaggtaaacaccgccacccaacaatttgtcggggttaagctggggttcgcgttggagcacttcttccttagaaattgtgtaattagtgtatttaggatccgtaaccccggctagttggtcgtataggttcatcgcaaccttgacggagaacatgttaaaagtggatcccggctcgtcgtaaattggtaacagcattggatcaggccggggaatgtggggggcaatcccttggacgaccgcccgttccttaacggtgtcagaaactacttcaacgtcgaagtttttgaggtagcgaatccctccgtggactaatttagtcgatcgcgaagaggttccttccgcaaaatcttgcatctcaattaagccgttattcatccccatggcgctagcctgaatggctactcctgcaccggtaattccaccgccgatggtcagtaagtcgagtgtttcattttttagacgttcaatatcttgtcttctacttaataatgaaaatgacatgtaataatcctcctaagagttagtttgctttacgcggttggtgcttaaaatttcgggttgcagccacggcttcttgccaaccttgataaaggtcgcggcgttcttcttcgcccatctgtggtttgaagatttttccaggttggtattcagcttttaactcgtcgagatcttgccaataaccaacggctaggccggctaggaaggctgctcccagcgcggtagtttctaaatcatgggcccggtgtatctcaattcctaaaatatcagcctggaattgcatcaggtaattgttgttggaggcgccgccgtccacccgcattgccgggatgtcgattcctgaatcacgtttcatcgtgtcaagaacgtcccgtgattggtacgcaagggattgcagggttgccttgataaagtcttctttggtagttccgcgggtaatcccgaatacggcaccccgggcgtcggaatcccagtaaggcgcacctagaccagtgaaggcgggaaccacgtagacttcgttttcattttgcgaagctaacgcggcggcttctgaatcggaagcctttttgaagagctgcattccgtcccgcagccactggattgccgaaccggctacaaaaatgcttccttccaaagcatagtaaaccttgccattaataccgtaaccaatggtggttaataaattattatcggataattgcggttgctcaccaatgttcattacggtaaaggcgccggtcccgtaagtattcttgaccatgccgggttcaaacgcgagctggccgaagagggccgcctgttggtcaccggccattccagcaattggaacttcgctaccatagaagtggtaatccttggtcttaccgtaaaccatcgaatttggcttaacttctggcaggatggcttcaggaatgtttaataattgcaaaatctcggagtcccatttcaactcgtggatgttgtaaagcatggtccggctagcgttggagtagtcagtcacatgaacagcaccatcggttagtttccaaactagccacgtgtcgatggtgccaaaaaggagttcaccgcgctcggcacgttcttgagcaccgctaatgtggtcgagaatccagcgaattttagtcgcggagaagtaggcgtcggttaccaagccggttttttggtgaatcaagtcgccatagccgtctttaattagttggtcggcaatatcagcagtttgccgcgattgccatacgattgcgttataaattggcaagccagttttcttatcccaaatgacggtcgtttcccgttgattggtaatcccaattccgctaatttgactgggcttgatgcctgagtcaataaaagcattagcaatcgtagacgaaacggcgttccaaatttcgttggcattgtgttctacccaccccggcttagggaaatattgcgtaaattcgcgttgcgcatcggcaactttacgcccagcatgatcgaatatgatcgcacgcgtgctcgtggtcccctcgtcgatggccagaatgtatttatctgccatgtctgtacctccataaatatttaagaatgattgaagtttaagaaagcgctttcgtaacttcaaaataattataaactatttgtaagtaatttagaaatagaaagttttgtcgagaacgaccacaagaatttgatataactgcggggggtgcaggatgtttaaatgctggtagcttagaagagaactcagcgtggtaattggttgcaataaaaaaagctttcagaaaaatctgaaagctttcaatttaatgactaagctaatcgttttagcccaattgatctacggcgtccattaaggaagctaccttagcgttgtcgtcctggcggtcaatttgaattacttgccagcctgctgcttgggccggttggatatccttagtagggtcgaccgcgatgtgaacgtgttcgtcaacgtcacctaactgttgggcaacgtatgcgaagaatcgtgcgttaggtttgtaagcctggacgtcttcggcggtgatgatttggtcaaaattatgttccagtttaaccacgttagcttgaattaaatctttagagtggttggtcagtaagacggtctcgtagcctttttctttaatgttatatagtgcagttggtgcatcggggaacggctccattaccgtgtgggcaattaaaacgtcactaaaatcacttgggtcaatcgtgaagtttagttcttccgcagtttcgtttagagccacttccattagtttagagtacttcataaactcactttgttgcattaaagcttgttctttttggcggtaagtatcccgaaccttcttttcgtcaatatcgtagcggttgccaattcgtccaaccgcttcgtaaaagggttgcacgttaaacaaggtgtcaaaccctgcaaagctaactacttttttcatttataacaccatcctcaattattcttaccaatccattatacaggtttctaacaaatcctaaattcaaaacttggcgagagttttagttatgctaacataagtaaggttaatcttttgaacgaggtggaatgctgatgcatttaaaaattgaagacacccgtctatcaaccctgttaaattcagtggtggtgggcggcttaatcggattaattgttagtatttttcgactgacgattgaaaaactgctaatatttttccaacaactataccaaaatttttccaccgactggcagtggattgtcctggtaaaccttattttagcagtcggagtaggctttttagttaaaacgacgccagatatttcgggatccgggattccccaaattgaaggacagctatcgggagaatacgaggaacaatggtggccggtattgtggaaaaagtttgtcgggggtattttagcaattggttcgggactaatgttaggacgagaaggcccttcgattcagctaggagcagccgtagggcaaggctggagcgaaactttgcggtaccgcggttcgcaacgccgggtgttaatcgccggaggagcagctgccggtctatccgcagcgtttaatgctccgattgcgagcaccctgttcgtgctagaagaaatttaccacaacttttccacgttagtgtggattagtgcgctgacgagtgcggtggtggcaaacttcatttcgctgactttttttgggctaacccccgtgttggcaattgtttatccccacgcactgccgcttaatttatactggcacttgttggtattaggaattttactgggactttttggccggttgtatcaaatctgcacgctgaaattaaagacttggtacggtaaaattaaatttttaccgcgatggttggatagtttagtaccctttatcttaattattccggtaggctggggatggccggcctaccttggcggaggaaacacgctgattaccacgattgcggcgcaaaatccggtgtttgtaacgctcttgattttactagtgattcggtttgttttctccatggtttcgtacggttcagggctaccgggggggatttttcttcctatattaacgctcggagcggtaagtggcgccctttacgtaagcataatggcacactgggggttgatcgacgcccgttacttacctaactttgtgatttacgccatggcgggctactttgcctcaattgggaaggcgccgtttacggccatcctgttgattactgaaatggtggggtcgttgcagcatttaatgccgttagcggtggtggcgctagtagcctacattgtgttggatttattgggcggcgaaccaatttacgaatcgttgctccaccagttggtaccggatattttagcggaaccgcagggtcgccaagaacgggtggaagtatttgtaaaggaaggctcccaatttgacggggcggcagtccgcaacgcgcaatggcctgcacatagtttgttgattagtattcagaggggcccgcgtgcaattgttccgtctggagatacggtgattaaggcgggcgatacgctggtagtaacgttacagcacggaaatcgaaaatacgtagaggaatacataaaacagagggcggagtaacccgggtagctcttgaggattaacggaaatgcggcattaatcgcggtttaggcggttgatgccgcattttggttaaccggagagagctgggttacggagcccatttcggctatgcggcaaagaagcgcaaggattaacggaaatacggcattaatcgcggtttaggcggttgatgccgcattttggttaaccggagagctgggttacggagcccatttcggctatgcagcaggaaagcgcggtaatgacccgatggcaaaaacttgttgcgttaaatgtttactgacagaactattaaaactaaaggggtccctttttttcgattatctgttatgctaatcacgaaaatataactggaggtaatcgtatggcaaatttagttcgaattggtaaaagtgacgtagaaaccacggcgttaggtttaggaactaataaagttggcgggcataatttgttcccaaatttaaaggatgaagatggttatgcggtcgtgcggaaggcgttggatgaaggaattcaattactagataccgcctttatttatgggaagggccgttcagaagagattattggcgacgttttacaagattacgaccgctctaaagtggttttggcaactaaggcggcccaagatccgctgcacgattaccaacccaacaacgatccagagtttttgacgttgcaaatcgacgcagctttgcggcgtttgaaaacggactatatcgatattttttacatccattttccagacgaaactactaacaaatacgaggcaatcaacgcgttagttaagacacgtaaagaaggaaaaattaaagccattggggtttctaatttctccttagcacaaattaaggaagctaacgtggaagacgtgatcgacgttgtcgaagatgattatagtttagtgcaccgggatgcggaaaaggaattattcccatatctcacagaacaccaaatttcttttgtaccatacttcccattggcgtccggaattcttacgggaaaatatacgaagaaggatcatgaacgctttgaccagtactcggaagctcaatttaatcagataattgaagcaactgaaaaggtgcgccaaattgcggaagcaaaacaagcgaccgtggcgcaagtgatcttggcgtggtacttgaagaacccggccatcagcgtggtaattccaggggcgcgcaaaccggaacaagtggaaagcaacgcaaaggcaacggaaattgaacttagcgaacaagaatataaggaaattgacgaatggtttaaaagctagagggcggagtaacccgggtagctcttgaggattaacggaaatgcggcattaatcgcggtttaggcgattgatgccgcattttggttaaccggagagagctgggttacggagcccatttcggccatgtagcaaagaagcacgagaattttcagcgtgagctggttaacaaaatacgagggcgcttgcttaatcccaaaagcggttattatgtctggaattggcataataaccgctttttatattagcacgcactaattattcgacttttattgactactctcgaatcaaatcggcaattctttgttggtaaggacttaagatccggtctttacgttggaccaggttcatgtaaaacaagggttgctcttcatcgaaaaagggcaggacccgaacgtccgggcgtttaattaccgcagaattgacgataaaacccacccctacgttttgggccaccatttcttgaattacttgggaatcattgctttggtaaaccacgttaggccgaaaattggtaatgttgctgaaattacgcagagcctccgcatgaacaaaattgctatcaaaggtgataaacgactcgttttttaattcggagaaccagattttgtcgcgagaaaagaagggcgattggttaccgacaattgcgacaaaatggtcgttgcccaaatgttggtaagctagattttcgttgaattgcttttcgatggcccccattaaggacatgtcgagggtcccagcaagcagcatttcctctagctcagccgaccctttttccacgggcacgatggcctttaacaaattttgttcggtaaggcgtttggcaatccgcgggaaaaagtacttggtcataatgggtggcagacccaagattaatttttttgtattgatatttttaatgctattttgggcgacggttaggtggtccaagattgcttgcacgtgttcatctagttgttggccgcttagggtgacggacaaatggtgtcggccttgatcccgggtgaacagcgtggtttgaaaagtatcttctaagcgtcggatagccatgctgattgtgggttgactaacgttaaattcttcagcaaccgtagaaaaatttttattttttactagcgaatgaaaatattttaaatctttagtgttcataatgtccctccataaccctattatatcaagctttttcggttaaatataaaaataatttataatatgctaatgatttgactatagcaatccaggagtcttaaacttaccgcgtaataaaaaattggaggaaagcaaaatgactgaaaaagcaatgagtattttgaacaatccttatttaaataagggaactgcttttacaaaagcagaacgcgatcagttagggcttaacggtttgattccaccatacatccaaactttggatgaacaggtagcacaaacttacgctcaatttcaaactaaggctaatgatttagaaaaacggttattcttgatgcaaattttcaacgaaaaccgggtactattctacaagttgttcagtgaacacgttgttgaatttatgccaattgtttacgatcctaccattgcggatacgatcgaaaactacagtgagctttatgttcaatcacaaaacgcaactttcctttccattgatgatccagataacatggaaacggcgttgaagaacgcggctgatggtcgagacattcgtttaatcgtagttactgatgcagaaggtattttaggaatcggtgactggggaactaacggtgtcgacatttcggttggtaagttgatggtttataccgctgctgctggaattgacccaagccaagttcttccagttgtattggatgtaggaaccaacaacgaaaaattgttgaaggacccaatgtaccttggtaaccgtcacgaacggatcaagggcgaccgttactttgaatttgtggaccaatttgttcaaactgcagaaaacctattcccaaatatgtacctgcactttgaagactttggacgtgaccacgcggcaaagattttgaacaagtacaaggatcgttacgtaattttcaacgatgacattcaaggtaccggaattattactttggctggtattttaggtgccctaaatatttctaagcaaaagattacggaccaagtttacctaagcttcggtgctggaactgcaggtgccggaatcttgagccggatttacgcagaagtggttgaaaacggcttgtccgaagaagaagctaagaaacacttctacatggtcgacaagcaaggtcttttgtttgatgatgacgaaacgttgacgccggaacaaaagccatttgcacgtaagcgcagcgaatttgaaaacccagaagaattgaccgacttgctatccgtagtgaaggcagttcacccaactatcatggtgggtacttctacaaaaccaggtgccttcaccgaagaagtggttcgtgaaatggctgctcatacggaacgtccaattatcttcccattgtctaacccaactaagttagctgaagcaaaggcggaagacttgttgaaatggacggatggtcgcgccttgattgctaccggaatcccggttgacgatattgaatacaacggtgttacttaccaaattggtcaagctaacaacgcgttggtttaccctggtttaggtttaggggtcattgcctcaactgctaaagtattaaatgatacaatgatttctaaggctgctcattcattgggcggtatcgtagacgtaagcaaaccaggagcagcggtattgccaccagtttccaagttgagtgaattctcacaaacggttgcggaaggcattgcccaaagtgcagttgatcaaggattgacaaaagaaaccatcaccgacgtgaaaaaagcggtggcagatacccggtggactcctgaatactaaaaattaggagcgataacgatggcggactatcgaattgaagaagatacattaggaaaggtaaaggtgcctcaacaggctttatggggcgcacaaactgaacgcagtcggcacaattttgcgacgggaccgttgatgccggtcgaagtaattcgagcattaattaacgtcaaaaaggcggctgcgggggtgaacaatcggtttggattattacctaccgaaaaaacgcggttaattcaaaaggcgagtgaccaattattggccttagatgatgcaactttaatgcaggatttccccctgcgcgttttccaaactggttcgggaacccagacgaacatgaacgtcaacgaggtgattgtgcacgttgcccaacaaattgattctgatttggcgcttttacctaacgacgacgtcaacaaatcgcaaagttctaacgatgacttccctacggcaatgaacattgcggcgagtcaagcaattaaccaccttctaccagtgattaaaaacttgattgccacattaacggaaaaacaaagacagtattgggacgtggttaaaatcgggcgaacccatctacaagatgcaacgcccttgactttcggccaagaaattagcggttgggtaagtacgttagaacatgatttagattacttggcgaagctcaaggatacgttattagagctaccgattgggggaaccgcagtgggaacgggattgaacgctcctgccggttatgacttagaaatggtcaacgaattgagtaaggtgtacgacttacgatttacgacccaaaataagttcttcgggcttagtgcacattctggaattggagctgtgcacggcgcggtgaaaactttggcagccgatttgttaaaaatcgctaatgacatccgtttcctagcaagcggtccgcgggctggttatggggaattgacgattccggctaacgaacccgggtcttcaatcatgcctggtaaggttaatccaacccaagcggaagcattgaccatggcagcaactcaggtaatgggtaatgacgtaacgattaacgttgctgctagccaaggaaactttgagatgaacgtttataaaccggtaattatcttcaactttttagattccgtcaatttgttaagcggggtggtggctcagtttaccgaaaagatggtcgcgggaattgaaattaacgccgaccggatgctggacttggtggaacaatcactaatgaccgtgacggcgctgtcgccacatattggttatcatcaagcggcagagattgcccaactagcaagtcgggaaggattgagcctcaaacaagctgcattaaagagcgatttggtgaatgaagcggactttgaccggtgggtcgatccgttgaaaatgacgaataacaaaagagagagtgagtgaattcgggtaatcttcgaggattaagaaaattagagtgtttttagacccgggtagcttctgaggactaactagatcacagcattaatcgcgggtttggcgattgatgctgtgattggttagccggaggaagttgggtttaaaaacacgtttcgactgtgcagcagagaagtacaggaattaagaagattttccaaaagctcgttataaagagaaagagagagtgggtaagatggcggcatttattacgtccgttgaaagtattattaccattctgttgatgatggcccttggctttggtctacgaggaatgggatggtttgacgaccattttagtggtagtatttcaaaattaattatgaacgtagctctaccagcttcaatttttgtatcggtaatgaagtatttaacgttaccaaaactagttagcttatcaagcggattgatttattcgtttggtggagtaattattggatatatcatcgcatggattacggttaagttattaaaggttcgcccaggacgtcgcggactctttatgaataccgtagttaacgcaaataccattttcattggattgccactgaacattgcgctgtttggttcgcaaagtttggcatatttcttggtttactacgtaactaacacggtttcgacgtgggcgttcggggtattcttgattgccaacgacgaccccactaagcaaaagggtgaccaaggtacggaacgtaaagtgaactggaagaagcttcttccaccaccacttcttggctttatcgttgccatcatctggttggtactcggtttgccagtaccaagctgggcaggtaacaccttgagttacgtgggtaatttggtaaccccattgtcattaatttacattgggattgtgctttacgatgctggattgaagagtatccacttcgaccgtgatacggtctttgcattacttggacgttttgtattgtcaccattggtaattaccggtttgattttgcttggtgcacacaccggacacgtattgccaacgatggaaatgcaaacattgattgtgcaagcagcagcaccaggattagcggttatgccaatcctagcaaacgaatcacatggtgacgtaaaatacgcaaccaacttggtaacgacaagtacgatcctattcatcgtagtcgtaccaattgtgatgacgttgattcaatttatctaaaggacctgattaggtctcgaggactaacttaattagggcattaatcgcgggttgaacgattgatgtcctaatttggttaaccggaggggactgggtttcggcacagcggtattagaatatggaaaatgtggttttacggagaagcggattagcgatcgcagcaaaaagcgtacgaccggttaaaaagctagcaaaaataaagagagaaaatggttaaaaattaacagaggacggaattcagttgtgaatttcgccctctgttttattttaaatatgagttttatacatagaatctatgaactatagttagagcagtgtctatattaaaaagaacgactactggttatgaaggaatggttttaaagttagtttaatttccaatcctaaaccatgtgcatagcgatttagagtttctagagaaggggtggagtcaagactttcaattttagcgatacgagattgtgccatgccaattctaaaagcaaagatttgacgagcttattaaaatttgttaatttacttgttgataaaacctatctaaacgcgaatggggaaattttgatgagtgtggcaagtatctaaatgtaaatattggcgctaattgaaccggggaagacggtttttttggcatgcttttacaagcgatacctgtcaaaataaattttaagtttagtttgaagacgacaggggattactgtggtcttttttttgttttaattaggttttatcggataggtgtctcttttatgagaggaaaaagagatgtttgatcaatcattatttaaaaaattacaatttgaccgagtaaaaaggggagttattgctaaagcagttggtgattttagtaaagagaaacttgaaaatatgccaattgaaagcaatttagcaagtatcagggttaaacaacaagaaactaaagaagcacgaataattattgaaagtggtcaatatattccattactaggcttgaaacagattaaccggttaatgaataaaattgataagggcgtgattctgacacccgcggagctaatcgaatttgcagatttcttgcgtagtaaccggatgttaaaaaaattctttgaaaagaatcggtatcagacaccaaccctgtataagtacagccaggcgttatctaaattcacgtctaccgaggaacacatttaccaaaaggttgatgattatgaagtactagatgatgcttctcgagatcttcggaaggcgcggaggcaatttaaaactatcaaggacgaaattcaagttaaactaatgaagtttttgcgaagtcctaaaaacaagccgatgatccaggacgttttgatagttgaaaagcaaggctcgataaccgtcccaattaaagcatcctataaatttaaggttcctggtacgattgtggatcaatcaagtaacggtcaaaccgtttatatcgagctagatttagtcgctaagcttaacgaaaaacgcgcgtttcaaaaggcagttatcgaatctgaaagctatcagattctagctgaattaacgggcgaattaagtgaacaaagaacaagtattttaaatgctattgacgctgtgacaatgtttgacattatctttgcaagggcgaagtatagccgggaatacggtggaattactccgcaaatcaaccaagcggagcgcattaatataattcaagggcggcatccgttcttggtcggtgcccccgtgccgttagactttcaattaggaaaggattaccggggattgattattactggtgctaacgccggtggtaagacaatcgtcatgaaaacagtgggattgttaaccttgatggcgatggctggattacaagttcctgcccaagcagggactgaattagcagtttttgaccaactatttgtggatatcggcgatgagcagaatattgaaaatcaactcagcaccttttctgcccacatgaaaaatattgcaaagattgttcaaaaggctggtcgcaatacattggttttattagatgagttgggcagcggaactgatcctaacgaaggggccggattggcgattgcgattctggaagacttgtatcgaaagggagcattgatcgttgctacgacccattatggagagattaagaatttcactaaaaagcatgcggattttgcgccggccgcaatgaaatttgatcgtgaaacactaactcctaagtacgtactgcaagttggtgaagttggcgacagtcaggcgctttggattgccaaaaaaatgaggatgcccaaagcattgattctgcgggcagataaatatattaccaatcaggcgaaatatgcaaccgaaaaaatacagtttccgaagttggcgaagactgatgatctgtccgataaagccgaaaacgaattgaggtaccgaaaaggcgatcaggtttatttaacggaactcaaaaaggcgggactagtttacgaagatcacggcgatgacacggtagcagtctttgtagaacatggctttcaaaatgttttacgaaaacgaacgcggttaaaaatggccgccaacaaattgtatcccgtggattatgacttggagagcctctttactgattttcaccaacgaaaaatgcgtaaagatctagaacggggctctaaaaaagctcagaagcagttggataaaatggcccgagcaaggcgaaacaaaaattaagaaatgaactaaaattgcgcagactgtgaatattaattaggaatcggtaattatgtctagtttaggcgtcgttgccgatttttagttaaggagctggcacccgtcgcattacattagaaaatcaaccaaaaaacgctttttgagaattcaattcttaaaaagcgttttttcaataattctaccctatagtaaccaatcaggatctaaacttaaccgcgggatggaatcttaatctgcgctgaatctaaagctaatgcttcggttttacgcattaagtcgtttagataaaatcccttaggcaggttagtaggttccttgagcgcgtaaatggtcaacgtatattcgtggtcggtaggcggcttaggtcccgaatagtgttcgaaaattgcgggatcatccacgtctaaaaacttagaaacataactattctttccctgggtcatcccgttttccaaagcgctggcgttttcaggaatcagattggtcacggtgatgtcggtcgcgatccaatgaatccacggaaaaccagcaacgggaacggcgtcgtaatcaattaaagttagcgctaaggctgctgtgtcagtaggcaactcgctaatttcaatgggaaaagaccgaattggcaaatcgtgaagcttgtcggctgcgggtgcgtatttgccaaaacgatcgggtaagtacccgttagataatgcaacgttaattttcataatttatcaccttcctagtttgattataaccgtaaagttccgtaagtggtaaacaacctagtttgctagacaaactttaataattttccgtcaagttgtgcgataattaaaagagataattagaaatggggggcacggttttgaaattaatttcgtggaatgtgaatggtttgcgtgcagcggtaaagcacggctttttggacgtttttaacgagttggatgcagatatgttttgtgtccaagaaaccaagctacaggaaggacaaattgacctggatttgccggggtaccaccaatactggaattatgcagaaaagaaggggtattcgggaacggccatcttcactaaacgggaaccggtggcggtctcttacggtttaggaattcctgaatttgatcaagagggacgggtaatcaccctggagtacgaggaatttttcttggttacctgctacactcctaattcacagccggaattacgtcgtttggattaccgaatgaactgggacgacgccttccgagcttacgtaaaacaacttgccgacactaagccggtaattttttgtggggatttaaacgtagctcacgaagaaatcgatttgaaaaacgaccgcactaaccaccataacgccggttttactgatgaagaacggcaaaagtttaccgagttgctgcaaagcggatttacggatacctaccgctatttctaccctgataaagagggcgtttactcatggtggagctaccggtttaacgcgcgagccaacaatgcgggttggcgaatcgattattttgtggcctcccaagcattggacaagcaactcgcggatgctaaaattcatacggagatttttggttcagaccactgtccaatcgaacttgacctgaatttatagaaacatgatataggagagaaaagatgagtttaccgaagccaattgaaaaaatgaacctaacggaagctaacgaacttgcggaacaactccgtgaaaagctcgaccgctggagtgagttgtactacaccaaggatgctcccgaagtcgaagattacgtttatgatgaaaattatgcggacttgcaagctttagaacaagcatttccagaaattgcttcgccagattcaatcacccaacgcgtggggggcgaagtgcttgccggatttaccaaggttacccacaccgaaccgatgctgtcgatgggcgacgttttctctaaggaagagttggcagaatttgaccagcgtattcagaaaaatgtgggccatccggttgattacaacgtggagcttaaaattgacggattagcgatttcattagtgtatgaagacggtaagctagtgcagggttccacccggggagacggaaacattggtgaagacattaccaagaatctaaagaccattaaatcggttccccagacccttagtcggccgctttctttggaagtccggggagaatgctacatgccgaaagcggcgtttgcgaagttaaacgaacagcaatcggcagcggggaaatccgtttttgctaacccacggaacgcggcggccggtagtttgcggcaactaaacacgcaaattaccaaagcacgcgagctcgacacgtttatctatacgctggtggaacccgaagttttgggtgtacaaacccagcatgaggctattcaggcaatggcagagttaggatttaacactaaccccacccaaacggtttgccatagcttagacgaagtttgggattatattgagcgttatgaaggtcaacgcgacgatttgccttatggaattgacggaattgttttaaaggtcaatgacttagggctacaagcggaattagggcacacggttaaggtgccgcgttgggaaattgcgtacaagtttcccccagaagaagaagcaaccgtggtgcgtgacattgaatggtcagtgggccggacgggggtagttactccgacggcggtcatggatccggtgcaactagctggaaccacggtgagtcgggcaaccttgaataacgtggatcagcttactgctaaggacgttcggattggcgacacggtgttattgcataaggcaggagatattatcccggaaatcacccgggtcgtcttggataaacgcccagcagacgtggcggacttgaccatccccgatcaatgtccttcttgcggtaaagaattagtacatttaaatggtgaagtagccttacgatgcattaacccagattgccccgcacaaattgtggcacgtttggaacactttggatcccgcaatgcaatgaacattatggggttgggtcctaaacagattcagcaactttatgcaaagggatttattcaccattttgacgacctatacaaattaactgccgaccaactaagccaattagacgggtttaaggaaaagcgggtcaataacttgctagaagccattgaccgtagccggcaaaattctttggaacgcttggttaacggacttgggattcagggcgtaggaactaagatggcccggacccttgctgaagcttttggttcaatggatcgattaatggaagcgtccgtggaagaatttgacgcagtagatacagttggtgaaacgcttgccaataatttggcgaccttcttccaaagtgaagcagcgcgcaacatgattgacgagttgaaggctgtggacgtgaatatggaataccttggcgcgcaaccaagcgaagcaccagaaaactactttaacggtaaaaaggtggtcttaactggtaaattagagcattttactcgtaacgagttgaaagaaaagctattgaacttaggtgcagacgtggccggttcggtttcgaaaaaaacggacgtgttgattgcgggcgcggatgccgggagcaaattaactaaggcgcaagacctgggtgtagaagtgattgacgaagccacggctttagaaaaattagagcaataaaaaaatgggattactcccattttttcttcgtccgaaaaacgactaatttactaaaagcatagttagaaatgatgacgacgacgttatcaatgattttaacgaagatgtcgtttccgtggagcagggaaatccctacgtagaggatgacgatatctaacgccaacgtagcggcccgcatcaagaaaaagcggagcgcttcggcaaataaatcgctggcggttgaagtgtgggaattgaacacccacagtttgttactgacgtaagcgaccaaaaccgacacaaaccaagcaattacgttactgacttggtagaatatatgtaattggtctactaacacagcaaagaccacgatattaaccaacgtggtgaccacgccccagaagaggtatgatataagggatttatattttttaaaaagttgcttaatcaaggtttcatctccaaattctttagagttaaccttttaagtaaaacatgaaacttaagaaaagaaaagtttagacataaatttagacaggtgaactaatttgaaaaagttatcagtgattgtaccagcttataatgaagaagaaaccgtcgagctgttttacgacgcctttgcgaaggtggaaaatcaaatggacgttgagcccgaattgatttttgtcgacgacgggtcaaaagataaaaccctagttgaaatcaaaaaacttcaaaaattacatgaggaaatccactacattagtttctcacggaactttggcaaggaagcggcgttgtatgccggcttacaaaaagcgagcggagaactagtagcggtgatggatattgatttacaagatccaccggaattgttaccccaaatggtcaaaatgatcgaagagggcgagtatgattcagtggctacgcggcgtaaagaccgggatggagaaagccccgtgcgttctttctttgcgcggcaattttacaagtggatcaataaagtgagctctttggaactcgtggacggagcccgcgatttccgcgtaatgacccgccaaatggtggatagcgtactttccatgcgggaacgggaacggttcagcaagggactctttaactgggtcggctttaacacttactatatttcttacgaaaaccgcgaacgggctgctggcaaaacttcatggtccttctgggggttaatgaagtacgcgattgaagggttcgtatccttctcaacggcgccgttatcgtttgtgacctctgccgggatcgctacctgcgtgttagccgtgctaggagctttggcagtaattgttcgggcgattattttcccgcacacctctgcgtttggctggccttctttagtagtgatcatcctcttctttagcggtgtgcaactactaagcttgggcattatcggtcgttacattgccgaggtttacttggaagtcaaggaccggccggtttatattgttcgggaggagaagtagggcttagtactaagcttgaataagggggagttaattattaaacatatattccaaaaatttaacttaaaaagatttttccttatcttttttgtcagtttatttttagttctgccacaaattattaaccggaatatcattttaggaaatgacgctatctttcattttaataggttctacgattcttatatgcaatttaaaactggtaattttagttattttcaaactaattacggttttcaacaaagtggaagaattgttaacgctttgtatggaccattgatagcttacatattgggcggaatactttttttagtccatagctggttaaaatttcaaattatagtatcatatttaacatttttcgtgagcggatacaccatgaacctcctttcaagaaaagtagggttatcaaatagatggagtaatataaattcgttgctttttatggggagcatgtgggttggtagatgggctcttgaacaaaattttatgtcgctaggtataatgcttatgcctttggttgtattaatggggattaacctattgaataacgacctgaaaacggtaaaaatagtacaacttgcaatggtagtgtcactaattattcaaattcacgttttaagtgccgttatttcagtattagtcttaatgattttttttgtggtagctgtattaaaaaataggaataagtgggatttatttctaagatgtgtgggagcaggcgtacttagcctagttttgacctttaacgtttggggccctatgctagagatttatagtagtaataatttatacacaccatttaaaacggttttatctgaatcggctattaatatatctactagtgatgctgacttccggcatataggtctggtgattagtgttttatttgttttacaaattgcttattattgtctgtatcattcagatatgtcctttattaataggatagtaactggcatagggattttcatgttggttatatcctcaaatgtgtttccttgggagttagtagaccgtaagttaccttttcttaagtcactgttacaatttccaattcgttttgaaggcatggcctttatacttttaattctaggtctaagccttactttatcgagtgttaaaaacgaagatgtccaaaaaatagctttgtccttttttatgatggctgcaatttttggtttgatacaaactaaccgttcaatgcagttaaagagtgagatatggaattcgaagaatccagtttcggatacaactaatatgcaatttcaaacgaaagatcccaaagctattagaaatgcatttagaggtagaaatttaaaaaagggattggaaattcttcaaaaaccaaatacagactatgtgtctgcacctaacaccaataaaaagacagaacacccatactaccaatatgacaaagacttcttatctacagatcgtaaagtaaataaaactgtgaaatctgatcaattattggttacatggattgcgcatgaggataattcaacaacaaaactacctataactgtgtataaaaattctgtattgaaattaaacggacatagtataaagccaaaacagattacctttgatcctttaaacgtgcctagtattaagacagaaaaaaaaggaaaaaatactttgtcattaagatatagttcacgattcatgaataaatactttttatggggtgtatatgcaatttggggagtattgctgttgcaagcattaaagaactttctcaagcgaataagatagcaagacatctaaacgattattttatagatgatatattacattttttttatttttttaatctaaagatactaataagatttatttgagatagaataatgtattatctttaaagaaacaaccaaaatcctatttttgtgtatggaaggaatttaattatgaatgcaatgtttcaaatcattaaagaccagttcttgaattttaaaataattcgtagaatggctaaatatgatgatcgagctacatatcaaagccattacttaggattggcgtgggaatttttaaacccgctaattcaaattggaatttactatctagtattcggagtggctttgaaacgtggagatcctgctccaggagtgccttacctgccatggatggttttaggaattgctccttggttatacatgaataaaacaactttggacgcgtcacgaagtgtttaccaacaagttgggttggtgtccaagatgaagtttccagtcagcgttttaccatccattaaaatatacggtaatttgtatagttactggacgatgatggcatttggcgttttcttaatgtttactaacggtatttatgtttccatttcgtggattcagttcatttactattttatatgcatgattgccttaatgtttgcggttggaatatttaattcgacagttagtgtgctaattcgcgactggcatatcacgcttcagtcaattttaagaatgttgttctacatgagtggggttttgttcaactttacaacgtctaattttccagcattcttagttcgcttgttagaattaaatccattttattatgttttaaatgggatgagagagtcactgttaaataaagggtggatttggcaacagcctaacgttaatttaacaattgtcttttggttatttgttttaatagtaatgattgtaggaagttatttacacaacaagttccgttcacattttgtggatttaatctagtggaggtttgttaaattgaacccagaatacaaagtagaagtaaaaaatgtaactaaggaatacgatctatataagactaaaagcgaccaattaaaaaacttttttagtcttggaaaagtagatgtgcctcatttttggtctttaaagggagttagcctctcgattaaagctggcgaaactctaggaatcattgggattaacggttcgggaaagtcgactttatcaaatattatttcaggtattatccctcaaaccacggggtctgtagaagttagaggggatacctcgattattgcaattggagcaggacttaaaagaaatttaacgggagcagaaaacatccggctaaagggtctaatgcaagggttaagtattcaagagattgaagaccttaagagcagcattattgattttgcggatattggtaattttattgatcaaccagttaaagattattccactgggatgcgttctcgtttgggcttcgcgattgccgtgcatattaatcccgatatcatcataattgatgaggctttatccgttggtgatgacactttttatcaaaaatgtgttaataaaattattgaatttaaaaaacaaggaaagacgataatatttgtaagccactctcttggtcaagtcgaaaaaatttgtgatcgagtagcttggatgcattacggcgatttacgagaaattggggatacaaaggaaattgttgatcattacagaaccttctcaaaagattttaagaagaaaagctctgctgaaagacgtgaatatcaagcaaataagaagcaagagcaggctgattttgatattgaagaatacaagagaacacttattgagcaaacatcagaaaacgaacaagttaataaggcaaaagctgagaaaatagttaataaagcaatgtatggccaaattttgcctgaaaaaatgactactagtactaaagctgtgttatggtgtgccattctattaatggcgttcttttgcctagttaacatatcgggacattcaattactaattcggtacagcatcccacaactttactacatccaacacatagagtaattactaagggttagcttagttaaagatctaatgacgcaggagaagcaggaggagcattaaaaagtgggtagtaagttaaaagattttaaaaagcgggtaaaatttcttgctcgcccgattaaagaatatgtttcgaattcgcgggttagagagaatgcatattactatcaccaattaaaaaagaatagcattaagaaaaatagtgttttactggagtcctatcatgcagtaagtatgacgggaaacgtttatgcaatttttacagaattagcaaaaagtaaacctgactatgatttttattgggtatatgcggtcgataaggacccaatgatggaatgcttaaaaaaagaatttcctgatagtaaactacactttgtaaaacatgaaagtaaagaatactatcggttattggctagttgtgaaatattaattaacgacacttcttttatgccctatttcattaaacaaaaggggcaaacgtatgtgaatacctggcacggcacccctttgaagacgttaggattagatataaagggtagtggctgggcggatcacaaaaatattcaacgtaatttattacaagcagataaattactcatgcctaacaaattcacggctgaccggttgataaccagtcatgatttaaatggaattctgccagctcaagtttacgtaactggaaatgccagggttgatttgagtttcgacgatgctaaaaaaatccgccaaaagtatcaactaggcgaaaaaaagattgttttatttgcgccaacgtggaaaaaggatatagaagatactactgtagaagatcttcaacaattgataaatcaaatgcaaagcttgcaacaaaaggctggagaagattacaaagtactgttaaaaacacattattttgtatatgacttttttgtaaaagaaggttttggcgatcaggtactaccaaattggattgatacaaacgaattgcttagcgccgttgatattttgattacggattactctagtattttctttgacttcttaccattaaagcgcccggtatatttttatattccagataaagaagcgtatgcaaaagcacggggcttttatatggacttagatattttaccaggattggtgtctgaaaacttagatgagattggtgttgctctagcgggaaaccaatctgtatatttgcaagaatatgcaactaagtacgaaaagttctggcaaaaatatttatatttagatgatggaaaagcgcgtaagcgtgctgtaaaggccatttttgatcaagagggcaaggacgccataagttacgagtctggtaaaaagaagataatgatgtatgcgggtggtttttacaacaatgggattacaatctcagcaatcaacctctctaattacattgattatgataagtatgaactgattttttgggatttttcaaagattaatgctgaaaaagccggcaatatcacgcgtgtaaatcccaaggcacattttatttataaattctcaaatactattcgagatttaagtgatacttacaaccaaaattggatttaccgtcaaggggcgaatacaaagtttggtagtatgaagaagtatcaaaaacaaattgcatatgaagttagacgaattcttggtaattttgaacccgatgtagttatagattttggtggctataataaaacgtttactgcgataactgcggtggctccgtttgaacggaaggtagtatatctccataatgacatgtttgctgaatataataaaattatcgacggaaaatataaacatcggtggaatttgaaagttacattcagtatgtataactactttgataaaattgtgtcggtttcagagagtgttaataagcaaaataagcagaatttaaaaccatggatacgcgatctttctaaaatggtctacgtaaataacgtagtagacgcaaggggaattctagaacagaaagaactagtacaaaagcaactaaaagacttacagaaatcgaaatatgaccaacaatatcgaatagtttttgatcagtttattaatcaaggtgggattttaactgaaaaaagttttatcaaaccagcggatgacacaatcaatttcattaatgtagctcggctttcacctgaaaaaaaccaggctaatttgattaaagcatttgaaaaagtggttacgcaaaataaaaatgtacatctatatatagtcggcagtggtcccttgaaaagtcaattggagagtttgatatatgatatgggcctgtctgagtatatatccttgactggttatatatctaaaccggccatgctcacggaattaactgattgctttattttaccttctaactatgaaggacagggattatcaattatagaagccatgctattggggaagccaatcattggtacagatgttccaggcatacattcagtgattagtggtacaaatggtttattagttgaaaacactattgatgaaattgctaagggaatgagtgaatttatcaatggtaatttaaaagcttctaagtttaattatttggagtataacgatgatgcattacatcaattttactcagtagtaattgaataaataagttatttaagaaacaaaaaagggcagagttataactctgctctttttttgttcatttatcgaagatgaagcattttatattatgttgttaggaatttagaactcgtttagttgttatgttaaaatataaagagtttgtacttttatatatagatattttaattcacagtatgaatcgatttttaagaaacatactgattttatcaagtatatacttggagctaattattttgtagctattcatatagacattattttaaaaaagcaagataaagaatctagacaggtgaactaatttgaaaaagttgtcagtgattgtaccagcttataatgaagaagaaaccgtcgagctgttttacgacgcctttgcgaaggtggaaaatcaaatggacgttgagcccgaattgatttttgtcgacgacggatcaaaagacaagaccttagtcgaaattaaaaaacttcaaaaattacatgaggaaatccactacattagtttctcacggaactttggtaaggaagcggcgttgtacgccggcttacaaaaagcgagcggagaactagtagcagtgatggatattgatttacaagatccaccggaattgttaccccaaatggtcaaaatgatcgaagagggcgagtatgattcagtggctacgcggcgtaaagaccgggatggagaaagccccgtgcgttctttctttgcgcggcaattttacaagtggatcaataaagtgagctctttggaactcgtggacggagcccgcgatttccgcgtaatgacccgccaaatggtggatagcgtactttccatgcgggaacgggaacggttcagcaagggactctttaactgggtcggctttaacacttactatatttcttacgaaaaccgcgaacgggctgctggcaaaacttcatggtccttctgggggttaatgaagtacgcgattgaagggttcgtatccttctcaacggcgccgttatcgtttgtgacctctgccgggatcgctacctgcgtgttagccgtgctaggagctttggcagtaattgttcgggcgattactttcccgcacacctctgcgtttggctggccttctttagtagtgatcatcctcttctttagcggagtgcaactactaagcttgggcattatcggccgctacattgccgaggtttacttggaagtcaaggaccggccggtttacattgttcgggaggaggagtaatgatcaaacgatacaagtcttggtggttattagcactttttttcgccgcctcagtaattatgacctatccagcttttagtgggcattttatgaagctaacaatggatggtggaattcatctttccagaatggaatcaatttttgagatgataaagatgggaaaattgccacctttagtgaattttattggcttagggaatcacggtaatgcttttaatgggatgtatccatgggtttcaatggctatcttttttgttttgccaaggtttttcttgactagcccgatgcatgcactatttgcaagttatgtgttaattaatatagctacattactcaatgcttatctattaacaagagaattaagtaaggatacaaggatacggctatttgcaacgcttttttatggctttaatgcgtatcatttaacgttactcttttcgcgaaacgcggttggtgaagcattagcatatacgtttgctccacttgttttattagggtgctttcagatttggagaggaagaactaagggaattctacatatagcattgggaatgggcatgatagctaactctcacgtgatcagtttgtttcttatggtattgtttctagtcgtccttgaatttagtcgattaatcctcaaaaaaattacatggcaagaaattattaattttgtcattgctggtggtttagcggtattaattggtttttattcaataacaaatataattaaaattagtgggttgaaccatttatatatgcctgagaaaaagttagaacccattatagtttcagaaatggttactagtgttttgaataatactattcaagacaaaagtggggaattcaatattggattgataggattaggaattttgttgtttttagtggttcaactatttcgtagtcaaaaaatgcagcgctggagtatatggtctttagtaaccgtattcttatttgttttaactacgacatggatacctcttcagaaaccatggatagttaactctatttttggcaatattcagtttttaggtcgtatgctttcgttgattgttttatcattagtggtagcaattaccttatatcttaatcaaaatcgtatgcgcaatgatttaatgctaatatttgtcagtgttttactattattgatgggaattgggagtgtttcacaatttcattggaagaaaaatgatgatccagtccgctattatgtaaataaccaaaatttagtattgacatcacatactgagggccatggctatagagattatgcccttgcgaacccaaagggtaaaatactttacttatatgcgaatacacctataaaaaattataaaggaacaggaaatacagcgacttttacagttgatgtaaactatgagagagcaactattccgattaatttatacaaaaatgtagagtatcaaatttatgtagatggtaagaaaataaagcagtttaaatgtgcaaaaatattgtcgctatctctatcaagaagaaatcacaaaattaagttaattgcaaaagcaggattgagcgaatatattacaatgctaatttctgtagtaagtatggtaatttgtagcggtctactgttaagacgtagatatatccattgagttaaatagtcttttaatagaagagagccaatcgaaaattagattggctctttttacatacctaaaaaactaaatctttaacctcttattgctaatatttaagcttatacttaattttccctttaaagctagttctttaacgacatttagtgtaaaactatatctggtaaacttatttgggggagaaatcgaaaatgtcaaaaaaattgattaataagttggttatcggtggattaatcgttctcgcattgataatagtttgggggcaggcaagtacatacttaaaaaagccagctgctactgaaaaaaataatcatttggcgattccacgagcgactcactcgacggaaaagggaaggttgcagcaagcactttcaccaaccggatttagtggctcagcaattttagtaaagaacaaccaaattgttgatagttacacagcgggagaggaagataatgagggtggcaaaaagaatcggttaactactgcttatgaaattgattctttgcaaaaatcactcacggctggactagtaatgaccttggttaataggcatgaagtcgcccttacggatcgccttaatcagtacataacgggcataccgggttctgcggaaattaccattcgacagctactcgacatgacatcgggattatcattgcctaagcttaaatataaaggtgatagtttatctagaaaacagtatttaaaaattcttcgaaagaacgttaaatttcagccgcaaaaatatggtaaatggaattatcagcccgtcaattacgtgctattgtcaatgattttagaaaaagttacgggggatagttaccaacagctgttcgcagaacgttacacaagcaagttgaacttacagcaaaccgtattcgcaactgacactactggttatgatacggctaaggggtattatctcaaaaaacaaggggacgaagttaaacaagtgcttcaaaagcctaacttggcgacggttgaatcagaattaggcacgggacaagtgtacatgtccgttgcggattattataaaacattagctaaattacttaatggtggactcctaggcaaacccactgtgcaaacattgtatcgaccggctaacggggctcaagtcaaatatcatgggggtctgtacactaatcatcaaaattattactcggctaatggttacggctacggatttgaagaccatattcgaattagtccggatggtaagcaggcgcttatcgtatttagcaatcatcaatctagtaagacaaatgaaccaccagtaaagctagcagttgataaattgaccaatcaatattttaaaacagcgcagataaacgagtaatgtactatttttgatgtctaaaatctgtcctataatggacataaacaattataaaataggggataaatgtaaatggatttgattacaattttgcggaaagtcaaacggcgcctcctaacctacgctttcaaacttaactaccggcccgcaaaacggcccaccgttatttttgaaagctttggagggcgacaagttagtgactcgccgttagcaatttataaagaaatgaaaaaagaacatcccgattatcgtttgatctgggtggtgaataagcaactggttgaagacgggtttccgaatggagaacgttacgattatgtggttcggggatcttttaaatgggtgcgtacgattgaaaaagcgcacgtctgggttgaaaatgcccggctgcctcgttgggtgaaaaagccggcgcacgttaaaatactacaaacttggcatggtacgccgctgaaaaagttgggcttggatattgcacaagtaaccatgcccgggaccactacggaaaaatatcacgaaaattttgttcatgaagcaaaccggtgggatgcattaatcagtcctaacgcctattctacgaaaatttttcgccaagcttttggttatcaaaacgaaattttggaaattggttacccccgcaatgacgagttagcgcatcccaacgcagctaaaattcggcagcttaaagaaaagttagggattcccctggataaaaaggtggtcttatacgcaccaacctatcgggataaccaatttttcaccaagggaaagtatgcttttagcctaccgtttgatttggcaaaattacgggctgcgcttggagaggatacaattttgcttttacggatgcactatttgattgctaacgcggtggatcttactggtgtagaagacttcgcaattgatgtatcgaattacccggacgttgcggatttgtacttagctgcggacgtgttggttacggattactccagcgttttctttgattatgcatacttaaaacggcccattgtgttcttcccatatgattatgaaacttatcgcgacgagcttcgtggattttatctggactatcaaaaatatttaccgggcaagattgtttacaacgaaggcgaactgactcatgaattagctcaactcgctaagaaaactcagcaacagctaagtccccaattcgaacaattttacgcaaggttttgcgccattcacgcgggtgatgcggcagcccaggcgacaaattgggtaagtcaacagttgcaagcttacgagactaaataagcaaggtgaattttatgagtggtctttctccagtagttgcgctaaaacggcaacagcggcttttaaaggggcctaacggacttgtaaacccaataattaaccacgatggtctttgaaatcaataaatgaaaaagcttcgcaagaatcggaattcttgcgaagcttttttgatcggtagctaaactactttttagcttgttcaattagcttttgcatcatttgtgcttgatactcggcactaaactttttagtagcttcagcagttgtcttatcagtcaactttttctgttcggcaggactcatccggggatttttctgcaaagcagcttttaaggtgtccttaaccgttgcggttaccttagcttttacgtacttagtagcatcctttttcatagaagcttgattttgtttaaccaatttttgcaatttagcggcttcggtagttgacaaggttggccaattcttaggcacgtagaaggtgttaacccggtgggaaacttcccggtcgttcccggcgattccaaaccaaaggcggtaggtatcatttttgtatacccaacgggtggttttcttctctaaacgggcttggtcgtcgttagtggtcttaacccggttagtagttttttccaattcggtgtgggaagttttctttttgtccgcatcctttttataaacgtaaactcgttccttaccatcggtcccaatattcttataaagtaacatgggcatttgttttgaaggtgaaactgagtaaacggtttgggtggttgtttcggtgatcttcttcattccgaaatgttcccggtcgttcattaccaatagcgctactgagccaacgaccacgatggcagaaattgcggtacagatgtaacgaaccacgggtttaggaattagggtcattgaaacaaaggttgcgatcacagcaagtattagtagaaaaataatcattatttttcacctccagcttgaggttgtacttcggctgaactaccagaacggttgctaacaaagaaggcaatgattagacctaaggcactgaagccaaccgcgatccaaaacgatgcgtggtaaccactgatagtggcattaaaggcttggtctttgtaagcaagtggttcagctttcaataagtgtttagcaggcatttggttgttagtaacgttggttagcacactgactaaaatggcagttcccatcgaactagcaacttgccgaagggtgttgttaactgcggttccgtgccccatcttgtcaaatggcaacgagttcattccggcagtagtaaccggcatcattgccattgagattccagccatccgaattgcgtataacacgatgatgtaaagcattggagtggtccgggtgatgaaagcaaatggtaacgttccaattgttaacaagaacatcccggtagtcgctaaccggcgtgccccaattctatcaaagagacgtccggtaatcgggctaagaacccccatcattaatgccccaggcaataacgttaatccagaatgaaaggcagattcgccacgtacagtttggatgtaaagaggaagaaccatttctgcaccgaccatggcaatcatagaaaccgaactaagggttgctgaaattgaaaattcaggaatcttcaatacccgtaggtcaaggaacggatttttactccgtaattgacgtgccccaaataggattacgaagattgccccgataattaaggtggctacaactaaggaatcagtccagcccttgtcaccaacttcggagaagccaaagagcaaactaccaaaaccaatggttgaaagtgcagcagaaatccaatcgagttgggtgtgctccgttttcaaaacgtctttcataaagaagaaaccagcaattaaaaccacaatgacgattgggataatcatcccaaataaagtccgccagtggtagttatcaatgacccatccagaaagggtcggcccaattgctggagccaccccgacaactaggccggcaagtcccatcgctgaaccacgttggttagcggggaaaatggttagcatcatggtttgcaaaaggggcatcgtaattccgacccctagcgcttggattagtcgtccagcaaggagtactgaaaacgacggggctacgtaacagaacgtggtcccaattaaaaatatcgtcatggctgaaaggtatagccgcttggaaggaatccggctagtcaaccaggcgctaatgggaatcatgatcccgttgaccatcaagaaaccagtcgtgagccattgcacagtcgaggtactgatatcgaaggccttcattaaagtaggaaaggccgtggttaaaatggtttggttcaaaacggtacaaaatgaaccaattaaaagcacaaggatcaataaagaccgcttatagggttttccatgtgcatcaaatgcttgtgtcataagcttacaacctcttttcataaaaactattcttagatactatagtccggtataccatctttgtcaacttatttgacaaagatgttagagaagttataattaaattaaataaacggacaaagtcaatcaggttaacttcaggaggagaatcatgggaaatccgtcagatcgggtcgatatgttaaaaagaatcattgcgagcgagtctttgttactaagtattggcgatgtggcaaaggcaattgatgtgtcacctcgtcaattacgttattgggaaaagaaaggctacgtaaagaccaatgtatcagagtcgggccagcgtaaatatacgtaccctgcacttattcaagccggaaacattgcccattaccttaataagggatatacgttagcgatggcagctaaaaaagccgaggacaatcgtaagttaatgaaaatgttacgaatttttttgcagtcccgggtaaacaagggctacgaaattgaaaacggctatgaaatcgacttgggtgaagtgaagaacttacctgcggaagaacacctgctgatagacgtgatgcaagacggtgaaagctatttcaaaatcaaaaaaacaaatgattgacgaagattaattagtaggctatatttatagtgaaatacttataaaaaataaggttcatcttcaaggggcagggtgtaattcccgaccggtggtacagtccatgacctgtcatttttgacagctgattcggtgtaattccgaaaccgatagttaaagtctagataaagggagattgaatttattgacgcgcactgaattttttaattcggtttttaacgctgttgccccgaactcgagcaacggcgtttttttgtggaaataagttaccaagaaggtgctccgattctaaaggaggcagtaacatgagtgtttctaaagttaataagatggtgattgtcgcaatgctggcagccatttcgtttgtattgattttcattgattttccgattttaccggggttttcgttcttaaagattgactttgcggacgtaccggtcttgatcggaaccgttttgtttgggcccgtgtggggaatggcgacggctggattagctgggctattggacattattgttcgggatagcaacccggcgggagcccttggagcggtagcaaattggatggcggcggtagcgtacgttctaccaatctattcgtttttgaaacgcgcagaagatcagccgcatcaccaagctgtaatggcgctagttaagggagtgctgttaggaacggccttgatgaccgtggtgatgagtgtggcaaatctgtttgttttgttaccactgtatatgaaattggcaagtttccaaataaatatctcgacgttaaatatggtgttgtacggaatcttgccgttcaacattttaaagggaatcatagtaggagcagtaattggattactgtactttaggctgatgccgatagtgagaaggggagaaaaataaagagagtggaagccaccgggtaatttttgaggattaacttgattttggccttaatcgcggtttaggcgattgaggccaaaatatagttaaccggagaaaattggtggctggaactcgtttcgactgtgcagcaacagaacacaaaggattaacagaaacagggactaatcgcggttttggcgattggtccctgttttggttaaccggagagagctgggttccagaacgcgtttcgaccatgcagcagtaggacgcgagggattaacttgattttggccttaatcgcggtttaggcgattgaggccaaaatttggttaatcggagaaaattggtggctggaactcgtttcgactgtgcagcaacagaacacaaaggattaacagaaacagggactaatagcggtttaggcgattgatccctgttttggttaaccggagagagctgggttctagaacgcgggttagccagttcgctaaaccacggagattaggctcgcgacagtcctaattttaaaaattactacatatataatatcggttaacggtaaccgaaaatagcaactaatgcgcaacatgctataataaagcttcatcaaaaatggttgataaacaacatttttggaataaggtaattcaactgttcggttggagggccaaatttagaggtgaagtttatgcggcttgacgcgcgaagtataacaaaaatggcattattactggcaattatcattgggttgggattggttcctaatcttccaatgggattgattccggttcccatcacggtgcaaaatattggtattttattagtggggttaatccttactccaggagaagccgcaatcaccatcggcgcgtttctgctactggccttgataggcatgccagtcttaaccggaatgcggggcggagtagccgtatttatgggaccgacgggcggttacctattggggtatcttgtaggagcagtgttattggcatggtggacgtcacacggtcgacaagattggtttggcctctttgcaaaagttgccatcattgcggttctagtaattgatttattgggaattgttggatttgcaattaatatgcggatggcattttctaaggcagtgcttgcaaacgcctttttcattcctggagacgtcattaaatctgcgttagtggctttagtgggccgacgcttaaaaataaaatagacgctacaaagctaaaatttagtcaagaccagctcccggaggctaaattttagctttttttaaacttttatgagataaatttgataaacgccgtaacgacggaaataatcggcagataatttatgaatagaatgtgacaaatgtgaactttttaagcccgtaatgttacggttactttacaaaaaattcaaatcatgccataattttgcgtaacgtttagcagggttagcgacctaacgcaacctttgcaaactaaaccaatagcaaaaaacaggggggattgtggtgatcggttttcttaagaatctgtggcaacacgattcggttaaattcatcacaaggacagtattttactttttagtttttgtgattttactttatttatacgggtatagtggaatgtctggcgggactttcatttacaatgaattttagcaggaggttttgatttgcaaaaagttacaaacgtaattgaaaagattgattcaattgcccaagagcatccggactggattgcttatgattatttgggaaatacgcacacatatggtgaattaaaagctttctcagataatttagcggcttacattttagaacaaaatattatggaacaagctcccattatgatttatgggggacaaacatttgaaatggtggcggcctttttaggagcagttaaaagcggtcatgcttacgttccaattgaccggcattctaatccagaacggttaaccatgatcaatgagattgcgcatcccgggatgtgtattgccattgaagacttaccggtctctttagatgacttgccaattttggaaggccaggagctttcagacgtgtttgcaaattcgcaaagcgtagagctagatcaggcggtcaccggagatgaaaactactacattatttttacttcgggaaccacgggtaaaccaaagggagttcaaatcagtcataacaatctattgagctttgttaactggcaaatggaccagttcgatttacctgaccgaccggtaaccttgtcgcaaccaccatattcgtttgatttatcggtaatggacctatacgctactttggtgttaggaggaacgttaaaggcggttcctaagacggttaccgataatttcaaggaacttttcgaaattttaccaacgttagggttaaatgtctgggtttcaacgccatctttcatggacgtatgcttattgcaaccaacttttgatgcggatcactatccggcactatcccggttcttgttctgtggtgaagagttatcacatgcgacggcccaagctttaaaacaacgttttccagaagcgcggatttttaacacgtatggcccgacggaatcaacagttgcggtttcggcaatcgaaattacggacgccgtgctggaacaaaacgaccggttaccaatcggccggttgaaaccggacatgggcggttacatcatcgatatggataacaacgttgttaaggctggtaacgaaggtgaattggtaatttatggcccagcggtttcgaagggttacattaataatccaaccaaaactaacgaagtcttcttcaagtatgaaggacatccggcatacaagaccggtgatttggtggtaatggatcaagatggggtcctctactaccgcggtcgaactgatttccaaattaaattacacggttaccggattgaacttgaagaggttaaccattatttgaacaacgacccgctcatcaaggcgggaattgccgtgcctaagtacggtaaagaccaaaaagttgcgcaactagtcgcgtacgtaattccggcaacggatgaatatgattcacaaattaaactcacggtggccattaaggacagtttgaaggctaacatgatggaatacatggtcccgaaccggtttatttttgttgaagaattgccacaaacggcgaacggcaagattgacataaaaagtatgatcgcgcgggttaactcatgatgtggacagcgacaccttacgaaaacccgacttactttttcatgttagccattgccctagtgcccattgtgattgggatgctacggggacgccgttttcactggtacgaactgttagtatcgtttttcttcttgttgctaacctttgggggaccaaagtggcaacaggggattgccttaattggttatttaatcttccaggtgatattggtttcactatataaccgctatcgcaagcagcataacgcgaccggagttttcgtaggggccgtaatactggcaattttgcccctagcagtggtcaaaatgacgccgctattgcaatcaggtaactcttcgttaatcggattcctcggaattagttacctaactttcaaggcggttcagaccatcatggaaattcgcgacggggtcttgaaggattacgatccgtggttcttcctgcagtttttggccttcttcccgacaatttcttctgggccaattgaccggtaccggcgctttaagaaggattatttaaacgtccctgaacgaggacactacttggacctgttggaaaagggtgtgcactaccttttcttagggtttgtgtataaatttatgctgtcttacgtatttggttccttgcttttgccaagggtccaacacattgctttacaaacggacggtctctcttggggcctgctgggcgtaatgtacgtttacagtttttacctattctttgattttgcgggttatagtttgttcgcggtagccattagctacttcatgggggtcgaaactccgatgaacttcaagcaaccgttcaaatcgcacaacatcaaagaattctggaatcgttggcacattaccttgtcattctggttccgtgattatgtttacatgcggctcgtgtttttcttcatgaagcacaagacctttaagagtcctaagacgacggcaaacgtaacttacgttttaaacatgttgttaatgggattttggcatggggaaacctggtattacatcctctatggtttgattcatggggtcgccctcgtaatcaacgactggtggcttggatttaagaaaaagaatccgggacgcttgccgcataaccggtggacagaagcactttcgatcttcattacctttaatttcgtgtgcttcactttcctagttttctcaggattcctagataaactattttttgttaaatactaaaggagattaattaattatggacgtaaaagaaacagttttaaatattttggcagatttaattggtacggacgttagcaacagtatggatgataacctttttgatgcaggtctattggattcaatgggcacggttcaattattgttgcaattacaaactgaactaggaattgaagttcccgtatctgaatttgaacgtagcgaatgggacaccccaaataaaatcattgctaaagtaaaggaacttcaagctcgtggctaaaaggttatggatgatttttggccccgttttagcggcagcgctgattttaatcggacttttattttccccattcaaaataaataagattaactcagccgttgagcaaaaagcagctacggcattgtccccagacacgctcaaaggagatgctgtaaaacgggccgccttagaaaatgggaattacgttcccttttttgggtcttcagaactttcccggtttgatttagcccatccatccgtaatggcggaaaagtatgattgggacttccgtccatttttactaggagcaccggggacccaatcgttgacccattattttgaaatgcagggaattaatccccaactaaaaaataaaaaggccgtctttgtgatttcaccacagtggtttgtaagaaaaggggctgacccgcatgcctttgcattttacttctcgcaattgcaagccgttaacttcttggaaaaccaaactggaaagccaagtgaacgatacgctgctaaacggttgctaaccatgttagacgaccggagtaacagcactaaccgtcaagtaattaacgcgttagatcgggtagctaacgggcagcaggtaacttcgggacaacggacttacttgaagtactataaacggttgttggctcatgaagaccaactcttttcgccgcttagcttgcaaggaactaatcaggaccatattaaccggcaggtcgaagcattacctaatagcccgtcggatgggatgattcaacaagctttgacccgtcaagctaaacggcaaacgtcaaacaaccagtttgggattcaaaaccagttttataataaacgtttgaagaaacggattgctgcttttgaagggatgcaaaagcattacgattatacgcgttcgcctgaatttgctgacttccagctaattttggatcaatttgcgaaaaatcatacccaagtgctctttatcatcccgccggttaaccagaagtgggcggattacgtgggcttatcacaagaaatgctccgtggttttgacaaaaaaataaattaccagctgcaaagtcaaggattcaatcagatcctcgatttatcacgtgatggtggtaagaaatacttcatgcaagataccatccatttaggctggtacggttggtacgtggttgatcaaaacgtcaagaattttgttgaccaacctagccaatcaacgcattaccaaattaagcatcaattctttgatgaagattggcaacagttaaaaccatctgatttgaaaacttatatcaagaataattaataacttttaggtataatagaaagagaatcggagctggggagccgaacgtcgcgactttgaaaattgattttggaattttgtgactgacgattgcttttgcaaaattgcgagagcggaattgaaagctagtcgagcgtttacccactctttttagataactagtttaagggaacgggggataaatagatgcgcgagaaaagttttcggttggtcagccagtttgccatcatgttagtcgcgctagaagttttagcgattagcattaacatgttttacgcaccacataacgtggctgcgggaggcgcaacggggatttcaattttgttagaggacgcctttggctggaaccgggcgctgattgtctttatcattaacgtggcaatgctgatagcgtcgtactttacattgggaaaacagactacggcccgaattacggtgggcagtttgttgttaccagtctgtatggcggtgacgccgagtttaagcttggtatcggaccgcacgttggcagtgattgtcggcggagcgctgtacgcaattggagtggcgctgttataccaaattgatgcttccagcgggggcactacggtaccgccgttgattttaaaaaagtactttaactttaaaacttccgtgagtttgctggtgcttgatacgattgtttgtctgatgaatatctttagttcgggaatggaagctttcattctagcgctattttcatcggtgatcacgctgttagtgatgaattatattgagaccggaattgaccggaagaagagtgtttacattatgagtagccgacttagtgaggtcgaggaaattatctcggagtcgctggatcaaagttacacgagtttgaacgtgcagggaggattttcgggagataaccgccggatgctaatgctggtggtggaaaatgccgaatatcaccgaattattgaaagaattagggaaattgaccccaaggcgttcattttaacgaccaatgtggcggagattcatgggggacaatattaatatagagggttttgaaacccgggtagctcttgaggactaacggaattaaggggattaatcgcgattttggcgattgatccccttaatttggttagccggagagggctgggttacaaaacccgtttcgactacacggcagaaaagtatttgtatttaacgaccaatgaactaaaaaaggggcctcagatttcaagcagaaatccgaggtcccttttcaatattaaaatatccagtttatttagcaaatatttgggccgcaattcgatcggcaattcggagccgcacatcgttaactccaggaattggagccccgttagttagccaatgccgtttttcggtgggaagtccccaaacaaagaagtggggtaccacgttgccgttttgatcgatcagttcagcagtgtcgtccgtaacgtccaaggctccggtttggtaactagaaccatcgcgaagctggagggtaaagatccgggccagcccctgttgcaacaagttgtttaccaacgggttagtgttgttggcagcgttaggctggggtaaacgaccttcaatcaagacgttaccaaagtactgttgatgatccgcaagccggtttgaataagtcataaattgatcatcactcgtttcaaccctcatatctgggccaatcagagttaaaatgcccgacttgataagggctaaaatctgttcaatccgaaatgccggcggtccgaccgctaagaagctatttaaggaattaaaatgtttgagaacctgctctacgtagtcgtcagcactgattaaacggtaggtaaccactttccgaatgttggtacgtaattcgcgtagcttttcaatagcgcttgtaaatggggcggttaagttaccttcgtttgccaagtccacgtcttgctgcaagtaagtcttaataaactgggtaaagctggcagcgtcgttaacgtctttaggaattggattcttccattcttcccagttgagacgatctttagcagcaatgccgtagttatccaagattttcttgaatccctttgtgctagcagctaggtcggcttcaaaagcagttagatcaatttctggataactattttgcgcgagggtaacgtagtaggttaactcaacgtcccattgaatgcgattaataaattcttcgccgctaatgacttggtgttggcgaacaaggtcgtcaacgtattggtcacttaggaaatagcgcggaaaagtttcgcccactgccttttggtctagcccccgagcatgatagggcaatcccctccgggagctagcgtaaatcgtaggctcatcaccagaacgagtataagttaagttcccgtgttcgtcgcggtggaaggttccgccacgccgttcggtaagttcggcaaggtagtcgataaaacttagccctaatccacgaataattacgtgatcgctagcagctacgtcatcaacgtccatctcggctggatacgcaattggaacgtattttaattgatgagcagcggcaaaatcttgcaactgccgttcttctttgcttaacgggttgttgccttcccctaaagcagcagacacaacgtccacgttgtaagcagcatcttgggtgatgactgtgtattgctgggcatcttttttaacgttagtcacccattctggacgaagggtcacgctaaagttatctggtaaatgattaataatttgttcgtaaaaccactgttggtagatgccaaaaagggctcgggaactgtaagagtgcttgtttaagttcgctaattcattcaagagcagcttttgatgatgatattgatgttcttcgataaagctgcgtccgtttgctagggcccagtcaagtaaactcggaccttcatgaaccgggccagccatttcaatagattggtccgtgaataaagtgattttttcggctaacgaattcattttcagttcgtggttttggtcaggattccaaactcgaccaccaattccgaaagggtcaaatagtgatatttcgacattggctgagtaattggtactgattccccaacaaactaaacgttcgagggccattaagttgcgcggacccgcgccgattaaagcaattttcatattgtccaccccgtttgtttttcacctttatcatagcataataacgaaagcttgcggcgaggctttccgggactgctaggtgagaaaggctacaaaaaataaggtaattgtataaaaaaatgaaatcgaatacatcttttttgctcaattgggtaaataaaagtaaaaaaagtggatttgaaagcgattttccctttttatctacgggcaaacggcgtagtataaatgtaaaatcacaatgagtggaaggataacgatgatgtataaagtagtattgtttgacttagacaacaccttattaaaaactgaagacgcttcggtggcggcattaagctacgctctgaaacaagatggcgtgacggttaccccagaggcaattattagtctaatgggaatccctggtttagagatggctaaacaattgggtgctcctaatccggaaaagaccatcgcaatctttaatgaacaaattggtaaagaagtcgatttgattaaaccatacgacggaattgaggcaatgtttaccggtttgcatgaacttggtgtggagtatgggattgttacttccaaattaaaacgagtctttgatgacgagatgaagcatttccctaagattcaacagattaaacgggtggtcttttctgacgatacacaaaaacataagccaaatcctgatccgattttatttgggatcaaaaaatactttgcagaaatggatttaaaggatgtcttgtacgtaggagattcgttatttgatatgcaggcagcccacgcagcgggagtagactttgctaacgccggctggggtgccatcccgactaatgatttctcagaggcagaatacgtgttgcaaaagcccgaacaacttttagacattgtgcaacggtcaaagaaatagatttgcaattaaatgggcggtggagcaggaagctatattagctacggaacagccctaaaaaaagaggttgagaaaattaagcaattttctcaacctctgttgtttatctagttttacattgaaggtaccaaccagtcgttttctaacaaatggtgaaattgttttgtgatcggtagccacagtttgttgttgatgatgtccttcaagcattgccaaaataatgggtcgcgtgcttggcgggcggtggggtaaacaaatatgtattcaccggtccgcgtccgggctttgatcttattattttcgtgtccgataagttggacttccaaatactcgcgcatattcggatcgttgataatcattacgcatcatcctccctcacttctataaggctaccatgaggaggccaaagaggggcaaaatttgctcagaatttagcacatcttaaataaaaaaatattttcttaaatatatcaaacttagtggagttattaattgcattttaaagataaagcgactatcatctttcaagctgaataattcaactaaggctaaggaggagtttcttctgaagggtcttaacgttattaaaaattgtctgtttttagttttactttttgcgatggatcaagtaatttcattaccgcaaatagcggcaatgcatattcacgactcccatccagttgtacacgtccttttggtagtagtgtacactttgaccactctagcagtggtgatttttttggttcaattttaccgttataaagtgcgcaaaaatcatagtgatttcgctaattacccgttgaacagtaagcgttttcggattatgttattaatgattgggttatggttcatttttatgcttttgcagacttggtacgtaacctactttaatattggtacttcggaaaaccaatcggcgattgaacaattactacgggacacgccaatttggacgtgggttgacgcagtactagttgctccggttattgaagaactgattttccggggcctcttttttgagttcttttttaccaaaaatagtcggctggtacgcacaattggcgtggtagttaacggcgctctttttggcggattgcacgacctaggcgctagtttcccaatttacgcaatcatgggaatgctgctagcgatcacctatttatggaccaaggatatcaaatatagcatcacgctccacatcataaataattttatttcatttttataacggctacggaggattaatatggatagtattttaactaaaggaagcccaattaagggaattatcttattcagtattccgctgcttttaggtaatattttccaacaaatttacaccctctccgacaccttgattgttggccgggtggtcggggtacaagccctagctgcggtaggggctaccagtgggctgacctttttgatcattgggtttgcccaggggatgacgaccgggttatcgattatcactgcccagcactatggcgcgagggatttacgagcggtcaaacaaagttttgcaactagcatttggatttgtggcggattggtattgttgctcaccccgcttagcgtttgggcaacccgaccattactacggttaatgcagacaccggctaacattattgatggggccgcaattttcttatccattatctttggcggactagtggcaaccatgttttttaacctattttccaatatgcttcgggcgttaggaaatagtcgtttgccactgattttcttggtgattgcctgcataattaacgtagttttggacatcatcttgattgttttcatgcacgttggaattgctggtgcagggattgctacggttacggcccagttgatttcttgttttctatgttggttttatatcaaggctcgggttccggcgttgtccctcgaatggcgggaaatcactacgaattggacgttaattaaagaacaaattcggattggtttaccaatgggattccaagcttcaatcatcgcaattggctcgattattttacaaatttcgttaaaccatttgggttcatcagcaattgcagcgtacaccgctgccggaaaagtggaccaattggcaactcaaccaatgatgtcattaggaattacgatggcgactttcaccgcgcaaaacttcggtgctaagcaatataaacggatattaaaggggattcgccaagcgttaactacgtcgattagttatggtttcgtgatgggaattttgattattttaaatagtcggacgttagttaacctgtttatcggaaattcagaacaacacattactaatttggcacatcaatatttcgtaattgtcagcatgagttacttcctgttggcaatcctgtttattgtgcgatacaccctacaaggatttgggaagagtatggcacctacgttagcaggggtcgcagaattgctttcccggatgttagtggggatttgggtagtgcctgcctttggctttatcggagcctgcacggcaaacccgttagcttggctaggatcaaatttagtgttgatctggtcctatgtccaagttgttcgtcaattaagacgggaacctgaagcataaagtgttttttaaagtgccagggcactataataaagttagtaggttgtgagtgtagagaagggggtttggttaatgattttcacgtatgacgtattaaaggacgtaattagcacgggaaaaccaattatcattaatgaacaaagtcaaatacaaaaattaatggcggataaaatcgccgcaattaaatttgtctcgaaaattaaaaatgagcatgaatactattgtttcttggagttgaatccggggaaggggattgtgttttcttccgatggcaacacctttgatggttttagcgtttttcaaattccattaagtgagttttattttgacgttgatgttgataagggcgtaattggaattgaagacggcgtgggtaacgaaaccgactttttagatttattcactggtccgtcaattggcgaatttagccggaagtaccaccatgctagtgacgaagaaatcatgcacgggaccacgtatgaaatgaccgaccgttatctaggggattatttaggctttgaaggcgaagatgcccagaaacttaacttgacgttgctgcgttttttgatggcggtatactttgaccaaaaccccgcaagtaagccggttaaataactaggtagattagcgctagtttaagaaaaagccggcggatgaaaaacatattttacattcagattacaacggttgattttttaaatgcgcggagtataatttcttctgttccagtatttatggttattttttggaggaagaaaaatgatttttaaatatgatgttttatctaaagtaatgcaagaagataaaacgattgaaatcaataaagacagctgcatcaaaaaaatcgcgggattaaacggagtggaatacgacgttcggagcagcaaccggcacgattacttcgtctttttaccgctgaatgatgatgaaggcttagttatcagcactgataaccataccgagctgggatttgagctgttaagaactcctaagaaagaatttttcttgagtataaacaccaatattaatctagtggattactatgacggtccgggaacccagaccgactttcctgacgtgcttgaacaagaagaactggaccaaaactacaatcattgttatggtgcaagtgatcaagcgttgaaggaaaccaaattgtatcaacaagtggataattgtgtaagcaaatatttacgggtggatgcaaagttagaagagaagttgaacttagtaattatgcggctggcctttttggcacatagtcagcggcaacacgcggtggcttagttagcataatggttgtacaaaattttaaataccccaagtttaatgatggcaaaattgctgttagcggacttggggtattttttgttgcatgtctgagacaaaaaccaccttaagcaagctaacttcttcgcatgcttaaggtggtttaataatatttaaggaaaatttagcggcacacgcaattactattaatctggcaatgacgtgtcttgagctgcatcttcttgtaactttttaaaatcgaattgggatagtgcaaagtaatatgcaccgtaaaggtcggtatcctgtttaaaaactgaagtttcaacatttggcatgtgcagagtttcttttaaaagtgagaaactgtcccgaattacctgaagctgatggttgatttcgggaaccaaaatactctgggtactgatccgtccgcaaatcacgtatttgttcaagtccagcactgcctgagtattggcaatcatgtaagcaacgttgcggcaatactcattaaaaagttcgcgggcgttggcttcgccattttcaatggctttaaagaccttggtatcgtcgttagggtcggaaagttgcaaaacgttcccgattttttgcaccattttagtggcagaacatgcgttaaacataatttgggatggtgaaggatcatcagtttgcggattagctaaaatcatccctaaagccccagcttctaggtgattgccggtaaaaatccggtcgtttaaaatgatcccagcgcctacgccatcatcgaggattagggctgcaccgttgtgaatgttacgtaagtttccattccagtgagcggcggttgctgcacagattccaacgctttgcatggcaacgggaagatcgtaacgcgcagcgataattttgcccaaacttagtccatgaagaagcggtagagaaccaccttgatagatgattccatccgcttgatccacttgaccaggaacgctaattccaatgccgtagatatttttttggttttcttcaacaatgtgataaatggcttttaaaaaattatcaatgttatcagtaggagtggggacgcttttacgtaccttcaattcaccctggtcgctaaaaagtgcgtaccgaattgctgattcattaacggcgatgcttaattgttccgtgttattcatcataatcattccttcgtgtacattaattatacatagtttgagaacgatttcaacgtcagtaatcaaaaaacgggggaggccccccgctagcggatgaagatgccgttgattttaaagttatagtttcttgcccatttttattaataaataaagtaaatgaacggtgaaaatggacaagatcacgaaagcaagcaggttgaaaatgctgttttgacctaatggagtgaaggctttaagtgccattacgattaggttagcaactatatagatgattaagattttttttaaaaattgtgagccatgtcccattaagcgaacctccttcatgtacgatcgacttaagtttttgtgcgcgaccaatgataaaagttgattatataataacgtagttgggtaatttctgggagggggaatattagaccaattgaccaaattagggaaccaatcgcctaacccgcgattaattccctaattccgtggttctcctgcagtgtagtcgagacgtgttccagccaccaatcttctccggttaaccaaattttgacctcaatcgccaatcccgcgattaaggccaaaataaagttaatccaggtgcttacctgcagcgtagtcgaaacgcgctcagcccccagccctctgcggctaaccaaattagggaaccaatcgcctaacccgcgattaattccctaattccgttagtcctcaagggctacccgggggtgcggagcgctcttatttattaatcacaaactttctaattgcctttgccacaccgctctcattattgttagccgtgatgaactgggcatttttctttacctcgtcaattccattttccatcgcgacccctattccggccgtcttaatcattgacaagtcgtttccttggtcaccgattgccattacttggtcaagactgaggtgcaaacgttccgccaactccttaaccgcgttgcccttgctgacgtttttaggcattaattcaataaagtaaggttcactttggaccacgctaaattcgtcttggaaacgattgaagatttggtcacgggccttacttaaaaccttcggatcgtcgataaacattaccttaggcatttctagatcagggttcatttcttcaacgctccggtaacgtaagcccatttctactaagaaactttctccaaccgtgtactggctaatatttttgttggcggtgtaaatatggttcttgccatccacatggaaatgaacgcccacttggcgactgaaggcttcggcagccaggtagtcttggaaacttaaggtgtgtttaattaaaatttccccgttaatggtctgagcaagcccgccgttataagtaatggcgtattccttttcgttttggagttcaagttgggctaagtagcgttgaatcccggtgatggggcgtccggtacacaaaacgatgttaacgcccatcttagaagctgcattaatggcagcgatgttttcttcggtcagttgtttattatcgtttaatagggtgccatctaaatcaatggccactaatttaatactcatgatcatcctcctaattgatgatgccgtttttgatgtgtgattggaatgcttcaaaagtagctgagaacaagttttcagtgttgctagtgagcatttcctttggaaaatagaaccgttcgtcgcttgaaactttgcccgagatggcccgaactaaatcactagccgtggaaagctccactagggaaccgtcggcctgcatcaattcaatttgggtccggggcttttgcgacgtagggtcataagcgtcgtacggcagatcgtagctatcgttttcggcagtgtagtattccgcgtcaaaccctgctgcagccactaactgtttcaattctggtaaaagtgcgcgggtttggttactgatgcgggccgatttaaacggggtccggtttaaaaagcggttagctaggtcgtttaaaatggggtcttctgaatcttcccattgcaagaagtaggtgttaagtaccccgtcgtctaatttcaagtagtcgcttaaagtaaattgcttgttgaaaaaaggcattaaaaattgtggggcctgctgccacggggttgctgaatctaagtacagctggtgggcccgggcaagcaaatgcccgagaatgacttccatggaccgtgaaacggaatgaaagtaaacctggacgtacatttgaaaacgactgacgataaagtcttcaactgcgtgaattccgctaatttgaaaggcaatcccttttgagtagggacgcattacccgtaaaatacgggttaaatcaaaggtaccgtagtttgtcccggtgtaatacgaatcccgaagcaagtagtccatccgatcggcgtcaatttggctagaaatcaattgcaccacttggggattcgggtaatcgtgactgataacggcagcaacctgggtcggaaaatctggactgatttgtcgtaaaacctggttaacttccgtagtcgggtccgtaatgatttgggtagtaatttgttcgtgattggtgtgaaaaatgtgctcaaacgtgtgtgaataagcaccgtgaccaatgtcgtgtaataacgctgcgcaaagggttaccaaacgttcctctttacgccataatccatcgttaggttttttggaaaggtaattccgttcaaagttttcaacaatgcgccgggctacttcgtaacaacccaaagaatgtgaaaaacgggtgtgttccgcgccgtgaaaaacgaatgaagtagttcctaactgatgaatgcggcgaagccgttggaattcttttgtgttaatcagatccaaaattacttggtcttggacgtaaacgtaatcatggatgggatcacgaaaaactttttccatcggcaggcgctgatttttaagggccatgatgccaccttcctgatttttattaaataaatcctttacttagaattatactagttttcgctaaagcttgtaaaagttgagcggtagaatagtacaattatatgtaaaatgaattataattggcatggtaataaagtgaaaggaagaggagcattcaaatggcactagataatggaattccaattgcgatccatttagagacgtttattgaacaagaaggtgaaaaaaaccatctagttttcgatgaaccaggacaagtatttcaaatgggcaattcaatttacttacggtaccaagaagtagacgaaaaaagcggacagaaaattccggttaccatgaaaattgacggcgaaggaacggttttactaacgcgagctgctgaaaatgaaatgcggcttcggtttgcaagtgggaaacggattgaagcgcgttaccgcaccccgtacggactgttcccaattgaaacggtcacccctttgttagatgtgcaactccaaaacgaaccgttggcaggtcaagtgaacattgattaccaacttttagcgggtaaacagctgattggtaactataaaatccgattgcaatttacggcctgagtgtagtatcattaaggacagactgtggaaaggacgtgcaccagttggaattagaaatttttaagggtcaaaacaaagacgaactctcgatgatcgaagttgctcacgccatcttagctaagaatggtgaaccaatggcattcgttgatttagctaatgcagttcaaaattacttggaaaagacggacgaagagtttcgaaatcggttatcgcaattttacactgatttaaatattgacggcagttttatttcccttggtgaaaacacctggggacttcggacatggtacccatttgaatcaattgatgaagccctaattcacactgaagaagacgaagacgaagatcgtccggtacgtaaaaaacgtaaacgggtcaacgcctttctggctgacgccgccgatgatgacgacgtaattgattacgatgcagacgacccagaagacgaagacgttaccgccgctgatgacgcggatgccgatgatccaacttatgaggatttatctagcgatgatgataacgacacgcttcctgacggtattgaaggtcaattaacagaattaaatgatgatgaagaagagtaaattatcagcttgacttatggttgattactcggtattatattttttgggctccggtaaacctgattgggtttagcggacaatgaacggttaataccccctattcatggaatagggggtatttttattgttgggtgagggttacccgatgataaaatccgctttcaggtttccaatagttaaccagttagaaatgttagaaaaggagagttttgatgaccaaatatattttcgttacaggtggagtggtttcatctttaggaaaggggattgttgcagcttctttagcacggttgttgaaaaatcgcggtttgaaggtgacaattcaaaagtttgatccgtacattaacgttgatccaggaacgatgagtccgtaccaacatggggaagtttttgttaccgatgatggtacagaaacggacttggatttaggacattatgaacgttttattgatattaacttaaataagtattctaacgttaccactggaaaaatttattcggaagtattgcgtaaggagcggcacggagattatcttggcgcaactgtccaagtaattccgcacatcactgacgcaatcaaagaaaagatcatgcgtgctggaaccgttacggattcagatatcgtcattaccgaaatcggtggaacggtcggggatattgaatccttgccattcttagaagcaattcggcaaatgcggagccaagcgggtgcccaaaacgtattttatatccacactacgttggtaccttaccttaaggcggctggtgaaatgaaaactaaaccaacccaacatagtgttaaggaattacgtggtttaggaattcaaccaaacatgctggtagtccgtactgaagaagatattacggacagcatgcgttcgaagatcgctgctttctgtgatgttgagcctgaagcggtaattgaatctaaagacgtggcaagtttgtatgaaattccgttaaatctaaaacgccaaaaaatggatgaaattgtcgttaaacactttggcttagacgttccagaagcggacatggctaagtgggcggacctcgttgatcacgtaaacaaccgccttgaccacacgattaacatcgcgttggttggtaagtacgttgctttgcaagatgcctacatttcagttaacgaagccttgaaacacgcgggctacgttgtgaatgcggacattaagatcacgaagtttgattcagaaaaaattactaaggaaaacgttgctgaattgatggctggccaagacggaatcatcgtgcccggcggcttcggagaccggggaattgaaggaatgatcgatgcaattcaatacgctcgggaaaacgacgtgccgttcttaggaatctgcttgggaatgcaaatggccagcgtggaatttgcgcgtaacgtattaggttaccaagatgccaactctgcagaaatgaatcctagcacgccgcacaacatcattgacttgatggcggaccaagaggatgtcgaagaccttgggggaacccaacgattaggtttatacccatgcaagttgaaggaaggtaccgttgcggcccgggcgtacgataatcaagaattgattcaagaacgtcaccggcaccgctttgaattcaacaaccagtaccgtgctgaaatggaagctaagggattggtattctcaggtacttcaccagataaccaccttgtagaagtgattgaaattcctgacaagcgcttcttcgttgcttcacagtaccatcccgaattcctttcacggccacaacgtccggaaggattattcaaggcatttattgcggccgctaaccaaagtaaataattagtttactaactactacttcaacgaggtcggactaggtttccggcctcgtttttacataaggatgtttgagtttttttaataggtgaaggcttgtggttgtatttttgcaacaaattatttatgattgaagttgactgtaaaatacattccttagttttaagtactttaagttcattatgtgaggaaaaaccatgaaaaaaatgataatcaagggtggacagcgactgactggagaagtgtccattggcggagcaaaaaatagtacggttgctctaataccggcggccattttagcggacaccccagtgcggtttgattcggtacccgatatacttgacgtccataacttaatgattattcttgaatcaatgaatgttcattcaacctttaaagatggcgtgatggaaatcgacccgacggaaattgtcgaaaacccactaccaagtaaagcgattaagagtttacgagcttcatactactttatgggctcgcttttaggacgcttcaagcgttccaccgttactttccccggtggtgataatattggtccgcgaccaattgatcagcacattaaggggttcaaggctctgggagctaacgttactgaagatgaggacacggtttacatttctgcttacgagcggggattgcacggggcccacatctttttagacgtggtttctgtgggagccaccattaacgtaattttagcagcggtaaaagctcaaggagttaccaccattgaaaatgccgctcgggagcctgaaattattgacctagccatgttcttaaataacatgggagctaagattcggggagccgggacggacgtaatccggatcgaaggggtcgacaagcttgtttccacggcgacccacaccattattccagaccggattgaagcgggtacatacctatccttagcagctgccgtgggtgatgggattttagttaataacatcattcccgaacatctcgaatcgttcacttccaagatgattgaattgggagtcgatttgaaaattgacggggacaagatctacgtaccaaaggtggaaaagatgcgggggattgaggtcaatactaatccattcccggggtttgcaaccgatttgcaacaaccgctaaccgcctcgctactaaaggctcaaggacgcagtgtggttaacgaccacatttatccagaacgggtaaaacacgtttcggaattgcaaaagatgggagccaacatccagcacgccgacggagtaatttacgtcgactacaccgaccaattgtatggtgcaaacgtggaagcgggcgaaatccgggccggggcctgtttgatgattgctgctttcatggcggacggtaccactacgatcaccaaagcagacaacatcttacggggttacgatagcttagtgaagaagttgactaaactaggtgcggacgtggaaattactgcggatcaatcgctttagaattaacaattaggagagttaatattcatggataaatttttaacgatgaatgatttacaagaaatgactctcaaagaaatttacaaccttgcgcgtgaatacaagatttcatactacagccagatgaacaagaaggaattgtcactggctgttttgcgtgctcaggccaaaaagcagtcatttgttgaaatggaaggagtcctcgacataatcggcaacgaaggctacggttttctgcgtccgattaattacggctcttcccaagaagatatttatatttcagcttcccaaatcacccggtttggtttgcgaaacggagatttagtgggtggcgaagcgcggcatccgcggccaggcgaacgttattacggattgatgcgggtaacttcggtgaataataaggatcccgaagaagctaaacaacggccacatttcccagccttaacgccaatttacccaaaccaacaactgacgttagcgactacgccagacgtgttatcaacacggttggtggacttgtttgcgccgattggatttggtcaacggggattagtagtcgcaccgcctaaagctggaaaaacgacgttgttgaaggccattgccaacggaattagtaagaaccatcctaacgcgaagttaatcgttctgctgattgatgagcgacccgaagaagtgaccgacttggaacgctcgattgatggtgaagtagtctattcaacttttgaccaagaaccccggaaccatacgcgggtttctgaactagtcttacaacgggcgatgcgcctcgttgaagacaaacaagacgtggtcattttgctagattcaatcactcgtttaacccgggcgtataatttagttacggcgccgagcggacgcaccctttccggtggggtcgatccggcttcattttataagccaaagaaattctttggagcggcacgcaacattgaagaaggcggttcgttaaccatcattggcaccgccctggtcgatactggtagtcgcatggacgatgtaatttacgaggaattcaaggggactggaaattcggaattggtattatcccgcaacttagcagaacggcgggttttcccagcattagatatccggcaatccggcactcgtaaagaagagttgatgatttcacgggatgttttagaacagctgtggaacatccggcggtccatgcgtggcgacgcgttagaatacaccgaacaaattctacaattaatgaaaaatactaagaataacgatgagtttatcgctaatctgaagaaccttaatttcggcaaaaagtcctaaatgaggttgtttgaaataattatttatgctatgattgtggtcgttggttttataataactatgattcagcaaatgattcatggcaaaggagcgtaatatcatgaaaaaaggaattcatccagattaccatccagttgtattccaagattcagcaactgggttcaaatttttatcaggttcaactgcatcatcttctgaaacaatcaagtgggaagatggtaacgaatacccattaatccgggttgaaattacttcagattctcacccattctacactggccgtcaaaagttccaacaagccgacggtacggttgcgaagttcaacaagaaatacggtttggcttaatattaagtcaaatggtaagcaaaaaagagctaatccatcatggattagctctttttattttgtcatggtaattagtctttaaagtctaggaacggttaagcaacggaccggccgtttaaccaacggaagaggaggaagttgattaataccaatacggaagtggcaatgaaaaccgcgttgtaatcaaacaatcccgaaacagccgaacctaataacggaccaatcatgttgcctagcgcctgaaaagattggttccaactgaaaattcgtccggtgacttccggaggggttcgcttagataaaatactttgcaccgctggtaacatggcaccatccgagatgccgataaagaaacggaaaacgcctaaccagaatactgaaggcacgaacgccatcggtacgtaaaggaccattgcaaataggaaggcgaccgataaaattttctcggttccaattcggtcgccgagttcacccagccggggagcagcaagcatattggcaatcccggggatggcggcgattaaaccggcaaccatggtaactccggcaccgttatgcatcagctccttaacgtacaaactaataattggggcgatggaattattcgaagcttgaataatcatggtggtgataaacatcccaaaaactgcttgcggtcggttcaacttatgtaccacgtctttagcagttaacgaaccttccgtgctttcgattggaacaaagtgttcgtgaactaagaataaactaaggaagaacacgattaataatagtgctccagtgatgaaaaaggtgatacgataagagaagatggaagcgagggctccaccgacgaggggacctaaaagggagccggatacaggaccggttgataggaaaccgagggcgtacccgcttttttctttcggagtttccgtagcaattaaggcgtttgcgttactaatgtaaccagcaaagaccccttgtaacaaacggaggccgattagttggtagacattttggactaatcccatcgcgcctaaaacaaacgccattccgagggaagctcgtaagatcatcagcttacgccctcgtttatcagcaatctttccccagattggtgaaatgatggctagcactaaaaaggttgaggaataagtcagtccactgtatagtgataattgagatttcgagaaattgccgagtgtattgacataaagggacaaaaaaggcataatctcactaaatgcgataccggcaataaacgttccgaaccatagtacaaagaggttttgctgccatggttcgcgtttttttctagctcgtccttctcgatgagaaaacatctaaaagccttctttctaaaataaaggtatacctatatacaataccacaaaaataaaatatatatattggagatctaaaagatgaatagtaagttaaaaaaatggcttagttcaattgcgttaacgttagtggttatttttagtttagcattaattttcaatcgacagatcaaaacgtggatggtatcgcagtacaaccccaccgttagtgaacaggtggtcactaaaaatgaaaagaagaaggctgattttaatttttcaaaggtcaagtcactagactggaagacggtggttaaagcccgggcgtcggaaaagcgaattaaggtaattggcgagattgcctacccggacgtggggattcatttgccaattggtaaaggagtcgacaatttgacgttagcgttagcagccggaacgcttaaggaaaatgaaaagatgggcaagggtaactacgccctggctggtcaccacatgattgataagaaggttctctttgggccgttatattggaaggctaaggtgggacaaaaagtatatttgacggatgaaaagaatatttacgaatatcaagtaaccacccggaagtttattaaagcaacggatgtacaggtgattgacgacgttaaggatcaaaagttacttacgttagttacttgtgatgcaaccggagcgggacgactaatgattcggggaaagttagttaaagaaatgaaacaccaagaagctccggctagtgtccaaaaactgttttcgcgacagtttaaccgctaatttagtggctttttggcggcagtctgctactattaaggtaatcaggtaactttgaaaggaatggataaataatgagtggaatggtcattgggattatcattgttgcaatcttggttgtggcaattgtgttgatgtataacggtttagtaaaggcgcggacttatacgcaagaatcttggagtcaaattaacgttcagctaaaacggcggaacgacttaattcctaatttagtaaatacggttaagggatacgcaacccacgaaaaggaaaccttaagtaaggtagtggaattacgtaaccagttggttgaccaaacgaaggtggcggacccgtcaactgcccaacggcaagcggcaatgcaaacttctaaccagttgagtgatactttaaaaagtatttttgcgctttcagaaaattatccagatttgaaagctaaccaggaatttaacaagttaatggaagaattgaccaataccgaaaataagattgcgtactcacggcaattgtataattcaagcgtagctagttataatattaagctacagtctttcccgagcaatttagtagcgggaatcgggggttttaaagcggtggactacctccaagttccagaagaagaaaccgctgctcctaaagtttctttcgataaataaggctattttaagagggaaaataaatgctatatcaacaaattgcaagtaacaaacgcaagaccgtatacgtaatggttggttttgcgattttggttctcctaattggagcatcggtcggttacgtgttttacaatagcgctagtgcgggagttgtaatggcggcgattattgctgcggtttacatgggattaatgattagtaattcgacaaacgtggtaatgcgaatgaaccacgcgaccgaaattagcgaagctgaccatcccgagctatggcatatcgtagaagatatggcactagtaggaaaggttccgatgcctaaggtgtacattgtagacgatcctagcccgaatgcctttgctaccgggaataacccgcaaaatgcagcggtagcggtaaccaccggaattttggcgcgtttaaatcgcgaagaaatggaaggtgtgattggccacgagatttcacatatccgtaattacgatattcgcctttctacgattgcgttggcactttcagcagcagtttcattgctagttaactgggggatgcatgcattctggtggagtggcggccgccgccgagacagcgacgatgatgaggatagcagtttaagggcaatcttaatgttgctggcgttggtactcgtaattttaggaccaattgccacgtcgattgctcagctggctctttcccgaaatcgcgaatatctcgctgatgcatcaagtgtagaactgacgcggaatccattgggattaattaacgcgttaaaaaagatttcagctagcgaaccgatgcaggaagcggatccgagcagcgcagcattgtacattgcggatccttttaaaaagaagcgctcgttagcccatttgtttgatacccatccgccaattgaagatcgcattgctcgactggagaaaatgtgagttgatcaatcaaagaaatcatttaattgaaagtgagataagggtccatgttgcgtgacgactatatttttgtacatttagaatcaattgttaacttaatttattcgcgcggaattactgccaaggatttcttaagtggaattttgcaggtgccgaccaatattttacttttaaaccgggaagttagtgacgacgttccaatcgataaccatacttttttaaacgagattaacgatgccaagacgattagtcagtatttgcttgatccgcacagcagtaaaaattggatcgatttttctcaagcagaggcacttagtgaattaacgcccaatgacatcgctaatttactgtacatgggacatatgaagagtcatttggacactcccttttcgtacaaactgcaaaacgactacgtttacttagaggtggggactaaccaagtcaaaacttactaccggcggctaaagaatttttacgcagttttaaaccagtcggtaatccggcatgccgaacagacgtataacgaacaccgcttggtttttcggcgcgtcaatcatttctcggaattgccagccagcatggtgaggcaactaattccagtgcttggcgaaggcgtcatttttgcttttgatcaagccattgaacaagaccacgaactgcgggtgccaattttaattgctagtgatagtaatttagcccccacgttgcgtagtaaagaatcactatacaatcaagcgcaacaaatcgcggtgttaaaatataatttaaggaatcaggattggcattttattatcaccaatcccaaggcatttgatgccgaagccttgtactaatgcaggttatttatctgtaaatgaaatgttaacgacttatatagtagctaatgagatgaaagtccagtttttgttaaccaaagctaattttgacggcatgtttctagattaaattggttggtaaaatctactgggcttttttgaacccgttgccttagtaaccaaaaaggtggctatggtataatcgagggtaggtttgaatagggggagctttaaaaatatgaaaatgcaactaagtgaaattgcccgtgctctaggagtagacgagtatccggaccaatggaatgaggttagtgtcaccagtgtccagtttgatagtcgtcaattaacgccgggttctttgtttgttccaatcaagggacaacgcgacggtcaccaatttattgagcaggctattcaggctggcgcggttgcaacgttatgggcgaaggatcatgaagatacccgcccggcagatttaccaagtattgaagtggaagatccgctggctgcgttgcaaaaattagcgaaatactacttagataaaatcaatcccaaagttgtggcaattacgggaagtaacggaaaaactacgacgaaggacatgactgccgccattttggcgaccgaatttaacgtggtgaagacggaagccaacttcaataacgaaattggggttccaatcaccattttgggaatgaacgcgaatactgaggttctagtggttgaattagggatggaccgccccggacaattacatttcttaagtgaattagtccaaccggacatcgcggtaattaccatgattggcgaagcccacattgaattctttaagacgcgagaccggattgcggatgccaaaatggaaattacggacggtttaaaagaagacggttgctttatttacgatggtgacgaaccgttactagtggagcgggccaaggcggtggatgttgaacaacgtacgtttgggatgaaaaatgaaaacgacgtattcgcatccgatgtagcaggtaccgatactgaaacatcatttaagactaatttggaccccgaagtggaggttaaattaccaattattggcgaatataacgtaaaaaatgcgttggcagccattacggtaggtgatcgataccacgtcggagttgcggacagtgctcgtgcattggcagattttaacttaaccaagaaccggaccgaatggctaaaaggccggcagggagaacggattttaagtgacgtatataattctaatcctacggcagctaaagcagtgttaaactcctttgcacatactaagaagaccgggcgccggtttgtggttctgggagatatgttagaactgggagaaaatgccgaccaaatgcatgcccaattagcggacagtttaaatccggctcaattcgaagaagtatttctcgtgggccagcatatgcgtgcgttaggaaaacggctggttgacgaagaaatttatccagcagaagccgttcatttatacgacgcaaacgaacttccgcaattaactactgatttacaacaaatgattaaagctgatgactgtgtactattaaaggccagccacgggattcatttggaaaaagtggttgaacagcttaaataacgaagcataggccggggagaaacccggtctttttttgtagggtaaaaagcacgcgatggtagagaaaggaaatgagctccaggccccagttttctgcggctaacccaatttagaactcaatcgcctaacccgcgattaagccctaaattaagttagtcctcaaaccctggtcaagggcttctactctctatatttggaaacgagttccagcccttagggttctgcggctaacccaatttagaactcaatcgcctaacccgcgattaagccctaaattaagttagtcctcaaaccctgaccaagggcttccactctctattttatttgctaatcccacttcgcgggtgtatgattataaagttatgtttacatgattgttactgtgggctttgccctaaaagacggattttctttgatgcagtagcagaaatttaggaggaattatatttgaaatttaccgaactagggttggaagaagacattttgaaagctgttttagacaatggatacgatgaacccactccaatccaagctgaaacaattcccgatgtcttagcggggaaagatattattggacaggcacaaaccggaaccggaaaaacggctgcgtttggattgccaatcttacaaaatgttgacctagataatcctaatattcaagcaattatcgtttcaccaacgcgtgaattagctgcccaaacccaagcagaaatctttaaattgggtaagtacaagcgagctaaagttcaagttgtgtatggtggagcagacattcgtcggcaaatcaatgcgttgaagagccacccacaaattgttgtgggaactcccggccgacttttagatcacattggccgacacactattcgcttagaccacgttaaaaccctggtccttgacgaagcagatgacatgttggacatgggattcttaccagatattgaaaaaattattgaacaaaccccaagtgaacgacaaacgttactattctcagcaacgatgcccgcaccaatcaaaaagattggggttaagtttatgactgatcctaaacaggtgacggttaagtcaaaagaactaaccgctgatttagttgatcagtactacattcgttctaaagaatttgaaaaatttgatatgttaacccggattattgacgtacagtcacctaagttggcagtagtcttcggtcggacaaagcgccgagttgacgaagtggctaagggcttggttgctcgcggttataacgcagcgggaatccatggagacctaacccaacaacgtcggatgaacatcttacaccaattccgcgatggacagttagacatcttggttgctactgacgttgcggctcggggattagatatctctggggtgactcacgtttataattacgacattccgcaggatcctgaaagttacgttcaccggattggccggactggtcgggccggtgctcacggaacttccgtaacctttgtaactaactgggaaatggattacctccgagacgtagaacgtttaacgaagaaacgcttgcttccattaaagccaccaacagaagaagaagccttcattggtcgggcagcaatggctgaacaaaacgtgcaagaattggttaaaaagaccgatgttgataagtttggcgaacaagcagaccgtttattagaacaatacgacgcgcgtacattagtagctgccttattgaacgatgaaactaaggcagacgcgagtgagattaaggttaaaattacccctgaacgcccattaccacgcaagaagagcggtaaccataagagtggcggctaccgcggcggtcgacgccatggtggtggcaacggctaccggcgcaacggtaacggtggtaaatggaacgaccgcaagaacggtcatcgccgagaccgggatgaccgccacgcaggttcaaaccaccggcaagataacaacaagggcggtaataagcgccactttgtaattaaagaaaaataaagtttaaacatttaatgaggttactggagctttgatttcaggcctcattttttgttttcacagttttagaaaaactttaccaatttagcttaggactagcgggggtagctgaaaaagccgtttagtatgtaaagcttgccatgaagggcttaagatgggatgttttttcaaaggcaagtttgatacaataaatgacgacaatgggaggattcacatgatctacggaattggcatcgacattaccaacattgatcgatttaaagcgttgcacaatccaacgtctttcatcaagaaagtgttaacagataaagaacaagccgaattggcaggtaagagcggtcagcgagcatacgaatttttggctggccatttttcagttaaagaatcctatagtaaagcatacggtacgggattaggaaaaaagcttaattttcaagatattgaagttgagtatgacgacaacggtcgaccagtaattagcaaccatccctttgcaggagttgcgcacgtgtcgatttcgcattcaaaacaccatgtcgtaacacaggtaatcttagagggggattaacaatggttgaaggatggcatcgcgcaagtcggctagtagtcgatgcggcggcaattcggcaaaatgtaaaaaaggaaattgaacgtttagatccgcaaagcgagttatttgccgtgatcaaggcggatgcgtacggtcatggactgattccggtggcccggtatactgaacaagcgggcgccaccggtttttgcgtggcaattttagacgaggcattgaccctgcgagaggcgggttttgttgaaccaatcttagtcttaggaatcactaacgtaaagtgggcggctttagctgctgaaaagaacgtttctttaaccgtgggagacgtggagtggttgactaaggcggctccccagttaacggcagaacatccgttaaaggttcatttggcgttagacactggaatgggacggattggttttcaagagtcagatggccttaatcaggcggcaaagttgctcatcaatgatccgcgttttgtttttgaaggtgtatttacacactttgcaaccgcggatgaaaaggatcccacttatttcaatcttcaagtggaccgttttcataaattagtggacactttgccagaaaagcctcgctacgttcacgtttctaatacagcaactagtctatggcacgcagcttgcaacggtaacctaatccggtttggggtcggaatttatgggatgaatccgtccggaaccgttttggaaccaccgtatgatttgcagccagccatgacgttagagtcccagctttcattttctaagctgttgaaaaaggggcgttcggtaagctatggagcaacttacactgctgaacaagacgaatggattgggacagttccaattggctatgccgatgggtatctccgctgtttacaagggttccacgtgttagttgacgggcatttttgtgaaatcgtgggccgagtttgcatggaccagttaatgattcgccttccgcatgaatatccggcgggaacctcggtaatcttagcggggcaatcgcaagggaaaagtattagcatgacggacattgctgattatgctggaacaattaattatgaaatcacatgtggctttacggagcggattccgcgtgtctataagaataatgatatagtaaaataatttcattgatggtagaatgaaagtaataatcaggaatacaggagagcgagcctaatgagtaatcaactaagggatatatctgttgaaaaagagatttattgtgaaatgtttgaagttgaacccactggggtaagtgaccagttgattcatgctttttttgagcgtcatgctgcagaacatttggagctcttaaaggcgggctaccaacaaatggcggacattaacgccaagattacccaggattttacatcctgcgaagcggcttgtgaagaacacgtatttaacgtgttaagtagtgattaaattaatagattgaatatggggtggcactgtggacgaatccaaggtaaaacgcggcgatttgttctatgcagacttgtcaccagttgttggttctgaacaagggggaatgcgtccggttttagtgattcaaaataatgttgggaatcactacagtccgacggtaatcattgcagccattacgactagaattactaaaccgaaaatgcccacccacgttgccattcgtgcaggcgaagccggtaatccacgggcttcggtaatcttaatggaacagattcgaacaattgataaacaacgtctacatgatcgaattggccgtctggacggccaaaaaatgaaactcgtcaacgaagccctcaaagttagtttgggcttggtggcgaatacataaaagactattgaaatttcaatggtcgtggtaaattaaaaaggcgtctcaagaattttttagttcttgagacgccttttttagttgatgcttatcaacttaagcaaggcggtgcgactgcaaatcttcgacttcgggaactttaaagcctttccgttctagattgctaataatgcgctgcaactttttaggtggtactcccgccggtaaagtgaatagcgtccggtgaattaattcgtcttcgttggaatccaaagtaatgacgctcgcaatggaggtgtacttcgtaatgatctttgcactagtggctaaatcgccacgttcgtcactagaaaccaccgtgattacgtaactccccacgttagtgttccaagattgggaaagggcgtctaatagccgggcatgggtcaagattccgtaaaaatagttattgtcgtctaaaacggtaatgtacggcaagtccttgatggtaaaaaatacggtgaaaaacgcggcactcaagttaatgtacttggtcgcgtttttcagtaaactagtcaccgggtcttgcattgaccctccccgcgacttatgccgataaatgtgcattttgtaaatgttcccgcgaaagagccgtcccgttttatctaaaatggggacgcaacgaaaacccgagtcttctaaaattttaagtgcctcttcgagcgtggcatcttcttgaacggtagttaggcgttgcttgggtttaaccattgattttaataacattatggattaccctccatatcttaatctatttttaataatagcatagattaagacgttagaataccactaccggagtcccaactgggacagcttcgaataattttttcatcgttgcgggtggggtgttgacacagccatgtgaaccatgggtcttgtaccaatcgccaccaaatttaggttgccaagaagcatcgtgaagaccgaccccggtgtaatcaattggcatccagtagttcacgggtgaagcatagttggagccgtcgtcatttttaccacgcagcgttgcgttacgctgtttattccaaacgtaaaagactcccgtaggcgtagtattgccacccgatggttttccagttaccacgtcggtagaaatttgtagtttaccatctttgtagtaccacatgtgttggttagttttatcaacttccacgtacgtggttccgagttcgccctttttcaaagactgtccggagccaacgatggtggctttctgggtgaaacttgcacccttgagaatgttggtactcaagttggccgcatcggccgtggtattgattgaccagccaaaaatgccatccttaacggtttgggtaccgcgcttagtactgttgaaggtcacgtccgcaccataagtagcgtatttttggtttaaatctgctaaataagccttcaccttagattgatcaacgcttaatttttgctgaccttgagcatcagtcttaactttaagccaactcttcagagtcgcttggggaattacgatggtgttgccgttcacatcgtaagtgattttttcgttttccgcctgaatgcgttgcaacttgacttgggctgcgttgtttttcttagagtaataggtgttctttaaatctagctcgtgagcacctttagccgtgctagcctggatttgttgtgccaaaatttcggggctaactacgtgaccagttgaattggtgctggagtttaacttttggttcagctggtcggcagcagtctgcgcgtaagcatttagttttttagtccccgcttgatcaaggttaacactaggagtgtcagccgcgttagccacgtccattaactgaagaggccacgtccaagggttctgtgacttaattgcgctggtgatagattgccgactggttgagttaagtccggcgtcagctaggctaacttttttaacaactttgccgttagcagttaaatttaatttttggttgcttaagtgcttttcaattagttgctgtgcttgggtggcgttttttccgcccacgttagcacccgctaccgtcgtatttggcatgaaggtgctactagatttataatggtaggccattccagcgtagcccaaccctaagataaccaccgcgccgattgtgatggcggtcttagaatggtgtggctgctggtgctgatgtttgcgttgttgcatagtacttcccccaaatgatttaattctttacttttgctttcttctgtaacattactgtaatatttcgaatatatcaagtctactatgcgaatcttaacaaaaaaatctgggtttgacaccaatatttgcacaattaactgattttagtacaagctgtttggggaagggacgtaaaaagagggtacaaaaaaagcaccggttgcaaccggtgctttcgttgataaatttaatgattatttgtcttgtttttcagcaagagcgtttagaccgtcagtaagaaccttcttcaaagtagttgctgagtcagtcatcttcttcttttcgtcatcgctaagtggtgcttcgataacgcggtttagaccttgaccattgataactgcaggagtaccaatgtaaatgtcgttcaaaccatattcgccatccatgtatgcaccaacaggcaatacggcgttttcgtcgcgaagaattgctttagaaatgcgcatcaatgcagtaccaacaccgtagaatgtagcacccttcttgttgatgatttcgtaagctttgttacgtacgctgtcttcgatttcagccaattcgtcagttgaaacgccttcttctttagcgatttcaagcaatggctttgtaccgattgtagctgatgagtaagcagcaaattcactgtcaccatgttcacctaagatgtaagcatctacagattctgggctaacgttgaatttcttaccaagagctacgcgcaaacgagctgtgtcaagtgagatacctgaaccgataactttttccttagggaagccagagaatttccatgttgcgtaagtaaggatatcaactgggttagcagcaacaaggaagataccatcaaaaccagaatcaacaactggtttaacaatcgttgaaaggatgtttaagttcttgttaacaaggtcaagacgtgtttcacctggcttttgtggtgcgccagctgtgataacaactaagtcagcatccttgcagtctgagtattcaccagagtagatgttctttggagctgtgaatggagtagcatcttcaaggtccaatgcgtccccaactgtacgatccttaacaacgtcgacaatgacgaattcttcagcgattccttgttgtgccatcgcgaatgcgtaactagaacctacggcaccgtcaccgacgaggacaactttttgatgattttgaatattagacataatatccattcccttcatttattagattatatatttggtccaccaaagtattatagcattttaacaggggaaagttgagacctaattttcagaaaacaaataagtttgccaaaaataattaccgagcgaacagaagtaatatctaagcttttgtggcgatatatgataagattatttaaaacgagctcaagctgaaggggcggattcctttcagctatttttgcgtatgaggatgataaataatgaaaatgattgttggtttaggaaacattggaaaagaatatgatcaaacgcggcacaacaccggctttatggtggtagacgcactagctaaaaagtatggggtggatcattttaagattcatcacgaggccatggttggcgaatttttcttaaatggtgaaaaggttttattagtgaaaccaactacctacatgaacgattctgggcgagcggtacgtccgttaatggactactatgacttagcattaacggatttgatcgtggtttatgatgacatggacatgccggtggggaaaattcgtttgcgacaaaagggctcggcaggcgggcataacgggattaagagtttgattgcccacttaggtaccgaaaagtttcgccggctccgggtgggaatcgaacacccagcacaccaaaaagtggtggattatgtgcttggaagatttacaaaagaacaaaaagcggattttgaaattggcgtacaaaacgcaattgcggcgctcgacgactggctagcgggcgcggaatttagtcagttgatgaatcaatataattagtggggcaagtatgaatattgaaaaaatttttgcagacaccaaggcagttgttgaggttactagcaatttaggagcgcaaacccgtcaattagtgaccggtttattagaaccggccaaacaactgtttttgaatgcgttattacagaaacaaaatcaaccaattttagtggtaacggatagcttggcacacgcggaacgactgtataacgagttagcagaagggcaactggacttacatgcctactggtttccggcagaagagattatcgcggcagaggtggcgaccagttcgcccaactaccggacggcacgggtgcgttttttaaacgccctcgctaatcagcaacggggaatttatgttacctctgcttctggttttcggcgaatggtcccggcggccgcagacgttaagcaggcccagctagaaattagcgtgggggaagaatacgacccgcaacagctaattcaacagctagtccaactgggataccaacgggttgaacaggtagaaaagaaatcggaatttgccgttcgcggttcaatcgtggatatttttccgcttaaccaggacgttccagtgcgcgtagacttttttgacgttgaggtagattcacttcgaactttcgaccaaaataaccaacgcagtatcgaaaatattacccagactaaaatcttaccggcgacggatctgattgtgactgaagaacaattccatcaaggaatcgctaagttacaaaaacaagttcagcaagcgcgtaaacggctggatgaagataaccaagaacttttacagcaaaacattgcggaagttacggaacgctggcaaaagcaccagattatcccagaagacgttatctacactaagcaactctacgcaaagcctaattcgctgctcgattatttagctgacgggatgcttgtggttgacgactacccgcggattttggatgcggagttagatattcaaaaaaatgaggctagttggattgtcgaccagttaaagaacaacgttttgttagacaatgatccgttgggcttagaaatccgccaattaatccggcaaaaaaagcaaccccaaatctttttatcgatgtttcaaaaggggatgggccggcttaagtttgaccaactaacggaaattactaccagagcggtccaggaattctttggccaaatgcccgttttaaagggcgaagtggaacggtggatgagccggcacgccaccgtcttgatttttgccaattctaaagagcggcaaagtaaaattgccagcacgttgcgtgattttgaaatcgaatcacgaaccgtgcaagcagatcggatagttaccggggcggtcaacattattgggcaatccttttcacaagggtttgaaatgcccgacgccaaaatggtggtgcttactgaaaaggaactgtttgccaaagttcgcaaaaagcggccgcgccaacagcacattgaaaatgcggaacggttaaaaagttataccgagttaaagcccggagattttgtggtgcacgtcaatcacgggattggtaaatacttgggaatgaccaccatggaagttgatggagttcaccaagattaccttaccatccaatatcagggcagcggacagcttttcattccagttacccagcttaatttagttcaaaaatacgtggcggcggaaggcaagcgcccgaagatcaaccgactgggcggatctgactgggctaagactaagcaacacgttgcttctaaaattgaagacattgcggacgatttgattgaactatatgccaaacgggaggccgaaaaggggtttgcctttccaccggatgacgatttgcaattacaatttgaaaatgactttccttacaccgaaactcctgaccaattgcggtccataaaggaagttaaggaagacatggaaaagccccggccaatggaccgactgctagttggcgacgtgggttatgggaagaccgaagttgccctgcgagctgcttttaaggcgattgaaggtggcaagcaggtggcaattctcgtaccgacaacaattttagcgcaacaacatttcgacacgatgaacgaccgttttggagattatccaattacgaccgcgatgctgtcccgttttcaaactaacgcgcaaattaaggaagctttagcagggttgaaagacggcaccattgacatcgtagtgggcactcaccgactgctatcaaaggacgttcaatttaaggatttaggcctgttagtgattgatgaggaacaacgcttcggggtgaaacataaagaacggattaaagctttgcgttctcaagtggacgtcctcaccctcactgctaccccaatcccccgcacgttgaacatgtcaatgattggggtgcgcgatctttcagtaattgaaactccgccaaccaaccgttacccgattcaaacctacgtggttgaagaaaatgccgggattatccgcgaaggaattatgcgtgaaatccggcgggacggccaggtattcttcttgcataatcgggtgcaagacattgaaaaggtggttgcccaaattgaggcattggttcccgaagcacgggttgcctacattcacggtcaaatgaccgaaaaacaattagaagatattttgtttgatttcattgagggggaatacgacgtgctggtaacgaccacgattattgaaaccggcatcgacattcccaacgccaataccctatttgtagaaaacgctgatcacatgggcctttcccaactttatcaactgcggggacgaatcggacgctcctctcgagttgcgtacgcgtacttcctttaccaaagggaccgggtcttgactgagttgggggaaaaacgcctggaagccattaaagacttcaccgaattgggatccggctttaaaatcgccatgcgcgacctttcgattcggggggcgggtaacttacttggtaaacagcaacatgggttcattgattcggttgggtacgacttgtattcgcaaatgctggctgatgcagttaagcaaaagcagggcaagaaggttcccaaacgttctgatagtgaaattgatttagaaatcgaagcctttcttccaagtacgtacattgaagactcacagcaaaaaattgaattttacaaacgactccggcaagttgattccactgatggcttaatggacgtggtggatgatttgattgaccggtttggcgaatacccaaccgaagttgccaacttgattcaaattaccgagcttaaattacacgcggatgctgcgcaggtagaaaaaatcgagcggaaaaatggcaacttgttcattaccttaactccggcggcaagccagcggattagcggcgaaaacgtctttgccgcgctatcggtcactaaactgcgagcgacagtggcggaatcaaatgataaaatgcatataaagttagttattcaaccgcaaatgacgcaacaagattggtttgagcaactaatgagctacgttaaaaaattagctgaatatctgtgaggaagcgacttgaaaaaaataaccgagcaaaaagcaatgcggggagccttcattctatcggttgccgcgattatcgctaaggttttgagcgccgtttaccggattcctctccaaaatttggttggtaacaccggtttttacgtataccaacaaatttatccgatttacggaattgggatgaccttcgcgcttaatgggtatcccaactttatttctaaaatcattgccgaagaacctgatgaaaaaagaaaattagtacttggccagtactccataatgatcctaacggtgctttccgcgacggtgtttttgatactggttggcggcgcgcagccgattgctcaggcaatgggggaccgtcagctggcgccgatgctccgggtcgtagcaaccatgtttttgctgatgccgtttttagcaacgggacggggatactaccaaggaatttataacgttattccaacggcaaaatcgcaagttgtcgaacaagtggtccgggtaagcatcatcattttggtggcgataatcacggtgcagcaagactggtcggtttacaaaatgggcgcttacgcgatggctagttctaccgtagccgcggtagctgcaagctggttttttataccagtaatccgtaagatcatgcacgaaggtaccgctcactttcaatggtccgtatttaaagatttaggaaaacggttcgtggtggaaggcgggctaatttgcctgctttcggcgatgattatcctgcttcagttagtggattcgtttaccgttaaaaataatctagtggcggcaggaatgttacctgacgccgcaaaagctctaaagggagtttacgaccgcgcccagccattagtacaagtcggaacggtaatcgcgaccgcgtttgcgaccacgttattgccttcgttgaccgaagctttgcaaaaacgtgattccggggccttttatcgctcggcaacttcgctaatccgagtggcggtggcaatttcatcggcagctagcgtggggatgattgctttaatgccgtttatcaaccggctgctcttcggtagtttcgctggttcgggcgctttggcaatttataacctcagcgtaattttggcggcgttgatttttgttaataatagtgttttacaaagcatggggcgcttaaagatgacgttttgggcgattgcggccggtctttgcgtcaaggtgatttgcaatggttgggcggtccgccactggtcaattactggcgcaagctggataaccgtccttagtttggtaatcattgctggcgcgatgagttgggcgttaccagtgcggctgttaaagagggtttacctagaaaaccactttttactaaaattgttaattggaaacgcggtgatgtttggcgttgtgcaactaatcaccggatttttacgagtgttggtttcaagtgatggtcggggagctgctttgctaattacggcagtggcagcactaattggtgcgttaacttggctaagttttgtgctaattaatcgggtcttcaccctccgagagtggttgacgatcccctttggcaaaaaaataataagaacaatacagaggatggttaaatgagactagataaatttttaaaagtttcgcgaattattaaacggcgggcgttagcaaaggaagttgctgaccagggccgaattttaatcaatgataaggtagcaaagtcttcatcaaacgtggttcctaacgatcaagttgaaatccgttttggaaataaaacgttggtgatccgggtggaacagctgttggatacaaccaaaaaagacgatgcggaacgaatgtatacgattatttctgaaaactatcaacaagattttagaaaataatttaaaacttggtaaatatgcgtggacaggctaggtaagcgttgttataatcggaagtgattaaggggatataacaatgacaaataatcaacatcatcagaaaaaaaatcacagcaaaatgagttaccggacggcaaccggagcaccgaatccttatgcacgggcacggaaaaaacgtgctttagttatcttaggagtttttgcggcggttgcggcggtctttttgttccaaatagtccacgcaaaggtgtctcaaaacagcgtgaatgcaaaacttgcggtggaatcggcacgctacacaaaaatgaaggatgaaaacgcccagttaaaagacaaggttaagcaaatgaatgatgaaaattatttggaaaagttaatccgggcaaagtacttctacactaaaaaaggtgaaacggtatataacttacctaacgatgccaagtaatggtaaaaccagattaaattaatgaatttttgaaattgaatagtcgttttaagaagtgaaaagcagggttttgaaaaccaatcctgtttttcacttttttctgttaagtaacccgttttcgaatgtataatttcttaaaaattttcaacaacgtccaatttttttcatgaccgttgaaaataaatttttccgggtcgacagctcgcaagccactagtaagaaatggtataattagacattaaattttttaggaggaacatacggatttatgtcaattgaagttggaactaaggtagatgggaaagtttctggaatcactaattttggagcttttgtagatttaggggagcatcggtctggcttagttcatatcagtgaagtttctgatagttttgttaaggatattcacagcgtacttaaggtaggcgattcggttacggtgaaggtactttcgattgctgatgacggtaagattgctttatccattcgcaaggcggtagagcggccggcgcaagcagcaccgaagaagtctcatgaataccatcattcacgagacgaccggcaattcaatcatcaatctaatcaccaagcaaaacagcatcattcaaacgcaaacgaatcgtttgaccaaatgctatcgggctttttaaaggacagcgaatcccgtctttccatgcttaagaaaaatacggatggtaaacgcggcggacgcggtggacggcgcaactaatgattagtttaagggcgctgggtgaaaaaattgttgaccattatcaattgaatcaagcgccggtggtcgtagcggtctcgacaggagtggactccacggtattaatcaacgcgcttttagcagcgtctaatctcgctgaaaatcggctagttattgcccacgtaaaccaccagttgcgttcccaaagcgtgcaagaagaggaatttttgcggcaatggtgtgcaaaacgacgactgacgtttgtaagtactaagtggcctagagaactgcatcccgatacgggagtggaggctgctgctcggcggtttaggtatgatttttttgccaaggtaatgcaacggtatcacgcaaacaccctcttgacggctcataacgctaccgaacaggctgaaagtttccttatgcaagtggtgcgcggaggttggttaagccagttacgcggcactcccgaggagcggtcttttgcgaccgggcgtttagtgcggccatttttaaaaattagcaagccgactttagtagcgcttgcgcaggaaaatcacctaacttggtttgaagatgaaactaaccaacaggatgattatttgcgtaaccgggtgcgtaatcagttgctgcccgccctgcaagcggaaaatccgcgcgtggtggagcatattggacaataccaaaccgagattaccgaacaagaccaattgatcaaagaaattagtcgacaaaaactagcgcagctccggcaggggagtcaatatcagttaccaaagttcaaagcggagtcgcggttatggcaaaaccaactgttaaaacagttggtcagcgagtcttgtcccgcagtggcaattggacaaaataagctggatgaagttttagaatttattaatcaaactaatttagcacagggctcgattgatttaggtaacgattatgtactggaaatcacgtacgatttattacaaataatcaaaaaaaagaccgtaaaaagtgaacaagctaaaaagcatatggtaacattgaacaagtggttaactttagatgagggtactcaatttcgaattagcgaccgttccgttgctggaccggttgccggagcaatggtgttgagtgacaatcagcttaagcaaccgctttttgttcgtcaggcaaccccccaagatcggttacggttaaaaaacggcaagtataagaccgttcgacgggaattaatcgatcaaaaggttcctcgtgaacagcgagcgaatttttgggcagttgtggacggcgaccaaagggttttgtgggtactcggtttaagacaagcatggttagccgaaccctacttagcaacgcaaacaaaatatattttggaatatagaactggaggacgtccccatggacaatgatatcgccaaagttttatacagtgaggcagatataaaagaagcttgccaacgtttaggtaagcaattgacgaaggattatgctggtaaacgcccgttgattttaagcgtattgacaggggccatgtttttcacaacggacgtggtccgcgaatttgatggttatgcacagatcgattttattgacgtatctagttataacggcggcactcaatcaagcggaaaagttgaattaattaccgatatctccgaagatgttagtggccgtgacgtgctgatcattgaagacattgtggatactggacgtactttacgctacgtaatggatttactatattcccgtaacgcgaagagtgttaaaatttgtagcttcttggataagcctgccggtcgcgatgtggaagctacggcagactatgtgggctttacggttccaaacgaatttgtggtcggatacgggctagattaccaaggttattaccgcaatttaccgtacgtgggtgttttaaagccggaaatttataagtaaaaacattggtcaaagttagtcaaatgtgatattatatcgacaacagtcaagattaaaattaatgcgtcttgatgccttacaaggaggaactacatgaaaaataacagaaatgggctgtttaaaaatagtcttttctatatcgtagtttttttgagtattatgggaattatcgctgcggtagtgggcaagggtggaaacaaccaaacctccaccatttcgtcaagcgagtttatttcacagcttaaaaaagacaacgtgaaaagttttgatattcagccatcaaatggtgtgtataagatcactggtaaatatcgttctgcgcaagaggatgatactgccacagggttattccccggaacagtttcatctagtaaggtaaccgggttccaaacttcggtactacagaatgactcgaccgtctcccaaatcaccaaaactgcatcatctgatggagtaaaggtaagtactaaggaagaagaatcgagtagcttctgggttcaactcctcgtaacgggattgccattaatcttctttattttcattttctacatgatgatgggtcaggccggacaaggcggcgctggcaagggagtaatgaactttggtaaatcgaaggttaaacccgctgataagagtgccaataaagttcgtttctctgacgtagctggagaagaagaagaaaagcaagaattagtggaagtagttgaattcttaaaagatccgcggaagttcgtgcaattaggtgcccgaattccagccggggttctgcttgagggacctcccgggacaggtaaaactttactagccaaagcggtagccggtgaagccggggttccgttctactcaatttctggttcagacttcgtagaaatgttcgtcggggtcggtgctagccgagttcgggacttgtttgaccaagcaaagaagaacgccccatcgatcatctttattgatgaaattgatgcggttggacggcgtcggggcaacggcactggcggcggtcatgatgaacgtgaacaaaccttgaaccaattactggttgaaatggacggatttaccggtaacgaaggggtaatcgtcatggcggctactaaccgttcggacgtattggatcctgcgttgcttcgtccaggtcgttttgaccggaagatcttggttggtcggccagacgttaatggtcgggaagccatcttacacgtccatgcaaaaaacaaaccaattgctagcgacgttgacctagctgagattgctaaacaaactcctggttttgtaggggcagatttggaaaacttgcttaacgaggcggcgctgttagctgcccggcgtaataagaaggttatcgacgcagccgacttagacgaagccgaagaccgggtaattgctggaccagcgaagaagaacgcggtggtcagcaagaaggaacggcaaacggtggcttaccacgaagctggacataccattgtggggttagttctcaacgatgcccgggtcgtgcataaagttaccatcgttccgcgggggcgtgcaggtggttacgcgattatgctaccgcgtgaagaccaaatgctgatgtctaagaaagacgcgatggaacagattgctggtttgatgggtggtcgtgctgctgaagaaattattttcaatcaacaatcttcgggagcttcaaatgacttcgaacaagctacgcaaattgcccgctcaatggttatgcagtacgggatgagtgataagatcggtcaagtagaattggctgcacctggacaatcctactacggcgaaagcggaccggcatactctgaaaagactgccgcaaccattgacgaagaaattcggcgctttactaccgaaggttacgaacaagctcgcaagattatccaagagcatcgtgaacaacacaagattattgcggaagctttgcttaagtacgaaaccttggatgaaaagcaaattctcagtttgttcaagactggtaagatgccggaaaagaaatcggacactgaatttccaagcgaaaaagctgcaacgttcgaagaagctaagcgtgaattagaacgcaaggaagctgaacgccacgaacaagcggctaactccgttaaggaatccaacgctaaagataatgaagacacgaccgtttactatcctaatgacgaggatcatgacgacggttcaacaaattaatagccaaagaatcgtgggttgcccaatgcactcacgatttttttgcgaaaggagcatactcaatgagtgattatttaataaaaagtattgttaatgacgggatgtttcgggcttacgcagttaataccactaacttggttcaagaagcccaacaacgccacgattcgtggagcgcagctacggcagcattagggcgttcattaacagcgaccttgttactgtcttcatccgttttaaagggtgaagaaaagcttacggtaaaaattaatggtggcggtccggtgggcaccatcgtggtggatggcaacgccaagggaacggttaagggttaccttcagcatccgcacgtatctttgccgctgaaggaagaccaccatattgacgtgggccaagcagttggtaaccaaggggttatggcagttactaaggatatgggacttggcgacccgtttaccggccaagttgggttagtttctggtgaaattggcgacgacttcacttactaccttgcacaatctgagcagattccttcggcggtaggagtgtcagtctttgtgaacccggacgaaacggttggcgtagcagggggcttcttgattcaagtaatgccagacgctacggatgatgcaattgatcgcttgcaagcgcggttaaaggaaattccgttgatttcagaaatgcttcgtaacggcaagaccccggaagaaattttaaacgatatttttaaggacgatcaggttaaaattttagataaaatggacgttaaatttgaatgcgattgttctaaagaacgctttgcacaatcattagcttccctccctacggaagagcttcaagaaatgatcgataaagatcagggagcacaagcagtttgccggttctgcggcaaccagtatcaattctccgaagctgatttgcaaaaaatcattgatgaaaagtaatttgccaaaatttgtgtaataaggatcccgcggttcctccacaatcgcaattttgtgtgctatcatattctgcatgcataaaaagtttgatgaggtgaaaaaatggaatggaaaattggggatataacgatcccaaatcaattagttgttgcaccgatggctggggtgactaacacggcctttcgggtgatctgcaagcagtttggtgccgggctggtagtttgtgaaatgatttcggaccggggcatcatttacggtaacaaaaaaacgttaagtatgatgcaagttgaccccaacgaacatccaatgagtatccagatttttggcggtactaaggaaactttggtggaagccgctaaatttgtggatcaaaatactgaagcagacattatcgacatcaacatgggttgcccagttaacaaagtggttaatacggatgcaggggcgcgttggttgttagatcctaataaggtttacgaaatggtttcctacgttaccgacgccgttaaaaagcccgtaaccgtaaaaatgcggactggctgggatgataaacacatttacgcggtggaaaatgccctggctgcacaacgagctggagcagctgccttagcaatgcacggtcggacccggaaacaaatgtacactggtcatgccgattgggacatcttaaaagaagttgccagtcaattgcacattccgtttatgggtaatggagacgtaaggacgccccaagacgctaaacggatgttagatgaagtgggcgccgacgcggtaatgattggccgggccgttttaggtaatccatgggagcttcaaaaggtggcagcctaccttaacgatggaacgctcattgacgaacctaccccagcagaaaaaattaagattgctaaggaacatttgcatggcttagttgagttgaagggtgaaaatatcggaccgcgtgaattccggggtcaagcggcatattaccttaaaggggtgccacactctgcacgaaccaaggtagccctaaatgctgccgaaactgaaaaagaaatgatcgatatttttgaccggtttattgaaaagctagactctcgaatgagtcgagttgcgaaataaggttgcattttaccgttttaataagtaataattatatttgaaaaattaaagagggggatcacatagtgggcgagaagcaacaaccaagtatgaatgaccaactacgggtacgtcgtgaaaagatgcaagaattacgcgacaagggaattgacccgtttggccatcgttttgaaagaacacatttagccgcacaattacacgaaaagtacggtgacatgtcaaaagaagaaattgaagaacagggcgttgtcgcaaccgttgctggtcggatggtttcaaagcgcggtaagggaaaggtcggttttgctgacttaaaggaccgttctggaaagattcaactttacgtacgtaaggatgaattaggcgaagacgtctacaaaatctttaaacgtgctgatttaggtgatttcctaggagtaactggggacgtaatgaagacggacatgggtgaattaactatcaaggttacgtcattgaccttcttaagtaaggcactgcgtccgttaccagacaagtttcatggtttacaaaacgttgagcaaatttaccggcaacgttatttagatttgattgcaaacgatgaaagcatggaacgcttccgtaaacggaccaagatcgtatcggcaattcggcgctacctagacgaccatggattcgctgaagttgaaacgccagttctccacactcaagcaggtggagcaagcgcacggccatttattacccatcacaatgcgttagacattgatttatacttacgaattgctttggaactccacttgaagcgattaattgttggtggaatggaacgcgtttatgaaattggtcgagttttccgtaatgaaggaatcgacactcgtcataacccagaattcaccatgctagaaacttacgtagcttactacgacttccacgacgtaatggacgaaacggaaggcattttaaaggtggcggttaacgccgtttcagatgacggcaagattacgtaccaaggtacggagctcgacttgaaccaagactttgaacgtttacacatggttgatgcgattaagaagtatgctggagttgatttctggccagaaatgtctgttgaagaagcccgcaaattggctgacgaacatggcgtaaaatacgaatcatggtggacagttggtcacattataaacgaattcttcgaagataaggtgcaagatcaattgaagcaaccagtcttcatctatggtcatccagttgaaatctcgccgttagcaaagaagaatgctgacgacccacgctttacggatcgttttgaattatatatcttaggtaacgaatacggaaacgcctttaccgaattaaacgacccaattgaccagcggcaacgttttgaggctcaagttgcagaacgggaagctggtaacgaagaagcagaaggaattgacgaagactacattgaagctttggaatacggtatgccaccaactggcggtttaggaatcggaattgaccgcttagtaatgttgctaaccgatgctccttcaattcgtgacgtgcttctattcccaacgatgcgtccaattgattaacagataaataagcaaagatcacgctatttagcgtgatcttttttgtttgcttatgaaagtaaaactattttcatgagtcaccttaaacaaaaagtctgggcaaaatttgataacgaaggtggctgagtaaaaagattttataaaagttgatcagttgcaagcgttaccgaatcgcacagtgtggccttttggtgtgaaagtgccattttttataatggttttcttaaaaatgctattgacgaaggatggtaaaacttggtactatatttgagtgccaatgatacgctatttcgaaacgagaaataatgagatattcattaaaaaagtgttgacaatcatttttctcaatgatatagttaaatagttgtcaaaagaaattgttttaatttgaaatctcatgaacgacgtcttccttaacgccgctcaaatatagtaccaagttttatacgggtacgtcaacccatttttctaaattattttaatttttccgctttccacccctccaagtgctctgctaacggcttaaaacctgcatcatagtggctttttgtccaaaaatgcttatgattaacataaaaattaattggcctagggtacttacttaagttacccttggtttcctttaaagcacgaattgacagcgcaaagcgtcgattgccatcatcttccattaccaccgcttgaactttttctccaatatcaaaagcgtggtgcatatttctaatatactgattgtcacactctgaaacatgtatcaaccccttacgtccctttttatcctgaataaaaagaccgtaatcccggatgccaacgatttttacttcaagtatttctcctagtttatacatattgctctgctcccctctaaaagtttaattttaaggtaatcttttaaaaaagcaaagttccttccctaactgtatgataatatagactgcggattcaagaaaagcgggattaaaacaaggctttctagacggtgaaagttaaatcctcaatatatgatacctaaatttttagataaggaatgattctttgcaaactctaattgactttgttcttcacattgacgaacacttggtaactattgtaaataacttcggtaactattcttacttaattctatttgccattatctttattgaaactggtgccgtaattctcccgtttctaccaggtgattcccttttatttgcagctactgctctttctgctaaacctgaatacgggctaaacgtttgggcattcatcattttattttctcttgcagccttattgggagactccctaaacttctttttaggaaagcacgtcggaatggcactgcgcaggcatcccttctttggtaagtttatcagtgacgaaaaaatggacgaagctcagtattttttcgagaagcatggtaacatttccatcaccctagcacggttcatgcccatcattagaactttcgctccttttgtcgctgctggagctaacatgccttaccgatcattcatccgctataacatcgtggggaattttgcttgggtagccgtttgctgtggtgctggttacttctttggcaacatcccatttgtaaaagagcatttttcattagtggtaattggcattatcgtcgtttccctaattcctgcaataatttcgttcatcaagtcaaaatcaaaaaaacaggtcaactaacgtaaccccgctcattaaacggaggtctacgttaggacctgtttttttattattcgataaaaaatgatcatgtacatttcaaaaagaattcctattaaggcaaaactaagcgcgaaaaaccgatccgttaatacgttgataatcggatccgtttttggatcaaaaatccaataattatccctaaaaaagacttgatgaaaaataataaaataacggttaaaatccactgccaagaaaaaaatgattaacggagttaccacaatggtaatctgaaagaaacgcaacatttgccactcctgtttttctctaaaaattcggtgccaaattaatagtagtccgccgattgccaataccaacgtaatggaatttaataaaaacagattttttaccgccgccatatgaattaaccctcccttagaaaaagggaaatccgccaagttaagacgtttcacccagggcaattctaagtacgctaatagttggtggtaatttttgatgacctgcgcagtagttaaacccgttgtgtgaacagttcgcgccgttaatgaccaatgaaacaaccagggcgaattgattgtaagaaaaattgcaccactaatcccaacccaaattgtcaataaagctgccattagtttgcgcatttttattgccattcatcaaaactattaatttcgtgcgtaggtttaaccgcctgctttgccaccaattcaggcgttgaaacccccgtatacaccaataaagtatccatgccgaaattgattccagcggaaatgtcagtcatgtaattgtctcccaccataactacctgatcctttggcaaccccattacctttaatgccttttccataataatggtttctggctttccgatataaaaggccttttgctgcgttgaacgctctagcaaagcaattacagagcccgcacccggtactaatccccgttcattaggcaaattagtgtccgcgttggtgccaataaatttagcacctttttttactgctaaggttgctacctcaaatttatgatatgtaacatcgtaatccaacccggcaaccacgtagtcggggtggtcttcttccatttcaaaccctttcgctaaaattgcacgtttcaacccgatttcaccgataatgtagactttgcgatgatctttgtcagcaattccatccaaataatctgcagtagccaaagcagccgtataaacattttccggtttcactttaatatcatggttttccgtcaaattttttgctacgtcttctggagttttagtcgtattgttagttacgaacaaaaacggaatctgcttttcctgtaaccgttcgacgaaccgcttagctgccggaatcttctcttttccccggtacatcgttccgtctaaatcaatcatatatccaccataattttcaatcattacttctttttctcccttattttaaaagttttttgtcgtttctttttaccggtacccaccacttcgttacgtcgttttgcgactggcttgcgtgatttagccttcttcgaaaccggccgttttgctttatgtttagtttctgcgcggtgccattctttaatccagcgtcgctttgaacgctcattaacttgcatattacgtaatataaagtatggacacccaaaactacaaatttcaaaaaggtagtcttcgaaacgactgatttttaattcgttaggcaccttttcttcatctgcaaaaaagcccttcagccgtagttgtcccgaaccgatatccccaacaataaagtcgtaccgactcagcaatccgacaaagcgttcggccatcaattcttcatcaaacgcatcgcgataatttttttctaaacgatattcgtgatcgttgattagaacctcgtctgtattgacttgaacgacccggttaaccaccggacgtcgcatttccgccaactcttcatttgtttttttattcatcactattccccgcttattgtatagcaccatcctaaattaaaaggaacgtacaggtcaatatcttactttaattaccgtaacttttccatagcctacagcttaacgccgttttttaaagtcaattctttttccgtcaatcatttgttcaatatcactttcagaaaagggggcgccaaacggaatttggtaatctaaataatccttttcaggagtgtcgacccccacattgatattttccttaatattcacgctataatgatggatgtgcccatgcaaattaatcacttgctgaacaatccctagcataattgggtagtggctcataattaactgccggtgattcattttaataattgttcctaccgaatgaaattcaaatttcggcttaccattcactaagtaattatgtttagataaatatttaaataaactccgcgaatcatgattccccttaattaaaactagtcgcccgttaagccgttttaatagttcgtacacctcttcatgcgcctttttttctgggcgcacaaaatttaacgcaatgtcgcctaaatgataaaccacgtcctgatccgtcacccgttgattccaatttttaattattgcttcgtgcatcgcattaatattagtaaaatcacgtggcgcaaagtcatggtcttttagtagctctttatgaaaaaaatgggtatctgccgtaaaaaaattcaaattatcatcctcttcattactttcccttgattttttcattctaactaagaatcatttttaattgtaccgcggctataagaactttgtacaatttccctctacgaaaaaaactggaaacctctatcagaggtctccagcctgcggcatcgaaattatcgggggtaactgtgcttaaaaataattaagcggttcaaacaattatttcaaacttttttgcgcccattttttgaaatccttgaggaacgccaccatttccttttgctccttaaagtctgggaattcacctaacaaaacttgatcagcctgtttagcattctgacccaccttttgcagaattaaaatcgatttttgtgctttagcgtctttaaacatcttacttggcaagtttaaaatcgcctgtaaataaatcttgtcatggaaaaatgctagtagctttttggcctcttccgtttgaaaaaggttacttggaactaaataaactccaaagccgcccggccgtactgccttcattgattgctcaattaataaatggtgcacaaaggaatgtccctccgagctacgcgtctcaaaaccaaccgttcgctcatcaattgggtaatatccaaccggcaaatctgaaactacaatatcagcatttttaaccaacaaattatcgatgctgtcttgatggtagagatccacttttaaatgctcgaaaataaaggacatacttgcaatcgcaagcatagtatcgtcattatcgattcccgtcccgttgaatttaacttggtgatcttgaaaataattcaaaatggttgatagcaagttccccgtgccaactgccgggtcgaatattgatacttgatcttgggataacggcaaattctcaatgatgtagttaaaaagcattccaattgcttccggagtgaattggtgattagcttggatgcgttcgacccggtttgcttggatcatcaccaattggatggccttgcgaagctcttcaggttcatattcctgccagttaaaatctgcgtaaacttgctttaatttttgtaccgttacttgatctggtttaccgtcttcaacttggatttctcccgtaattaagttatcccccgtttcaatgaacgcgtctaaaaaatccacgtccaaatttttttgtaatagttcggttgattccttaaaaacacggtatattttttcaattttttctgtatccatttgcgatccttcctcactaatatccactttcgttaaatctaacctttacagtattacctttcttgagttttatcgtcaagttttgatcctgatttaattctaccgtacccagttttttattagtcaactttttaatttctttttctcggtaacgtaataaaaactggttggccaagattttaacttgggtggtcgcttgttcattttttaatcgcaaaattgtttgtcgtgcttggtcattcaaaaacagattaattcccgccataaacgttaatacaaacaaagcggtaatcatcgcgctagctttctttttcggctggtggaataaacgcgtacgcactatagttgcctccataaaccttcattttaatttgaactaaattaccgacccgtttgaaagaaaccgcacgcacccccggcattaacggcatatgcccgggagtataacgcagcatattttttcgcgaatagtactccagctcgtaacgcttcttttgcgcttctgaatacaagatcaagcgattaggtcgaacttctttcaaacgaaaatcgtgccgctttgattctaaatcttgaacaacctcggtaattttgtcttcaaaatcagcttcagctttatgcttagttgctttgactgccatgattgttaagttaaccatcagtaccataattaataatgctaaaattgcttcagccaacgtaaatccgtatttataatttttgcctgagttcatttaaaacttcccgttcttgattaagctcgattcggttttccctaatactaacctgccaactatgccaagtgttcatcataactgctaaaaagcttcccagaataaatagtcccacgattccttcataaagcaacgtgccagtctttttacacccgggtaatttcataaacaccccatcctaactgtgctgctaagcggtatttgttttgaccattctcctgtaaaaccaccgtcgtgggggtaacaatcccatctcgaccaatccgaatggtccggtcggtatacggctctaagttaggaggtaaatctaaatatttagagtgtcgctcccgtccgtgctgccaatgaaacatcacgctgtgatcgtctttaataaaaattaccgagccctggcaaccttcatacattgccaaccgttccatttcctgccaacccatttcgaaacgtttaaaaaatattttctcctgctgttcactatgggctccccgaaaattaaccagccccattccaattgtgctacaagtgattaacaataccacaatgctttctaaaagggtaaatcccgctttccggacgtcaactacggctaacatgaccgctactatctactttaatcccgtcccgattaacttggtccatttgtttatccgataagtatcctttttcctttaaatcatctaagctttccggtaaatgattgtattcattttcatacaagtccacttgagtttgaacaacttcggtaagtgcatcgccctggatgttgcgagcattatgtttttgactagttacgtttggtaaaataattaggattaataatgaaatgataaacaacacgaccgtcatttcgatcaacgtaaacgctttcttaattctgtttttcattacgacacttcctttattgagttatacattggcatcaataggttccagtacataattacaattactatcccaataatgccaaataaaattggttgaaccactaaaatcaaacgttcaatccgactaattaagtttttgtacttcatcattgacaacgcgtaaatttccgttgctaaggcatctttttgacttcctttttggattagcaaacttagttcggttggcagataaacagccttttgaataatttgatccacctgccggccgttcgcaatgctgtgctcaacttttcgcccaatttggtgcaacaacgattttgaatctaactggttaaggtatttacagatactgcccacagacatcccgttggcaattagaaaagataggttcgctaataaataatagtggcaataattttggtaaagcggcccaatgatgggtaaacgacaaagaaggttgacttggttagtaatgctggaacgtttgaatttccagaaataatatcctagcgctgctaccgcaaccaaaaagaccgctacccaccctgccttaatcaattggctatcccaacttttagttccccgattccagtctgctaattctggcatgatgtaaatccgcatccccaccatcatgagtcctaaaaacaatagcaaaaataacggatattggatcactgaccgtagtttttttcgttgctgttcctgactggtgaaaatttgggcaatcgtgttgagcgtcctaacaaggcccccatgctgatctgcaattgccagttgataataaatgttcgtgcttacgtaaggctgaaaggcggccgaaaaagattgcccgcgctgcagctgttcaatcacgttttgcatcggtttagcaatcgagggtcgcataatacgaataaaatctacgctttttcttagcgaaatgcccatttttaacaaatccaccatcgtggagaagataaatgcctggtctgctaaaggaattttacccgtactggtagtcctgatatacttcgttggtaatttggccactgtttttccactcctctaacttggtctgccaccttggtgacttagtttttaacaacgggtggaatgacttcatttccgctagaattcggatagaaccatttttaattggaataatccgttggtaaatggtggcagttagcgcctcctttaaataatcttcttgcactcccaactctagcaaccggtcccaaaccccttccgtgcttttacaatgcaaagtagttaatactaagtgaccactcagcgcagcttgaaccgcgatttcggctgttttactatcccgaatttcgccaataataaatatatctggccggtttcgtagtccactttttaacaatgcttggtaggtcattccggacttctcgttaacctgtaattgcaggaagttattttcttgaatttctaccggatcttcaatcgacattacgagttttgaaccacttaactttttagcaatctcgtaaattaacgtagtcttccccgaaccagttggcccagaaaaaacaatcatcccccttaaacgcgccgccgcttcaatatcttgcaggctgaccgggtctaaaatttcacgttgctgcttcaactcgtaaataaagcgaaccaccatcgaagggcggtctaaaaagtcccctaccgttgaaattcgtaaatttaccacctgaccatcggctgccaaccaggtcatggcgccgctttggggtcgacgtcgttcacttattgacatatctgcgcgatacttaatatatgacataatttgttcggcttcccgctgttcgatgtgcgtagacttgcgatatccctgcacatttcgataaagcacctggtatttatcgttacggggcataataaacaaatcactatcatgatgaacaatgctttcttgcataattcgacttaattggtttgttatatccactactcatttcgcctcctcatcatgtagatacgaaaagtcggcaaatttatttttttaaaccattttttaattagtaaatttgttatcaccgcggtgagtaaaactgctaaccttaactaccttaaaaaactaaaaaggaaccccttaagaatttttcgattcttaagaggttcctttaacttggtcaccttttctggtaataaatcgtatttgcaagcttaattagctttacttaacggacaacccactttgactttcttacaactaaatgttttttacctaccgaaatagaaatttatttcagaatatctttccgagtcggaattgaaggttgcgcccccatcttttggactgctaacgaagaggccttgttaccatactcaatggcggtttttaaattacttaaatcaggatttaattccgagcttaaagcacctaagaaagtatctcccgctgccgttgtatccaccgcctggactttaaatgccggaacgattccgtgttgcacaccatcgtcgtagaacacacccttacttcctagggtgataattacggttgccacgcctaggtcgtgtaagcgttgggctgcttttaacattgccgcttcgtcagtcacggcaattccagttaaaatttcgacttccgtttcgttcggggtgatcacatccgtattttttagtagctctgctggtaacttagccaccgctggtgcgggattcaaaatggttttaactcccaactctttagccatttggaaagcaaattgcgtcgtttctacaggagtttctagttgggcgaccattaaatctgctgcagcaatttgtgtttgggccttcttcacgtccgtggcggataattgcgcattggcaccgccataaattaaaattcggttttcgccactcttttctaccatcacaaatgcttgtccagtacctgcatcctcgtctaccgctaccaagtcggtagtaactccgctattaaccaactgttgcagcatgaacttaccgttttcgtctgcgccgacccggccaataaaactcgtttgcgcaccagagcgagcagcagcaattgcctggttagctcctttaccgccaccagccatgtcttgattatttaatgctaatgtttcgccaggttcggggacccgatccatctgtaaaattcgatccacgtttaaactacctagcacaactactttattagtcattttgccacctcattatcattacgtatgcaatgattttaccacaccggttttatgcccgcctaccaccattgaaactttcttttactaaaaaggcacaaaaaaaccaacccgcataaaatggggttggttctgaaattcattattattcagcgtcatctggtaaaacagcagcttcgtatacttctgaaacgtcgtcgttgttttccaattcgtcgattaatcccgtgtattgctttactttatcagcaggaacttgagtttccgtttccggaatcatagttaattcagcatttgccaaatcataacccttagcttcaagtgcatcacgaacggcagcaaattctttaggatccgtgtagatttcgaatacttcatcagaagtttgtacgtcatccgcacctgcttcgatagcatcttccatcatttggtcttcgtctttatccaaaccttcgcgtttaataacgatgtagcccttccggtcgaacatgtacgaaactgaaccagtagctcctagtgaaccaccatgatgagtgaaagcagaacgaacagctgcagccgtccggttcttattatcagtcaaagcagaaacgataattgcggttcctgctggtccataaccttcgtaagtaatttcttcgtagttagctccaccagtaccgctacccttgtcaatagcacgtttaatgttatcttttggcatgttagctgcacgagctttatccatcattaagcgaagttgagggttggcagaagggtccggacccccagctttaactgccacgtagatctcccgggagatccgttggaaaattttaccacgttttgcgtcttgggcgtttttacggccttgaatattatgccactttgaatgtcctgacatttccgaactccttctttcatattatatttatcgtattcatagacgcttaatataatacgcttccgaaatatgcttgtcaacggaagttcgtgctcatccaagatcgcttccgcgtccgtaatccgccaagtttctaactggaagttattccgattgattgccgaccgctaatgcacgttaacttgttgaccttaaccgtaaaacactccctaattcctacattttatggttcattggcattagatgatattcaattgggtgatctggatcaaaaatttcaatttgggccatcattccggtatcttcgtgttccaaaatgtggcagtggtacataaagattcctaatttggtaaatttaaccttaatccgaaccgtttcgttagggttaactccaatggtatctttccaaccgtgctcattgggattaaccgcgtgcccgttgcgatcaatcaattggaattggcagccatggatgtggaacgggtgaatcatcccaccttccatgtcgttagtgttggaaacttcccaaatttgggtttgatcaacttgctggcgggtgtcaattcgttgcatatcaaacaacttgccatccaaccgcacttgatcatccatcccggacatcaccgttttgaagaccggagtattttcgtcaacggacaatgctggaatttctgccaatggtgacggtaatagcatattttctttcttaatgtcgccaattttgaacttaattaggtcgaagtcgtcagtttgcaaaattacctcttgtcccggttggtaatcagagaagttaaccaatacgtcggcccgttccgcacaggtcagcataatgcgatccatttcaacggcttccggcaacagtcccccatcgctaccaatctgggtgaagggatgataatccgcaaagtgaagccgccattctcgccgattagaaccattcaagaaacgtaaccggacaattggcttagtaacgttaaccaccggattgaccgtgccgttaaccaacgcgtaatcgcccaaggtcccgtccacatcgtagtcggctttgtaatctagttgattatcgtgatagctacgatcctgcaataccactggaaaatcattaactccccagcgccgcggaagcttaaggctttgttcgtgtccatcggtaataattaccggtgctgccagcccattccaaacttggcgcgccgtctctggacatggatgcggatgcaaccaaatgttagccgccggttggtcgaccgtaaacgtaattttgcgttccccgtgcggatagactggcgcatgaggtcccccgtcttcgtagggccccacaatattcaatccatgccaatgaaaagtagtaacctcgtctaattcattttttaaagtgacgtggtaggtcttaccagtttcaaactgaattgccggacctaaaatactaccgttgtatccccaagtgtgcgttggcttgccaggcaaaatcttcgtttctccagcttgagcagttaccgtataataaatttcatttccttctattcgatcaggtttcaaaaaagccggtacgttcaatgggtgttcttctccaggcgccttttttaacgggcggtacccaccgtcatgataatcataggcgttttcatcatatagatactttgtaatcattttgatttccctcccattttaaagttatgtatcaagcatattactgactccaacagcattccgcccgccattacgtacattgcgggcatcatttggttagtagccaccaagtaaaacaaatacacgtagagcaatacaaaaaatatcgacccaattttagacttaatcatcaactaacccccatttctactttagaacaattataaagtacacccaattgccgaaaatgtaaaggtttccctaaaagtctaaaatagcactcaactttatcgcggttaactttcccactacgttaaccgcttccacccacggaaacaaaaaagctgggaaaaattcccagcttcaagcatttcctcgcaacgtcgtctaactgcgaaaagtagattaattattctattctaagactgcgcaattacgcccgttttgtgtaagtacccttttcggtattaataattaacgtttcgccctcttggacaaaatccggaacgttaactaccaaaccggtttccatagtggctggtttaccagaaccggttaccgttgcccccttaatggaaggtgaagtttccacaaccttgagttctaccgtagttggaagcgtaatcccgatcacttcgtcaccatagaagttgattttcacttccgtattttctagtaagtatttcatttcttgttcaatacttgaaattggtagttcatattgttcataagtctccgtgtccatgaaaatcgccgtatcgtcttgccgatataggtattgggcttccttagtatccacaattgcttgctcaactttttcggttggccgcatcgtagtttgcacggtagctcccgaacgtacgtcataaagcttcatttgcattaccgtgtttcccttaccaggcttgtggtggttcgtttcaagaactttaatcaacttaccatccttaataaacgtcattcctgcttttaaattaattgcttcaaccatttaatcaatctcctttaagttatttacaataaatatggaatcctccctaaaaacttagttaggagggattgaaaaaatgcttcgcatgatttttagagtaaagctcatctgcgccctccgcgatttattgtttatctccattctagcataaaaaagcgcttaaatggacggcttctctagcggggctaaaaagcatttagatataaaaaaagtgcaacgcccacttatccactaagctagcactacacttctaaatttattagatactcaattttattttaaatcagctattcaatcgtcgcccctaacgcatttttaaaatgggacaacgcccattcttgaccgtgttcggtaaacgttgcgaccgtcgttgggtcaataattaactggtaacccaagtcataggcatcaactgccgtatgcaagacacaaatatccgtacaaactcctgctaatcgcaaagtatctacgtgacgttcacgtaaacgaatgtctaaatctgtgcccgcaaaggaactataacgagttttagcaaactgccggacccgcggattatcctgattcaattcgtaccagtcctttaattggccatacaattcccgtccccaggatccttctaaattatgcgcatcaaataatttggtttcgggatggtagggatccttttcaacatgtagatccgttggtagcattacccaaccaccttcgcgaagttcccgattagcggctttaatcaaggctggttcaattgcttggcccaccttgccagtcgttaacgctccgttcgtagcaacaaaatcatttgtataatcaataatcagtaaagcttcgtttgcacccattttaattcctcgcttcctggtttcgcacctgcttattctacgttaattccacaacgttggtaaatcgcgtcaacgttcttcaagtggtagcgatagttaaaaattgatttaacttcttcatcacttaacgtcgtctttattttactatctttaagcagtaagtccataaaatgctgcccagtattccaaacttccatggcaattggttgaacagtgtcgtaagcttcttcccgagtccaacctttatcgatgagcttcaacatgacttgttgtgagaaaatcaacccgtgggtcatttccaaatcctttttaatttcgtcttcgttaatgaccaggttatttaaaatccggttcatccggtttaatacatagtccaccaaggaagtcgcgtccggtaaaattacccgttctgccgaagaatgcgaaatatcacgttcgtgccacaaattcatgttttcaaaggccgtaaccatctcgccacgcaccacccgacttaaaccagaaacattttctgagccgatcggattacgtttatgaggcattgcggaagaacccttttgacccttggcaaagccttcccgcatttcgttaacttcggtacgttgtaaatgccgaatttcagttgccatttcttcaatttgggaagcaatcagtgctagcacgcttaagtattcggcgtgtaaatcccgtggcaaaatctgggtggaaatttcttggtgccggattcccaacatttcgcaaacccactcttcaatttgaggagtgatattagcaaacgttcctactgcaccgctgattttacccacttcaatgtgttggcgagcctgcttgaagcgttcaatattgcggttgatttcggaataccagcgtaggaatttcaaaccgatcgtagttggttccgcgtgaatcccgtgggtccgccctaccgtaatcaggtctttatacttgattgccatttccttcaaagttgcttggagcttttctaaatcagctgcgatgattttgttagctgctttaatccgcaacgattgtgcagtgtcaaccacgtcggtactggtcaaaccgtaatggatccatttccgttcttcacctaaagattcggaaaccgcccttgtaaaggcaatcacgtcatggtgagtctgactttcaatttcatcaattcggtcaatatcaaaacgcgcattcttcttaattagcgctaggtcttcatccggaacttttccgaccttattccaagctttgactaccgcaatttcaacttctagccagctgtcaaactgcgcttgccggttccatattttttgcatttcaggtcgtgtataacgatcaatcatttagattacccctcgtcctaaaaaaattatttactaacctattttatcaaactctccctaattaataaacgcgaactatcaaatgcttaacccttccaataattcgggtcgactcatttaaatttaccctattttatgttattatcaggaagttgtgtattgataaaaatggaggaatgaagatgacagctacagtagtaatcggcagccagtggggcgacgaaggaaagggtaagatcattgattttttgggacaaaacgctgatgttaccgttcgttactctggtggagataacgcaggtcattccttggtcgttaacgatcaaaagcttgccttgcgactaatcccatccggaattttggcacctaattcaatttgcattattggcaacggaaccgtggttaacccacacaccctattagacgaaattaaagaattaaatcaagccggcgtaaacaccgaccacttaagaatttctgaccgggcacacatcattttcccttaccacatcttgcaagatcaacaacaagaacgggatcgctctaaaaacggcgaaaaaattggtactaccaataagggcattggtccggcatacatggataagatgcaacggatcgggatccgggccgtcgacttgcttgacgctgaaggattaaaagaaaagattgccttcaacctagctcaaaagcaacgggttttagatgacgatctttgggaacaattaccaagcgtggatgaacttacaaagcaatacgctgaatacggacaaatcctaaaagattacatcaccgataccagttacttaatcaacactaaattgcacgaacaaaaacgggttctttttgaaggcgcccaaggaaccatgcttgatattgaccatggtacctacccgttcgttacctcctcaaatccgacggctggtggtgctgctaccggctctggaattggggtaactaaaatcaagcacgtcattggcgtatgtaaggcatacgtttctcgagttggtgaaggtcctttcccaaccgaacaaattaacgaaattggtgatcgcattcgcgaagttgctcacgaatacggtaccgttacccaccgtccgcggcggattggttggtttgacggggttttgatgaagtacgttgccgacgtcaacggcttgactgacttagtcgtcaactgtctcgatgtcttgtccggcttcgacgaagtgaaaatttgtaccggttaccaaaccgatcacggagtaattaattattacccagcttctgaaaaggaactcgaaaacttaaccccaatttacgaaactttgccaggttggcaagaagatttaacccaaatgcagtcttacgatgaattacctgccaacgcgaaaaattatcttaagaagatcgaagaaattactggcgtacaagttagtgccttttcaatcggtcctgaccgtgaacaaaccgtagtagtaaatgatatgtgggattaagctttattaaccaccataaatagtaaaaataaaccatgtaaaaaggccctgtaaactgaggtgtaccccagaagttaaagtaaaaaattaacttctggggtatttttatgactaaaatttctaaagaaacaaaacttagagcactaatcgaatattttactggaacggaatctaaatcgaagatagctgctaggtacggtattacactaacgttattcaaaatgctggttagcgcttacgaaacctatggttcagatgtgttatttaatccgccacaagttaatggtgattttaaggttaagttaacgaaatggaaaatcagaaatcgtgcttcatacactgaagtagctgctgaatttggatatgttggtatattacaaattcaacaatgggaaaaaatatatcgtaaaaaatgggtcgaatgggttattgtctatagaaaaaggacgtaaaccaaatatgccaaaaaagaattctaagaataaatctaaaacctaatcaccatttactcctgaacaaaatagaattaaacaattagaaaatgagaatttagaattgcgtcggcaaatttctggcatcagccaaaaaatgctcactcaagaattacgcgaactagaacgtgaccacatcgtcaaccggaaaacttacaacgtaattcctcccaaggtagagtatccccttagcgattatggacagactttgtccactctgttagaccagttatgttcgtggggggaaatgcacgtgcagactttacagaaaaatggcgttgccgttgagttaaattgtgccgacacgctcgccgaatagcaataaatccgactaaacaaaaatcgactattatgcctacttcaggcataatagtcgatttttaattaatgctcgcaagcttgccaactctggcctcgtttttctctcctaccgtcgcttcaatcccttgcgaatcgtagtaaatcccttaccaaatactgctaaaacaactcctaccaagaatagccctagcgcgatcgtaaattctcgtaccaataaatcttgtccagcagtctgcacgatttgcttaaccactgggtactgaatcggtaaattactcaatacgttgcttacatatccaattccgcaaatgatggctacaaatccgccgactactagcaaggtagaactgatggtactgagcagtcgtttacgtagcaacgcatatgccaatgtcaaaactagccccacgccactaacccaaattacggtttggtcaatccgcgataatttttgcacctggccggcgtatcgggaaagtttctgggtatctagctgactattaaaaacggccactactttgctaactaccattgcgttaaccgtttgttggaaagcacccgtagcttgggtgctttggttgattgcgttagtgatgatattttcatcaatgtgcacttgctgcccatcgtaaaattgctgaaccatcgtttttaactcgtcgttaactagatcatctggaattaggttgctttggttaatccccgcttgctgtaactgggtatccaactgttgattaattacttcggcagcactagacttttcaatttgctgctgtacgtaatttgcattaaacacggtctgtttagccgaaaccgcgccaaagaagaataacccaaataaaatcattaacacccttgctaccacaaggcgtggcggtcgaacgggcacctccgtttgatcaactttcttttctgctaaatgactttgcctgctcatcctggtttcttgaattttaaccacttccccttctcaatcataattaaacgtgcgttttcaacgctttgcattggttaacagcttcatccacttcttagtttatcatttcgcctgttttttcttcaatgaaagcagatgtaatttatttttatttttgaaaactcctccgaaagcttgcaaaattggtattgcatatccccttttagataagatatacttttaaacagtgtgtctcattaaaatactttttaagggagttagatgatggaatatagtttttttgctaaattagctgctgaattcttgggtacagctattttagtcattttaggaaatggttcggttgccaacgtggaacttaaaggaactaagggaaacggtagtgactggcttgtaatcgccgttggttacggttgtggagtcatggttccggcattaatgtttggaaccgtgtcaggagcccaaatcaaccccgcatttacaattgggttagccgtctccggaatgtttagctggtcacaagttatcccatttataattgctcaaatgctgggtgcgattattggtcaactagttgtttactgggcttacttaccacattacgatcaaaccactgacccagaatcaattttaggaacttttggtaccattgatgcaagtgatagtttatggaacggctttgttaacgagtttgttggttcgttcatcctcttcttcggtgcaactgcctttacgcatgccccatatttcaaggaaaacatgagctcggtatttatcgccctcggtttccttgtaggaactttggttgcttcacttggtggtgcaactggtccagctttaaaccccgcacgggatttaggtccacggttagtccacgctattttaccaattaaacataagggttcttcccaatggaactacgcaccaattccagtaattgcccctattttagcgggaatctgtgctgtagcgttatacaaagggattttcttataaaagacttatacataaatagtccatataatattaaaaaggtgaagattgttattttcgtaatgaaaaacaatcttcaccttttttggtttaattaaaataaaaaatgcttttcaaggattaaaaattcttgaaaagcattttgatttgctttacttaggggtcaaagctggtttgttctgcttaacccgaacctagcgtaacgctaaatttctgttaactttcccaaactccccgactttctgcacccgctcgttttaagcttatttagttgattgtctgaacaccatgtcaaatggcaaagtaatgttccgttcttcaacttcttctttgttcattaacttagtcaatagccgcattgctaccgccccagtgtcgtacattgggtggccaattgaactaatttgtgggcgcaccatcttagttaagttagtattgttgctggtcatgatttcaaactcttcaggtacttttacgttaaggtcttgtaacccatttaaaagtcccactgctaaacggtcgttagcaacgaaagcagccgtgatatcgcttgaagcaatttgcgaagctaacttaattccgtcttcgtaagtgttagtagtttcaaatacgaggctttcatcaaagtcaatgtttgattcagctaaagcacgcttgtatccttcgatccggaactttccgtttaccggttgtgaaagtggtccagaaacaaaagcaaccttcttgtttttattttcaattaattttcgaactgattcgtaaacggccgcttcgttgtcgatgctaacggacggtaacgcatgcttgtcatcaacggaacccgcaaaaaccacgggagtccgtgctgacttcaacgcttcccgtaaccgatcgtcgattgcgttccccatgtaaataacaccgtcaacttgctttgcaagcaagttttcaagtacttccactttcttatcgacatcttcatcagaattttccaaaatgatattgtacttgtacattgaagcaatatcgtcaatcccccgtgctaatgcagcaaagaacatttcggtgatgtcaggtaagataaccccgatagtggttgattttttacttgctaatccgcgcgcaaccgcattaggatggtaatctaagcgttcgattacttcgttaaccttcttacgggtgtcgggcttaacgttagggtttccgttaaccacccgagaaacggttgccatggaaacgccggcttcacgagcaacgtcgtaaattgtaatagtttgttttgacatgataatttcctctccatattgatttgatttgttttcatactgttttcaacgccatgaatacgttatcaaattttgtaccttcttgcaagctttttttcgtctgtagcccaattttttttgtgtgatataatcgaagtaccttaagtaaagaaagaagcgatcaaatgtcacaactagaaaaagtccaaaagtgggttgctgatcaccgattggacgttgcttacatcagtaattttgaaagtatcaagtatttgacaggttttgggagtgatccgattgaacgggttctcgcgttatttgttttccctgaccaagatccattcttatttgctcccgctttggaagttgaagcaattaaagacaccggctggaagtaccccgtttatggctacctcgaccatgaacaacccttccatttaattgcaaactatattcgggaacgtaacgccaacccggtccactggggcattgaagaagacaatctcaccgtagatcggtacgaagttttacgttctgagtttccaaatgctaaatttgaagcaaatctcacccccgtttttgaaaaattacgaatggtgaaaactgcggatgaaattgaaaagctaaaggctgccggtgctgaagctgactttgctttccaagttggttttgatgccgttgctgcgggtaaaactgaagctgaagtggctgctgaactagaatacgcccttaaaaaacgcggcgtaatggaaatgagtttcgacacccttatccaggcgggtgcgcacgctgccgaacctcatggagcaactgccatgaacaagattgaaaataacgaattaattcttttcgaccttggaaccgtacatgatggttacatcagtgacgcttcgcggacggttgccttaggacaactaagcgataaacaggctgacatttacaaggtatgtcttgaagcgcaattaacggcgcaagactacgctaagccaggaattacagctgctagtttggataaagtagctcgtgacattattgataaagctggctacggcgaatactttattcaccgtttaggccatggaatgggcatgggcgagcatgaattcccttcaattatggaaggaaatgatttagtccttgaagaaggcatgtgcttctccatcgaaccaggaatttatatccccggctttgccggagttcgaattgaagactgtgttcacattaccaaggatggctgtgaaccatttacccatacttctaaagaactaaaatacctataaaatttgaatatttacccagcttagactaaaagtgggaactagaaatctgtttcataatttctagttcccacttttttactactatgctacgtaaacaattaatcttctagtttatggggcatgaaaacctcagttggcttttcataaggtgccgttgccattttgtcgaggattacgtcctcttcttcagcaatttcatcatcaccattgaacttttcgttagcacggttagctaagtccattccccgttgcttaagttcgtctaccgaagctgctgcctgttctttaaggctcgccatatcaaagtcgttagcttccatgaagccatcaacttttttcatagcggcttcctttagttctgccggagtcgtgtccgttaatttaattgctgctgctgtagccgctgctccacctacgattacacctaataagaaactactttttgacatttatttaacctcctgcttgtttttttgccgatttttgtataaattaaccgcgcctttgccaacgttcatagctgtggcaacctttcccgtttttttagtttttgcggtatggttgactttcccagcaagtcgccgggtagcttggtttaggtccgaagtactctcgctcaaatccgcaaccgcttggaaaagtgggtcaatcgttgcgaccttaccgttaacgtcttccagcaactcgtttgcattagccaaaatgccttctgcttcatgtgaaatcaaatccacatctctagtaatgattgctaaactacgatttatttctgccaaggtctttgaagcattcaccagcactaagccgataaacaataccaaaatcaacaacgcgatcgccgcgatgatggctgcaattccgcctcctgtcatgcaataatcccctcccgttagtttatgtctccagaatagcattgtggcccatgatgtgcaatgaaaacacccttaatctctggtaaaataaacttacttaaccgaaccagaaaggatttttaacatgccccaaaccttacttatcggcgctgcttttcagccgctccaaagagaattatcgcggattgattggagtcaaattggcgctaattttcttaaacattttttacaaataattctcatcagtattattttttgggtgattaaccggattggtaaacacttaattaacaaaagtttcggtccctatcaagcccctgaaaagcaatctgctcgttctcagaccattttcgtagtagtaagaaacattttcaaatattccgtaatgtttttctacgtttacacgattctttccaacctgggggtcccggttggtacactggttgctggagctggaatccttagtgtggcaattggtttaggaactcaagggctggtttctgacgtaattaacggcttgaccatcttgattgagggccaattacgggtaggcgacagcgtaaccatccaaagcattgatggaacggtggtctccatcgggttacggaccattgaactgcgagccttagacggcaccttgcattatttgccgaaccggagcattacaaccatttctaaccattcgcaagaaaaccagaatattaccattttcttgcggatcaaagatccgtttaggattgatgaagccaaggacttgctacaagatcaactacccaaagctaaacaccacaccaccaaactgaaggcgggaatcgttatccaagctccggttgccgaaaaaagtcatggttacctcggagtccaaatctccacgaaggtggcccccggctatcaagcagcgatgcaaacaatgattcttgaccggaccttgaaaattctacgggaagctcaaattgaagtggaaaactaacgctactttttcattgattatgtgaacggaaattttccttcagaaaactaagtacttcttcatcaccaaatttcaacagtaaaatatacgttgatatttattaccaaaaaaagcaatctttaaggaagccctcagagattgctttttaaattaccagaatttatcaaacttagttaataaatcttggatggctaacgcccggtgactaatttgatttttttcttcccgggtcatttgagccaacgacttttgcttttcttcaacgtaaaaaagcgggtcgtagccaaaaccgttgtccccgcgtggaacgctcagaatccgaccacggaggttcccgttagccactaattcggtgccatccggtttccgaaccaccacggtggtgtggaaggttgcggtccgcttttcgtcaggaaccccacccaattcagtaagcactttggcgttattagcagcatcgttatggtccccagcataccgtgccgagaaaattccggggcggccgttaagtgcatcgatttctaacccagaatcatctgcgaggaccggaattccaatagttttagcatagctatctgccttaagacgcgcattttcttcaaatgttaaaccattttcttgaacgtcaacatcttcatcaacgtcctttaacgacagaacttcaattcccttcgcagtaaaaatctgtttaaattcttttaatttaccttcatttttggtcgctattaaaatttgattactcattttaatctcctaatcaatttttgctaaatttacttgtatatccggagcgaggaagctttgagcaatggtccgaaagcttgcaatatttgccgtagcaaaatactgttcatcaggtgtactagtggcttctcgtagaagaccttgtcgttcaaggacgtcctttaattgctgaaccgctgctacacctggatcgactagtttaacctggtcgcctaccgctgtttgaattcccttcgctaagagtggaaaatgggtgcatcctaggaccaatgtatcaatcccttggttctttaatccgacaagttgttgatcaatcacctgcaaagcttcgggtgtcgtcaactggttatgttccgccaattccacaaatgattggcaagcagccgggaaaacctctgtttgtggtgctaaagctgctaacgctgttgaatacgcttgtgatttaatggttccctcagtcgcaattactcctatccgattgttacgtgtagttgccactgcggcttgcgctcccggttgaataactccaatcactggaattggtaacgttgtacttaaaatctgaaaagccgcgttcgtagccgtattgcacgcaattaccaacgctttaacatcctgtttgatcaagaaatccgccatttgttgcgaaaacttgattacttccgtcgtgggacgtggcccgtacggtacccgagcttcatccccaataaaaacgactgcttcgttaggcattagttccttagccgcctttaccacggttaatccgccgactccagaatccataaatccaattggacgattatccatgttctttacccccagacaaatcaattacacattgtctataatactaaattttggataaaaaaggaaaaaacgctccgtaagaaactaaaaaggtatcaaaccagcgtatgagataaaagtcggataggttgtgcggactaactaaaaaacgaccattacgcctaattttggcataatgatcgcttgggggttaagggaaaaaactgatttttagtgtacgtctattaatattatttagttaacccgtctttctaccaatcgtaatcggtaggatcttgaattccccgaccggttgctttatccaacataatccgttgttcaaagtgggccacgtttcgcttagtttctttaaccatatcggggttaactgaaacataatcgattccgctttgaattaagaagttggtgaactctgggaattcagatggtgcttgcccacaaattgaaaccgtcttaccatccttatgggcagcctcaatcaggtgatggattgcacgtttaactgctaaattccgctcgtcaaagagtcgcgcaaccgtgtcgttattccggtcacatcctaaaatcaacattgctaagtcgtttgaaccaattgagtatccatctatgaactggttaaactggtcagctaaaataatgttggatggaatttctgccatcatgtaaaccttaaagtccgcactccgtactaacccttctttttgcataatttcggtgaccttctgcgcttcgtcaaccgtccgtacaaatggaatcataacattcaggttcttcaacccaaattcattacggaccttcttgattgccgctagttcaagcttaaaggcgtcaatgtattttggatcgtagtaccgggaagctccccgccaccccaacaaatctgcaggttcgtgcggttcatatttatcgccgccctttagtttccggtattcgctagacttgaaatcggataaccggagcactactggccgaggtgccattgtccgggctactttagcaatcccctctgcgagcatgttaaccactttttcggggtggccctgctcgattaggtatagcggatgctcgtgaatgtaagtggtccagaggaattcttcacgcattaaaccaattccgtcagccggtaagctagagtacttttcaactaactcaggatcgccaaggttcatcattactcgggtagcggttggtgcaaaggtctcggccgctaccatttggttgccctcctgctgtgcggaggcagatttctttaacatgctggcgactttgccatggtaaaccaccccatttttagcatcaatcgtaaccacgtctcccgtcttaagggcgtcggtggcagccagatttttactcttagttcctacgatacacggaatctgcatttcccgagaaacaattgctgcatgacaggtcatcccaccgtcattagtaatgatcgcggtcgccttcttcatcgctggaacccagtctggggaggtcatcaccgttaccaagacttcgccttgtttaaattggtcaatgtctttaggattgtcaatgacgtgtactacgccacttgctaatcccgggctagctggaaggccccgaactgcaaccttagcatctgcttctttgaccacgtcggcatcttcttcatccgcgtggtccgccgccttccgttgggaccaaactgtttcaggccgtgcttgcacaatccataagcggtcggtattggcatccaaagcaaattccatatccatgtagcagccgtaatgctcttcaattgccttcgcataacccgccaactcaattacttggctatctgacaaaactggttgcccctgaagttcttcgggaaccttttcttccaccgttcccccatcggcaacccggactagctgaattggttgcttaataatgttcttttcaacaattttcatcgtttctttgtcaattacaaagtgatccggtgttacctttcctaaaacaacgtactcaccaagaccataaatcgcatcgatcacaattttagagtcgtctccatcagcgacgttaaccgagaacataatccccgaagctttagagaagaccatcatttgaaccgctgctgaaagggcaactttttcgtgcggaaaatgctgtttatgccggtagtaggttgcccggtcggtaaagagcgaagaataacaaagttggacccggttaacaacgtcggcagcccccttaatatttaagtaagtttcttgctggccagcaaacgacgcattaggtaaatcttcggccgttgcggaagaacgaatcgcaacgaagggggcgtcttggtcaacttttttggccaaatccgcgtacgcttgttcaatgtcctttgccaaatctgcaggcatggtggcgttaacaattaaattccggatttgctcgcatgctgaatgcaattcttcagaattttcgtaatcctgaatactttctagcaactcgttaacttgatcatttaagcccgtctgctccataaagtaccggtacgcccgcgcagtagttgcaaaaccatacggcaccggaacgtccattgccgacgtcatttcccctaatgatgatgatttaccaccaaccagatttacgtcttcacggtgcagttcgtcaaaccacaatacatttgcattttcacggctactcataaaaattacctcctcatcaacagaaacttaactttaatcaaacaattctaaataatcgatggaagcgtttacattctacgcctatattgtagttcatttctgcacaaagtaaaagagttcctggcaattttttaaatttagtatgttgaatatcagcgtttactaatgctcgtcaagggacgttaactcgcattaattcaaggatttagccgttcgaagctagtaagcaactggcgttggcatcgttaatttattaaagtgaaaaacaacacaattatttgctaaaccaccctaattattagtagatctgattaacttaataatcggggccagtcgtcttaataagcccatttaactaaaaagagagtgcgacaaaagtcggatagtttgcgaacattaaccaaaaaaaaacgattcatgaggaagtttcacctcacgaaccgtttttttgtttagagacttttatcacagccccttaatcattcacctaattataggtattgatttaaaatctttgctaactgttctttagaatgataacccacgatggtatcaactaccgcgccatccttctttaccattagcgtagggatgctcataatcccaaatttccgggcagtttccggattttggtcaacatccatctttgtaaagttaacttggtcgcccatttcgtcggctaattgttccactaccggggattgcatccgacatggaccacaccaagtcgcccaaaaatcggtcaacgttacgccagtaccagttttttcttcaaaatttgcgtccgtaattgcttcaaccatatttttaaccttctttctcaaaaagtaaccatgttgatatagtaactatagcagttttcaatcaaaaattgaattattttgcttacgaataataagaattatcgtaaatgcacgatggtagcgccattacctcccgcattagccggggcatactcaaaacttttaattcgccgattttgttttaaatactttgtaatgccgcttcgtaacgctccagttcccttaccatggataatggtgacttcgtcgtaaccagctaacagtgccgcgtcaatataacggtcagtttcggtaattgcctcttcgtagcgttttccgcggagatccaagctagttttcaccccagcagatttggtccggtgaaccacgttgtggctagctggtttagtggtccgttctggtttaaccttttctaattcgtcggtagccaccttcattttcaaaatccccatttggacttcccaatgatgagcgtccacttgccgtaatagctcaccgcgttgtccataggttaacacaatcacttcgtcgttaacgtggagcttctgtgcctctttagccttacggagcaccttgttgcgcttcaagttagtatcttggtgtaaggcgttcagcttactcttagcttcgatcaaatcgttttctttgaaatttcccgccgatttttctagtcgccgcaaccgtttaataatctggtcggccttgctacggctatcgttaacgatctggttagctgattctttggcactttctaacaaacggtccctttgttgactaagccgctccactcccttaaccaggatatcgttatactcttcagtttgtgacaacaaggtttggacccgctcgtttaacttctgggcccgtttttgccgggtagttaaatccttaatcatgttatttaaatcttgactatcttggtctaccaaccctcgtgcttgagtgatgatgtcctcgtctaagcctaaacgtcgtgaaatttcaaaagcgttactctgtccagggattcccagcaataacttataagtgggttgcaacgtgtctacgtcaaattccatgctggcgttaatcgttcctgaacgctcgtacccgtacgttttcagttctggataatgggtggtggtaatcgaagccgcgcccctttgtcgcacccggtctaaaatcgcgattgctaaggccgccccttctttaggatcggttcctgcgcctaattcgtcaaagagcgctagcgaacgttcgttaaggtgctccaaaatatgaatggtgttatccatgtgtgacgaaaaggtactcaaattctgttcgatggattgttcatcaccaatgtcagcaaaaatctcttcaaaaactcgcaccgtactattctcgttggccggaataaacattcccgattgggccattagttggagcaagcccacggtttttaaagtgatggtcttcccaccggtattcggtccggtaattactaaggtggagtactccccacccagcctgatgtcgttaggaaccaccttttttggatcgattaaggggtgccgggcctgtcgcaaattaatccggttattcgttgaaatctgtggctccgtagcctttaacttatgtgcatattgcgccttagcgttaagcaaatcaaggtgaccaagcaccttgctattatcttttaacgtgtccgcatatggagcaatcagcgcactgagttcttgcaaaattcgctgctcttcgtgtacctcagcaacctgttcttgccgaagctgattatttaaatcaaccaccgcttcgggttccacatagagggtttgccccgaggaactttggtcatgtaccaccccgccaaaacgggaccgggaatcggctcgaaccggaattacgtaccgttcgcttcgaatcgtgacaatgggttcacttaggtactttgcttgacttccccgggtaaacttttccattcgctgccgaatctcaccctccacccgcgtaattgcggcccgaatccgccgcaactcacttgatgcggagtttaataaatgtccatttccttcgattgaactatttaaccgttcttcaatttctggaatcgtttctaactgatccactacgccgttcaaggtttctaccgttacttccgtatctggtaaatccgcaaagaaattaattacttcccgggttgctcgcaacactcgcccaatttgcgcaatttcgcgaccgttgaggattgcatcaatttttaaacgttgcaatggttcgtcaatatcttctaaacgcggaatgggaattccacttttcacccggtaaatgttaaccgcgtccagagtttccttaagggcgttttgtactttggcggtatccgtcattggaactaattggcgaagctccttggccccgttttcggtcgcaatgaactgtttaaccgcaattttcactttttcatattctaaaacttctaaaattttactgttcatcataatctcatttcatttcaaatcaaaaacggcccgtttggtggtcagacattatatctgcacaccaaaccgcggccgttacttggattataaaacttagtcttggtcacctaagaaggtatttaagacttcttcaaccatatcccactcttcatcagattcaattgggattaattcaccttcgcctaaatcgtgattttcatcaggttcaaaggcgtaagcttgaatatccacttcttcatcattttctgcttcagccggataaagtaggacgtacgaacgaccatagtcctctgaatcaaacgtaaacaatacgttatatagttcttcgttgccgtgttcgtctactagggtaattttttgttcttcgttatccattgcgtgccctcactttaatttatcgattaatttaccgtgaccattgaggtagttctctaaaatcaaactagctgctaatttatcaattactttcttgcgcttggagcgcgaagtatccgcttgttcaatcaacatacgttccgcttccacagtggtcaaacgctcgtcttgaaaatcaattggtaacccaaacgtttccgttagtagtttaccataattacgcgcagcttccacccgggggccctcggtattattcatatttttaggtaagccaattacaaaaccggctacctcgtactggctgactaactccttaactcgactaatgccaaattcgccctcgtcctcgttaattggaataatttctactccctgagctgtccaacctaactggtcacttaccgcaattcccacggttcgtgatccaacgtccattcccattaaccgcattaattcttttccttcttgccaccagcaacttgatctgctaaatagtatcttactaattcttcaataatttcgtctctttgatgcttacgaattaaattccgcgcatcgtttagccgcgggatgtaagctggatcaccagaaatcaaatatcccacgatttgatcaattgggttataacccttttcttcaagagcatcgtatacggtttttaacgttccccgaacgtcatttggcttattatcgccaaaatcgaagaacatggtttcatcaagttttcccactgttagcacccctcttcacatactatgattaattttacttgattaaccgcaaaatcacaataaaaggggccgctcgtaactgaagtgtaatattcaactaccaaattaggggagttttttggcaaatgtgtcttttttgacgcatataaacggtagttgcaaatgctttttaaattagccgcacaaactaacttcaggtttacgacttaccaatccttaaagtaaccaaattaaaaagatttcccaagaactatcatttcttgagaaacccttttagttatgttgcaaattttactactagtaggatttaaaattatttaccctgggtctctagccattcgctagcagcttgcaacgcttcgttaattttttctggcgcagaaccaccggcttgggccatgtttggacggccgccaccgccaccgttaaccttcggtgcgattgctttgattaaatcgccagccttcaagccttcctttacaagcggatcctttacggcagcaattaaattagccttttcaccaatcttagcacctaagaccaatacgtcagattggtccttagttttccaatcgtccgccatttgccgcaattggtccatgccggaaacctgcacttcggcagtaattaaccgaattccgttgatttcttgtacttgatcgtagatgttggcaacttcagcttgagcaatcttagcttcgagttggttaatcgtttggttcaaatccttaacttgtgcttgtaattgttcaacttttgcaggaacatccttcatttgagcactcttcagcaatcccgctgccttttgtaagagcgcttcttcaccgtttaagaactctagtgccgcttgggaagtaacggcttcgatccgccggactccagctcccacaccagattcagagacaatcttgaataaaccaatttcattagtgttctttacgtgggtaccaccacagaattctcttgagtaatcaccaacgctaactacccgaacctttttaccatatttgtcatcaaacagggcaatggcacccattttcttaccggtttctaagtccgtttcgacggtggttacgggaatttcatcgtagattttatcgttaataatctcttcgactttttgcaaatcttcgtcagtaacctgtccaaaatgggtaaagtcaaaccgtaagtagcctggttcaactaaggaaccggcttggtgggtgtgttcccctaaaacatcccggagcgcttggtcgagcaagtgggtcgcggtatggttcttttccaccttcaaatggaaagcccggtccacaatgagggtaaatgattcaccggtgtgcatttctcgtttagccttgatggtgtgcaagttttgtccgttaggagcgtgttgcacatccacaacttcggctaccacgttgccgtcagcgtcctcgattaccccttggtcagctacttgaccacccatttccgcatagaatggggttacgtcaaatagtacgcgagcttcccccggatttaccgtatcggtcagctgatcgtcttggataatatctttaagcactgcagcgtctactttcaaggtgtcgtaaccaacgtattcacttggcgtcttcaagtccgttaataggtcggattgcacgcccattgacttagcgttagaacgtgctgaacgagcccgttccttttgtttttgcatttcgtccgcaaaaccagcttcgtcaatttccattccttggtcttccgcgtattccttcgctaattccaatgggaatccgtaggtatcgaataaccggaaagcatccttaccagagattaccttagaatggtccgctttggtgtcagcaatgattgaatttaataattccaaaccatccgttaaggtttcgttaaagcggtcttcctctgacttgattactttttcaatgtaatccttgtccgcaagtacctcaggatagtagtcttccataattttgccgactactggcaccatttgatacaagaatggcttattaatgttcaacttcttaccatgcataactgcccgccggagtaagcgccgaattacgtatccgcgaccttcgttagacggaatggcaccgtccccaattgcaaacgtaattgcccgcgcatggtcagcaatcaccttgaaggaaacgtcgtcatttttatcaacgccgtatttcttaccactgagcttttctacttcgtgaataattggtaagaagaggtccgtttcaaagttagttggtgcatcttggaatacggaaaccacccgttctaagcccatccccgtatcaatgtttttatgtgggagtggttcgtaggttccgtccggcttatggttaaattgagaaaagacgatgttccagatttccagccagcgttcgttttctccgccagggtagttttctgggtcgtcatcggcaaggttattgaactcctcaccgcgatcgtagaagatttcagaatcaggaccactaggaccttccccaatatcccagaagttatcttccgcttccacaatatggcttggatctacgccagtctttaaccagatcttctttgcttcctcatccttcgggtaaaccgtcacgtaaagcttttccggatccatgtcaaaccattctttagaagttaaaagttcccacgcccagtggatggcctcttctttaaagtagtcgccaaccgaaaagtttcctaacatttcaaaaagcgtgtggtgtcgcgcagtgtggccaacgttttcaatatcgttagtccggatactcttttgtgaactagttagccggggaacttcgggaactacgctaccatcaaagtattttttcattgtggcaactccggagttaacccataacaaagtggggtcgtcctttggaattagcgacgcactgggttccaccacgtggcccttgcttttgaagaaatctagatacatgcgtcgaatttcgctacttgattttctttccattttttcctcctaaaataaaaaacaccgttgctcgtaaaataaagacgccgaaacgcggtaccactttacttgcaacgatgtttagatcgtatacctcttgagtctcattaacgctgagcagacgattcattattaatcgggtagcacaaccgcggcgcttcgttctttacaccagccagaacgtctctgcactaagcgttgcacggttacatatccctaatgattctaaatatcacagctaattatagaaaaccaaattaagattgtcaatttatcttcgcttcgaacgcgattgccgcattttagctttcttagcctcacgaactgcttgatgctgttccatccgccggtcgcgaattgccttttcagagatcgcctttttaatgcgccgtttataacctggtttaactttcttctttttctttttaactaacccgaccaaggtagggtccagttttttctgacttaaccgccgagtctgccgccgttgccgatcgtaagtatccactagttcgtggttacgtaattgttggggaataaacttaacccccattttttcaacttctgccacttcggcttcttcgttaggcatgtataacgtaatggccgtccctggtaaaccatttcggccagtccgacctacccggtgaatgaagaattctaaatcagttgggatatcgtcgttaattactagcgagaccccttcgatatcaattccccgcgccgctaaatcggtcgccaccacgtattggtaacgtaagcggtggatgtctttcatgattcgtttccgttcccgaggcggaattccaccgtgaattttagccaccggtagtccttgcgacttaaggtagttagttaattcgtccgcccgttcctttgtattagtaaatactaaggctaagtacggttcccccatcgtcaacaactggtaaatcaagttgtttttatcctgactcttggtagaaatcaaaatatttttaatcgtgggactaatcgtagtcgccaccggaatttcttcaattgccgggtgcttcatgtatttttgtaaaaagacgtttaattgctgtggaatcgtagcagaaaagaccaacatctgtagattttcgggcatacttgccgcaatttggtcaacggcgcttaaaaagcccatgtccaaagtcatatccgcttcgtcaattaccagatattggacttgccggaagttaagtgcccgagcttgaagtaaatcaagcacccggcccggagttccgatgacaattgctggttggtggtgttctaatttagcagtctgccgttttttgtcagttccgccaacgtaattgccaatttcaattggagtttctgaagcagcggccaattgcttagccgcttcgtagatttggtaagctaactcccgactaggcgtggtgattaccgcttgaatcgcgtttttggccggatcgatttgattaaaaatcggtagcaaaaacgcgtgggttttcccgcttccggtttgggattggcccactacgctttggccctccgcaattagcgggatgacacgctcttggaccggagtcggtttcacaaaaccaatttgatccaaagcctgcatgagaaatggttttagattaaacttttgaaattcgttcatactagctccttactatattattgcagaaagcggtaagcgttcgggcatccttacagaaggtgcgcttaagtcaggtaattttgagcgttaacgtaaaatcggccatcatgcctgaatctggcataacagccgattttgaattaagccaaactaatttgtggcatacgttctggtcttactaaagttcacaaacccaaaatgtatttttggcgttcaccgaagatatccgagttttctaccgctttacaaacttttaaactaattcttctaattctttaacgatttgagcaacctcatcacgatccgccgcctttgcgccactggcgagcgggtggccgcctccgtggtgccgcttagctaattcgttgatgaccggacccttcgaacgtaaccgcacccggaaggagtggtcatcttgttcaacaaagattgcccagcatttaacttgcgcaatgtgtccaggtaacggcacaattcccgccgttccggcgtctttcaagtcgaatttttccaagatttccttggttagtactaagtgggccgccccttgttcactaatcgtgagatggtcataaaggtaggctgacaaatgggcaaccgaaaccggaatttcgtccaggatttggttaactttgaccatgtcaaaaccggtcgtcattaagccagccaccacttcatgagtgtgggcgctcgttgctgaatacataaagcgtcccgtatcacccacaattccggcatatagatcactagcagcatcttggggcaatactagctctgacttaaactgattgtaaaaatcatagactagctccgagctactggaagcagcttccttcacccacattaagtccccaaaaggttcgtcattaggatggtggtcaattttgattaaataggctccttgatcgaaccgccgatcatcgattcggggagcattcgccgtatcgatgacaattaccaaagcgtcgtcgaaaaaatcgttgtcaacgtcgtccatttgccctagccaacttaacccatcaatctgttttcccacgaccttgatttgtttgtggggaaaggatgcttgcaaaatctctgctagcccaacctgtgacccgattgcatccggatccggacgttggtgtcgatgaatcacaatccggttgtactttttaatttgtgctaaaattttttcctgtgtatccatttttaacctcattcactatatctcaactaagccgtccccggctcagtctgtttactcgcgtgtttaagcataccataaaatcagtcctcatgcttaaacagcggtaaagaaacttcttggaaactctgatcagaaaggttggtaatggtgattcccagcaaacgaatcccacgcgaaaaatcagcaatctcgtcaaaaatctgcttagcataaaagtagtaagtctcactatcggttggtaaaaattccggacgagtgattcgcttagtaagagtctcaaaatcactataccgtaactttaagactaacgttttaccatgcttttgtcgcttggtaaccgcttgagctagtttcttggcaattaagcgaagccgttggtcgacttcgttttccgtcaccaacggtttgccgtaggtctcttctttaccgattgattttcgttcgcgctggtaagcaaccggacggtcgtcttgcccccgcactcgtcgatagagtgtatacccaaatttaccaaaatggtgaatcaggtcgttttcgcttagttttaataaatccgcgcctttaaacacacccaattcgtgcattttagggatcgtcttcttgccgactccccgaaactgttcaataggcatttcttttaaaaacgctccgacgtcatctttttcaataattgccaccccgactggtttagcatattcagacgccatttttgccaaaaatttattataagaaattccggtagaacaggtcagctgagtatggttaaaaattcgcttttgaatttcatgggcaatcagtaccgcatcttgcatccccttcttatcatcggttacgtcaaggtaagcttcatcgagggcgaccgtttcaattttatcggtaaattcgtggaaaatatggtgaatttggtccgacaccgcccgatatttttcaaaatcaggagttttaaaaaccgcctggggacatagttctaacgctttagcagctggcattgcagaatgaactcctgactgacgggcaacgtaattagccgttgccaccaccccgtgaccgccagtctttcgaggatcgcgggccaccactagcggtttagtacgaaattctggatgatcacgcatttcaattgaagcgtagaaagcgtccatgtcaacatgaataatttttcgagaatcatcaattattagcggcgttgacacctggtttgccaaaacggtcacctcccaccttggctatttttgggggttaaaaatccattgccggccgtcccgaactaataagtcatccgcagcctgggggcccatgctgccacttgcgtaattagggaaatcaggagtttcagcatcccaaacctgacgaataacgtccacgatttgccaagctttacggacttcgtgccagtgggcaaagttagttttattacccattaaggcgtcccgaattaaactttcgtatgcgtccggggttttagccttttctgaagctgacttccggtagcgtaagtgcactggtgaaagttggtaaccttgattacccttcttagtattgaattgcagcgtaaatccttggtcaggttcaatatgcaaggtcaacacgttggtttctagtttttggttagggtcgctattgaaaatattctggtcgtcatttttaaagaccacgttaatttgcgttgacttctttgccaaccgcttccccgtccgtacgtaaattggcaccccatctaaagaaggattgtgggtaattaattttccagctacaaaggtttcaatgctagaatcatccgccgttccttcttcttcacggtaggctaattgggtatgcgcaacatcttcaccatattgaccacgaacaaagttctgcgcagcttcttccttactgtacgtttggatattttctaacgcttcaattttcttgtcttgcaaatgtttggaatcaaatacttccggccgttccatcgttaataacgacacgatttgcatgatatggttttgcaacatatcccgcattgctccagccgtttcgtaataaccagcccgttcttcaacccccagtgattctgctaaggtgatttgaatgttgtcaatatgctccttattccataacgagttaaataaggcatttccaaagcgaagtcccgcaattgattggatcggttccttacctaggtagtggtcaatccgaaaaatttgttcttcgtcaaacgacccagaaattgaatcattgagttcctttgcactttgataatctcgcccaaacggcttttcaataattaaccggttaaaacctgatccttcagtcaaaagtttttggtcctttagatggcccgcaattgtgccaaagaaacggggtgccatcgctaaataaaaaatccggtttccgttcaattgatacttttcgtctaattgatcagcgagatcacgcaaagctacgtaatgttctgcatcatcaacgttgtgagattgataataaaaatggctagcaaatttacgaggtagttcactattcgtccgccccgcgtctcgacccgaatcctcaatcgcactcatgactacttcatgataatgatcatttgaccacggccggcgggcagttccgattacggcaaagttttcttttaaataccctttttcgtatagattaaaaagtgccgggtatagcttgcggtaagctaagtcccctgtaccaccaaaaataataaataatgccttttgctccatttttgactcctcactttcagtcttcaatgttttatattatgaatcagtttacctcaccgaacaagtaaaaacattccgctgcatgcaaaacattgtccgcttgcccaactattaattaactaaggacttcttggccccgacgtcttgctaataaagcgctcgtgaatattattagactataaaaagctaggattccacccacttaacgagcgctcctagcttttaaaaaactacttttcttccgtagttgaatcagatttttcatcatcagttgtatctgcattagttggctcagttgttgatgctggggcaacgttttgcttcttttcaactcgcatgattgccattcggtcaaataccaaataaatcccgtcacaatctaacgtaaccgtcttagcttcgttgtcgatcgaatcaaccacgccgtgcaaacgaccaattgtaactacttcatcaccaacgtttaattggttcatcatttcttggcgcttttgttgttgcttacgttgtggacgaatcatcatgaaatacattaaaccgaagatcaagatgaagaaaacaatcgtactcatcccaaaaccaccatttgcggctgctaataacattttttcacctcgctaattcatttatattaactgtaccaaaaatatacctactaaaccagtggtgttagaaattcttactattttctttgccgtaaccgtactcgtcaaagaagttttgccggaactctagtaaattatcatccataattgcttgccgaacgtccttcattaaatgtactaagaagtaaacgttatgaatgctggttagccggagcccaaaagtttcgtccgtctttaagaggtgacgcacgtacgcgcgggtgaagttccggcaagtgtagcagtgacactgctcatcaattggggtaaagtctcgcgcatacttcgcatttttaactaccagtcgtccgtgactggtcatgcaggttccgttccgggcaattcgagttggtaatacgcaatcaaacatatccactccccgaattactccatcaatcaatgcgtcgggcgatcccactcccattaagtaacgcggtttattttcgggaattaatggagtggtaaattcaagcacccggttcatttctgctttggattctccaaccgaaagccccccaattgagtatccagggaaatccatgctaactaaatcatgggcgctttgccgacgtaaatcttcaaagccagctccctgaataattccaaacaatccttgggtatcaggattacgatgagcctttaatccccgttcagcccaacgacttgtgcgagctaccgaatgtttgacatagtcgtaactttcaaaaaatggcgggcattcatccagactcatcataatgtcagggcctaaatcattttcaatttgaatggccttttcgggtgacaagaacatcttcgcaccgttaatttcgtttcgaaaatgaaccccctcttcggtgatgtcgcgcagcttcgctagtgaaaatacctggaagccgcccgaatctgtcaaaatccccttgtgccagttcataaattgatgcaggccccccgcctctttgacgatgtcttcaccagggcggacccagaggtggtaagtgtttgacaagataatatccgcacccaagtcttctagttcctcaggtgacattgctttaacggttgcttgcgttcctaccggcataaagattggtgtaggaaaagtgccgtgtggggtaataatctctcccagtcgggcaccggtatgcttatcctttttaattagtcggtatttgattgcaggttccacagtattctccattcgttatttatttaataaacatcgcgtcgccaaaactaaagaagcgatacttttcttcaacagcatgcttatacgcatttagaatcgtttcacgaccagtaaatgcggcaactaacattactaaagttgactttgggagatggaaattagtgatgaaggcgtcgaccactttccattcgtaacctggtttaatgaaaatatcggtccaaccgctatctggcttaatttcaccattaaatttagtaccgatcgtttccagagtccgaattgatgtcgttccagtagcaataattcgaccaccgttcttccggacttcgtttaaagtagcggctgattcctcagataaccggtaaaattcgctatgcatcttatgatcttcaatattttcttcatcaaccggccggaaagttcctaacccaacgtgcaaggttagataaaccagcttgacgcccttatcttgaactttttgaagtagttccttagtccagtgcagtcctgcggtaggtgctgcagctgaacccggttcctttgagtaaaccgtttggtaacgctctgggtcatctaacttttctttaatgtatggtggtaatggcatttctccaagtttttctaaaatctccataaaaatgccatcgtattcaaattcaatttcacgtccgccatggtcaagttcctttttaacggtcgccgttaaactgccatctccgaacgtaatcttggtacctactttggcacgtcgcgctggttttaccaacgtttcccaacggtcgccttcaatgttgtgcagcagtaaaacttcgaggtggccgccagtttcttccttgaccccataaatccgtgctggcatgacccgggaatcgttcattacgatcgcgtctcctggattaagctggtcaacaatgtcgtaaaaatgtttatccgccatttcgccagttttatggtctaataccagcatccgggaagcgtcccgctttttaatcggagtttgggcaattaattcgtgtggtaaatcatagttaaagtcttcggttgttaatgtcattttttccattcctcatttattcatatataaattttctaatcctaaatgagcgtatgcgcgctcagtaaccatccggccgcgaggggtccgctttagaaagccaatttgcaataaatatggctcatacatttccgaaattgtatccggctcttcaccaatgttagcggcaatggtggttaatcccaccggccccccaccgtatagttcaatcatcgtggtgagaacctttttatcggtttgatccaacccccgatcgtccacctgaagcaacttcaaggaggtttggactaacgtgcggtcgatatgggcatcattctccacttccgcaaaatcacggacccgttttaagagacggtttgaaattcggggagttccccgtgagcgacgggcaatttcgtgagctccctgatcgtcaatgtttgttttaaaaatttccgccgatcgtttgacaatgttcgctaaatcatcttcggtatagtagttcatgtgctctacaatcccgaagcgatcccgcagcggcgccgaaagcaatccggctcgggtagttgccccaatcaacgtaaacggtggcagaggaaagtggatcggatgtgccgtaggtccttgtccgaccacgatgtcaacaaagaaatcttccattgccgaataaagcatctcttcgactactttaggaagccggtgaatttcgtcaataaataaaatatcacccggttgcaattcgttcaagagggccactaaatcacccggcttttcaattgcgggaccactggttgttcgaatctggactgccatttcatttgcgattaccattgctaaagtggtcttccctaatcccggtggtccatacaacagtacgtggtccaacgcttcttcacgtttcttcgccgcttcaatgtatacggacagttcatgcttaatttgggcttgaccaatgtactgtcttaggttctgggggcgtaatgattgctcgttagcctcttcttgggctccctgaacggccgaagacgtaattcgttcatcatccattaatcacacgctatcctttcattaacaattttaatcctgcactgatgtattggtccgtagtttggttgctaagctcatccaacttaggcgtaatcttttttagctcgcgttctgaataccctaaagctgctaaggcttcgatcgcctcatctaacgtattgttagtagtagtcggcatttcaaataacgggccactaggttccttgctcgtaattttgcccttcagatccaaaataatttgcttagccgctttgggaccaattttaggaaattttttcaagtagttaacgtcatcgttgttaaccgcccgaataaaaccctggtgatcatcgttagccaaaattgccagcgcactcttaggtccaattcccttaaccttaagcaggttcaaaaagagctctttgtccgcgtattttttaaatccgtacaacgtgttttcagtttctgaaaccgcctgatgcacgtaaaccttttgcttttcatctgctttaaagctataggggttagctacgttaaccaagtagccgaccccgttcacgtcaattacgatgtaggcgggattgatatccacgacgacaccatttaaatattcatacatcttttaatccccatttcaaaacgtttgttcgtattaataattgtatcataagtcttcgtcaattaagtttgtattatggggatcttggatccgcttgaacatcttttccatatccgtagtggagaaatgtacgagcaccggccggccgtgaggacaattaaacggattttccaccttcgccaaatccttcaacaactgtttagcttgtaaatcgtctaaatgatggttagccttaatcgcccgtttacaactcatcataattgcggttgcttcccgaaacttagctaccgtcatgtttcggtcgttcaaaacgtaatccaccatttctttaacggtatcttcctcctgtcccttcttaaaccacgtcgggtggtgacggacaataaacgtatttcggccgaactcttcaaggtataacccacacgcttctaagaccgattgcttttccttgatgcgtaacgtgtcggttgtcgaataatctagataaattggcactaataaatcttgctggtcatcgctaacttgcccaatttgaacccgataatattcgtaattgattcgttcttgggcggcgtgctgatcaataatgtataaaccgtcgtccgcttccgcaaacaagtaggttccatgcatctgcccaatgtacgttaaagcaggaaaacgacttgtgctaggagttttctcttcaccttccgtgttctcatttttagtaacgggcgtagttgaatcggcatatttttctttaaattctgcaatccgatccgactgcaagtcttgccgcgtgctaatgataattggcttagtagccgcaacggaggggtgcaatgctgctgcggaatcatccccttccacagcagctgattcagtaggcgtgtccttacccttaccaaacgaacccgaaagtacagtttcagttaagtctagttgctcaccagctggcttagaaattcgttttttcttcaggttatctacagcatccggaatcaaattttggtccgctaaccggtcaaaaattgttttactaattaactccgttaaggcattttcttcactaatccgaacctccagcttggaggggtgcacgttcacatccaccaatagcgggtcagtttgaatattgattaccgccaccggatagcgtcccaccattagctttgagccgtaaccttcaataattgctttactgatatggaaatttttaatgtaccgtccgttaactaaaatagtaatgtagctgcggttagctcgggtaaattccggcaaactaacgtatccgtcaatgcgaaaatcgacgctttctccgtggatatctaacattttttgggcgttatgggtgccgtaaatattggctaatacttgttggacgttgccctgcccggacgttcgcatcaattgccgttcgtcgttttgtaaggaaaacgcaatctcgggatagctcaaagcaatccggttaataatatcggtaatctttgatagttccgttgccaaggactttaggtactttaaccgggcgggcgtgttgaaaaataagtcactgaccgtaatatcggttccctgtcgactttgggcctcccgatgctcgattagttctccgccccggtaatgcacgaattgaccgggcccttcggctgtggaagacgtcattttaacatccgcaattgatgcgatactgggtaacgcttcgcctcgaaaaccgagggtccccacccgaaacaggtcggcacgcgaagttattttactagttgcatgccgtttaaaggccgtctctacttgactaccctcaatcccgcttccgttgtcaatcacccggatcatttttaatcctgattcagctaagagaatatcgatgcggctgcttcccgcatcgattgcattttctactagttccttaaccaccgaagccggtcgttcaactacttctcctgcagcaatctggtcggctaaaatatcgcttaactcttggatttttgccatttatccgcacctcattttcgtagcttcttttgccacttatacaattgattcataacttccatcggggtcatatccattaaatttaggttagttagctgttctactacttgcgtttgtaactggttcgttttcttttgcgctggagtggtgtcaaagagcgccatttgttcttctacaacctcccgcgaagagcttgttactgaactttcctccgcgccggattggtcagctggttgcgtctccgcagcctgagaagcggtggaaactggttgtggtgtttcacttgcggttagctttgcagcatcaccttggttttcgttttctaactgttctagaattacggatgcccttgccaataatgaatccggcattcccgctaacttagcaacgtgaattccgtatgacttgtctgcggggccgtcttccatcttatgcaagaaaactaaattgccatcctgttctaccgcaccgacgtgcacgtttttcaaccgtgtcagcgtctggtcaagtgccgtcaactcgtggtaatgggtcgaaaacagggtcttagcatgcacattttgatgaataaattcaataattgattgtgctaacgccattccatcataggttgcggtcccccgaccaatttcatcaaagagaatcaagctgtttgcagttccgtcctttaacgcccggttagcttcctgcatttcaaccatgaaggtactctggccagaaattaaatcatcagcagctccgatgcgggtgaaaatttggtcaaaaattggtaacgtagctttctcagctggaacaaaacaccccatctgcgccataatgacggttaacgcaagctggcgcatgtaagtactcttaccagacatatttggcccggtaattagtaaaatttccgtatcctgactcattaaaatatcgttagggacgtaactttgatgccccattaccttttcaaccaccggatgacggccggctttgatttcaatttcatgggattccgtcatggttggtttaacgaattggtattcttcgctaactaccgcaaaactttgtaaaacgtctaactctgcaacctgcttagcaaggttttgaagacgttcaatttgctctttaatcgtttctcgaatctttttgaacaactcgtactctaaatccgtcgacttttgttcggcttctaggatgattcgttccttttccttgagctcgggagtaatgaaccgttcggcattcgttaaggtttgcttacgctcgtaacgtccttccggtacgctagctaaattagcccgcgtgacttcaatgtagtagccaaacactttgttgtaaccaattttaaggtttttaattccggttgcttggcgttcttgggcttgtaagtcagcaatccattttttaccgttccgcatggcgtcccgatactcgtctaacttgggattatagccatctttaataacgttaccttccgtaacggaaatcggggcatcttcgtcaatggccgcttcaatcaagtccgcaatttcgctaaccggatctaaccgcgtaagggcctcgtcgaaaacggggtcgtccaattccgctagtacgtgccgaattttaggaatttgcaatagcgaggtttttaattgaattaagtcccgaccattcacgtttccaaaggcaacccggccagctagtcgctccagatcgtaaactttagttaactcttcttgcaaattacttcgttcaaaaaagtgttctaataaaacctgcacgcgactttgccgagcattgatagcgtccttacgaattaacggacggtccagccactgttttaatagccgacctcccattgccgttttcgtttcatctaacaaccataatagcgttccttgttttttccccgttcgaattaagcgagttaactcgaggttatactttgacgcatggtccattcgtaagtaaaacgatggttcgtacgcaattgctttttgcatatgcgccagattgcgcttttgggtaacttgaacgtacattaatagttgtttaaccacttgcacggcaattggggacgtcaaatcttgaattaaataacttaattctgccgagatttcgacgtcattttgttgcgaaactaaaatgtttaattctttaaaacgttccccaaagtgctccacaaaatactggtccgcaacaatttcacgggtccgtaatcctacagcctcgttgaccacgctctcaatatcgtccaaaattgcgaccttcaattcaccggttgacaggtccgtgtacgcaaacccgtactttttagttgcagcgtcaaaactcactgccgttaaatagttattttccttagcgtcttccgccttttgatccgtagtggtacctggggtaacgagttggattacttcccgtttcaccattcctttggcggccttagggtcttccatctgctcacaaattgccactttatacccttggtcaactaaaatgtcgatgtaattttgggcggcatgatgcggcactccgcacattggaatggggtcgtccgcatttttcgaccttgccgtaagcgtcaattctagcagctgtgaacccttaatggcgtcgtcgtaaaacaactcgtaaaaatccccgatccggtaaaataaaaaagcatccggatactggtttttaatttccatatattgacgcatcattggcgtatcacttgtcttttgtggcattttgcattccttccgactcttaatttttcagttaattacaaatacgtaaaaaattagtttaacaatggctattctatcatatgcaccatataaaaaaagagcgggtccacagtggcccaactccttactttgcaaaatcaacggcgcgaacttctcgaacaattgttactttaattttgcctgcatattctaattgtttctcaattgctttacgaatttgatgcgttaacataaccgcttttaagtcgttaatcttggttggcttaacgattacccgcacctcgcgtccggcttgaattgcataactctttttcactccatcaaattggttagcaatttgctctaacttttctaaccgatggatatagctctgtaatgtatcgctacgtgctcccggacgagctgctgaaattgaatccgcagccgccactaacacggaaataacatgatttgcttcgttattgtttcggtgagacgcaatcgcgtcaacgacgaccgcgctttctttgtacttcttcgccaattccacacctaattcaacgtgcgaagtgtcggtctcatgttggaccgctttcccaatatcgtgtaataatcctgcgcgttttgctacagtaacatcttcacccaactcagcagctaacactcctgccaaattagcaacctcaatagaatggtttaatacattttgaccataactcgtccgatatcttaattgcccaattaacttaatcaattcaggattcattgaatgaataccaagctcaaatactgcttgctcaccggtcttgcgaatggtgtcatccaattctttcttagccttttccaccatctcttcaatccgagcaggatggatccggccatcttgaatcagtttttccaaagcaatgtgtgcaatttcacgacgaatcgggtcaaaactactcaaaacgaccgcttccggagtatcatcaataattaagtcaactcccgtgacgttttcaaagttacggatattccggccttcacgcccgataattcgtcccttcatatcgtcatttggtagcgaaaccaccgtaatggtggtctcggatgccatatctgcagcacttctttgaatcgcttgcgcaattacctttcgagctgtttcatcagcttggttttgagcatcttctaaactttctttgataatcaaagcccgttctttttcaagtttggctttcacttccgaaataattaaacttttggcatcttcttgagttaaatttgaaactcgctcaagctcttgttgtcgttcctcaacgagtgatgatgctttttgttgttgttcatcaattagcttttgatctgcagctagtttctgctctttacgttctaggctgttttcgcgcttttcaaaggaactatccttacgatcaaggacgtcttctctttgaagaagtcggtcttcttgcttttgcaattccgcccgacgttccttaagctctttttcaacctgcgcacgataacgatgactttcatcttttgcttccaaaagcttttcccgacgttcggtttccgcttgttgtcgcgcattttcaataattagatcagctgaattactagcatctgcagtttgcttttcaatgaaccgcttgtgcataatgtatcctgcacaatagccaacaactatagcgatgattgcgaggataatataataaattaccatctttgcctccaaatcatcaagaccatagttataatctttgaatgatgttatttgattctcacacttataatcattttaatatttagccataagcgtgtcaataagtctttagcgcccaacgctgattagtgctagctttgcgaaagctacgtactcctttaagggtttggtaaattattagtttaaacaggtctttttcaattactgataacgtagaaaaagaagctggaactatcccaacttcttttctccccataaatatttacctttatttcaagtctaattcagcttggtcgtcttgtttgctatcttccttaacttcactagctggatcagctaccatcccgtacgcttctcgaaccttagccaatacctcggcacggacatctgggtgatcttccatgtacttcttagcattttcacgaccctgtccaattcgttcttcaccatatgagtaccaggaaccgctcttgccaacgatgtctttttctacggccatatcaatcatttcgcccgtttgcgaaattccttcaccatacataatatcgacttctgcccgcttaaacggaggtgcgaccttatttttaactactttaatcttaacccggttaccaattacgtcagaaccgtctttgatttgctcagcacgccgaacttccaaacgaatggttgcgtagaacttcaaagcccggccacccggagtggtttcgggatttccaaacataattccaaccttttcacgaatttggttaatgaaaagggcgattgttttagttttattaattgaacccgaaagtttccgtagcgcttgagacatcatccgtgcttgtaaaccaacgtgagcatcgcccatttcaccgtcgatttcagcacgcggtactaaggccgcaaccgaatcaataactactaagtcaatggctccacttgaaactaaagcgtctgcgattgccaaaccttcttccccagtatctggttgggaaagtaagaggtcgtcaatgttaactcccagattagttgcataagctggatccattgcattttccgcgtcaatgtacgcagccgttccgcctcgcttttgaacttcggctaccgcgtgaagcgcaaccgtagttttccctgaactttcaggaccgtagatctcaacaatccgtcctttaggataaccgcctacacctaacgcatcgtctagcgctagcgaaccgcttggaatggtggaaatttgggtatcaaccgcatcccccatccgcatgatggaaccttttccaaagtttttttcaatttttttaagagctttattcaaagcttcttttctttcatctgccacttaattaataacctcctaatgggtcttatattgcacgtttccagttaaggctgacgcttctcgttgattaaaatttaaaattatcccgaagtcgcccttaaccatctatactaaatataatacctagtaatctccaaaaaagcaatcaaaaagcgaacaaaagttcgatattatttaaccacttgttcccaaatcattcgaaaaccattcattactgctaaatggcggattttttcccggttaccgctaaaatggaatcccttagccacggtacttccatctggcaacgccaacccaatccatacgtcaccaggcgcgtgtccttctaatccttcaggtcccgctactccagtaaagctaatcgctaggtccgtacctaattgcttttgtgccccgcgggccatctcttcagcaaccggacgacttaccaccgtgtattgagcgatagtttccggacgaacccccaataaactagtttttacttcatcagaatacgttacaaagcctcccgaaaatactgcggaagtacccgctgtttctactaattgattttggaaagcaccaccagtcaaactttctgctgccgttaacgttagttttcgtttgattaattcttgtactacaaaatctgaaaaagcgacctgttcgccttcagcatagtaataatcgcctgctcgagcaaggacttctgccttggttttttctaacatttgttctgcttcatctttagaatccgccttcgccgttagtcggatggttacgtcagtcggtttgaagtataacgcgattgtaggattactctgtcgtctgatcacgtcatccacccgggtcgccaagtcggcttccccaacccctacgaagtgtaacgttttggattgaattgttttatccaacgagtaccgctcttttaacaaaggaagcacttcttgattaaccattggcttaaattcactaggcggtcctggtaaaaccaagtaatcggtcgtcggagtagtggcaaacaagccaatcgctaacccgttgggattttgcaccggacgacttccttttaataacaacgcttgccgttcattattgggagtgatgggacgcccctgcttagtaaagtgctcgtgcaccttttctagcgcccggtcgtcaaccactaattcttcacctaaaaacgcggccaacgttggtttagtaatatcatcttccgtcggtcctaatcccccaatggtgatcactaagtcgctgcgcttgctggcaatttccagcgtttccttcatggtagttgaattatcgcccaccgttgcttggtggtaaacgtcaattcctagctgggctaattgctgactcaaataaacggcgttagtatcggtgatttcacctaacaaaatctcggtaccaactgaaataatttccgccttcatctactaacttcctcctcattatataactacgctaatcttactgctttattttaactttttcagcaaaaaaaggctgtttccaaaccttccgaagctaaactgattcgcttccgttagtttttccactagcctttgttttaaaaagaatccgcaaaaatggagcggttttggtaaaaataatcaattccagaataaatggtaaagaataagcatacgtaaagtaaaacggttcctggtccaaagtgcaaatagtttgcaaataagttgttcaatagcaagaaaataattgcaaacatttgggaaaaggttttaattttaccaggcatcgccgcagctaaaacttccccttcgttttctacaataatcaatcgcaacccactaactgctagttctcggcacacaatgatggctaccacccacgccggagccattttcatggacaccaagatgatgaacgccgacattactaacattttatccgcaatcggatcagcaaatttgccgaaattagttaccaaatgttggcgccgagcaatttgaccgtcaagaaaatcagtgatggaagctaccgcaaaaaccacggctccccaaattttagtgatggcaatcggggtgcccaaccaccatacgctccctccgacttctggcataacggtcaagatgataaaaatcggaattaaaataatccgaaaaacggttagtttatttggtaagttcatgttttctcctttctaattaacgacaatggtcacgctccgtaccgtgactcccgtagcaggatcaggcattttacgtcccccgatactaccctttaatccaattgtatttccaattttcaaaacgtatgtatagccctttttcaacttaaagtgctgggtttggtgagcttccataactccttgagcaacggtagccgcttggggagccgtcgctgttaacgaattccaagattggttatcgccagtcttgagtttaagcgtggcgtgtttttgttcgtccggcaaggtcacccgcaaattatctacactgtcattaaccttttcgattttcggttctgtcgtggtttgcttagattgctttttagcactaggatgcgtagacttggttttacttgcattagttttatgatggctttttttagttttatcaatcaccgtcggatttttttgtgcgactaattgtgacggataacggttagccatctcactaaaggctgcccaaactaataaccatatcaccccaactaaaataattcccatcaaccacgggtgctgatgaattaagccgctcagtaccgacggcttttgttgaagttctttttgcgcacggctagtaacttctccatgagttcgtcgccattccttgatactttcgggctcattttctaaatgacggttgcccacttccacccctagtaaattcgcgtattgcttaattaacgactgggtgtaatagtctcctggcaaatcatcatcttcaccagcttctaaagccattaaatatcgtttagaaatttgtaactttagttgaacttcgtcaagtgtccaaccctttttgagacgggcatcttgcaaccgcatcccaattactttgtattttttcgtccccataaaaataccccaatttattttaaatcaacaaccagtataccattatttttgccagccgccgtccacataaatagtctgaccagttaagtatgacgccgtttcggctaaaacagtttccactaggtaggcaatttcgtctggtttagcaaaccgacctaccgggatttcttcactgattgcttcaatttcatcttccgcaaagttagcgttcatctgtgtttgaactgctcctggtgcaaccacgttaacagtaatccctaaggaagccacctctttagcataagcatttgcaaaactgctcattgccccttttaacatgctgtaaggaacttccatggcgctgcccaccgccccataaaccgagccaataaagacaattcgtccgtgaccgccttctgccagtttagaaactaattttctaattaccaataacggtactttaaggtgttctaaccataaattttctaactgggtaccgtcaaattcatcgaacaactggtagatcgtggttccctgtgcaaaaacaatcgcgtccaagctaaaaatttgcgcaccgatttcctctgccgccgcttcgtttcgaaaatctgcttgaaccattaggaagtcttgttttgggtattgccgctgtaattcttgcactaattcttctaccgccgcagcgtgctggtggtaatgtaaatataaggaccagccttgtttagctaatcgtcgactaattgccatcccaatgtttccactcgctccacataccaacgcaaacttcattttctcgcctacttaattattttggtttaatttcaaaactactaattacttgttcactaacgaattggcctagcgcttcaatcacttctgtaagggagatctccttaaacatctgcgcttcgtcaaagatagtagcattgccgtaaagagccccttcaaaagaattagcaattgcttctaatgaattcatccgggcaatgcaccgaccgtacatttcttttttagccaaagcaaaatctgctgccagctccggggtatcggtaagtccctgacgcaaaatttccttcaaggcagctgctaattgttggggatggtcgctgtcgccacccatcgtcaaaaataattcgtcccgctcgttatttaaatcataaccgaaagtatcgtctaaaagtccttcatcgtataattttaagtaatttttagaagaagagcttaatagtaaatataaacctaaatctaaggtcaataagtactttaagcgttccagccccggagctggtaaataacgattatttcgaattcccaacattaccttagggcggttggccaggtaaactgccgagctttgctcaactaccggaaggatcttttgttcagctttttgtaaattaaccggctgaacaaattctgtaaactgcttttggcgctgattttcttcaacccagtcgacgaccgtttgcggatctaaattgccagtaacgaacaagtgcatgttttggggatggtaaaacacctggtggaccttatacagtaattcaggcgtaatctgcgcaattgaagcactggttccggcaatgtcttcacttaacgcttgtttgggaaataggttacgcatcattcccatgtataattgccaatctacatcatcattatacatctgaatttcttgtccaatgatcccctgctccttagctacggaagcactagaaaagtacggatcctgcacaaaatctagtaaagtcgtcaagttctctttcagccgactggttgctgaaaataagtagctagtcttgctatagcttgtaaacgcgttcgaatccgctccgtttcgcgtaaaaatttgaaaagcgtcgtagtcggctttttcaaaaagtttatgctccaaaaagtgcgccgttccggctgggatttgtagcttttgttccccaactcgaaaattgcgatccatcgaccccaagttagtggtaaaaacggcgtacgttttttgaaaatccgctttaggcaaaatattaatttgtaagccgttagctaacgttgccgaaaataatcgttcgtcaaaaaccgaatatgccttttcctttatttgcattagtcattatccccatttaagaaaaattccgctcgtggcttgagttgtcgagcaatctcaacaatttgggccgccccgacccggtctaaatcatttaaccattgctcagctgggcgatggaaaccaagtagatattcgttaagcccccgacggtgaatcgtacgttgtaagtctaaaccagcgaggtaatctgaacgcagcccagctttaatgctggttaaatcactctcggtaaactgccccgcttgtaaatctacaatttgttgttggatgatttgcttggcctgagcgtaattgcttgcttcaattcccgtttgcacggttaaaagtccgttatacaaatctaagctggaactagcatagtatgccaagctagctttttcccgcacgttaaggaacagctttgattgtggcgagccgccaaagagcgcgttaaaaacaacggcagcgtgaaaattatcgctcaccaccgtagctggaatatcataggccaagttcaaccgagcttgttgaactgcttgatttgccactctatgacgcggttttggcaacgaattaaacttcgtaattaccgatcctaactgaactttccgctcgggtaattctaaaattgccaaatcttctaacactttttgttcatcgacgtcacctgaaacactaatatgtactaagtcatgacgcagcatggataaatacgtggcgtagacttgttcgttttgtaaattctgcaaatctgcccgacgtccgtaactagggaccccttgaatccggtttgctccaaaagccaacttgcgaagctgctgactcgcccaaaactgcttgtcttcagtagcagaatccacgtaattaattaaattagtcttttgacgggcaaacgtctgctcgtcaaagcccccgttactagccaacgggtgactaatcacctcgtttaagaattcgatagccatccgcactaaggactgactgcccgtgtagtgatcattagccaccgtaattgaaaatccaatgtcatggaggttgccttttttacctgcccccacgccaaaactcgccccgtacattgctgacagggcgtgcgtaaattggatttggttaacatagcgctgggtgctcgtctctaaaagattcgctaccagggttcgaggagctaactccgctaccgttgcgttttttaaaaaatgtacgtcaatccgtaccgttttaaacttcttgcttggaacaattaaagcctgaactccaggccgcatttgtacgtccaaagatgacgcctcctaccttttcacatgcgattaataatagcgaaaaagcattgaaatatcaatgcttcttcgcttttttactgcctcattcaattaaaaaatttgccacctaatttacctgctttataagtaatccaatttctttgccttaagttccacttacaaaattggtgcaatcattcgactggctaactgtcgaaacttcttccaccgtgattgactcgcaaaatactgttcatcgagttcacgagcatccttaacgtcttgtttcataatggcgatcattttttgcgcaacttttgcgtcgtaaataaatgcatttgcttcaaagtttagcttgaaggaccggatgtcccaatttgccgaacccacactagtaattgattggtccaccacgatcgtcttagcgtgcatgaaccccttttggtacgcgaaaactcgtgctcccgctgctaataattgctttgcgtaatattccgtcgcccgatatacgaagggatggtctggcattttaggaatcaccatccaaacttgaatccccgaacggagcgcaatcaagagtgcttccataagtgcgtcgtcaggaatgaagtacggagtctcaatccaaatcgagtgtttggctcccataatcattttaatgtagccctgcttaatcttttgaatgtcattttctggaccgctgcttacaatttgcataggcagcttcttttccaacgcggtttgcgggaaataattcaaactaaacgttaacttaggatcggtaaccgacgcgttccaatccataaagaaccgactttgtaattgtaacacgaccgagccgaccaaccgcaagtgggtatcacgccaattgccaaaacgacgatttttgcctaagtactggtctcccacgttaaacccgccaatgtacccgattgaaccgtcaattacgacgattttgcggtgattacgaaaattaatccgaaaactataatagccaaatttagagcgcataaacggggtaacttctccaccagcagcaatcaacggccgaaagaacttttgcttagctccttttgaaccaaataaatcgtacagcacccggacccgcaccccttcgcgcgcttttttcacgagaatctcccgtaactggtgccctaagtcatcatcgtaaatggtgaagtattcgatattaatgtgatgttgggcaccccttaaatcttgaaaaagttttttaaacttagcctggccgtcggttaaaatttgtaaatcattttgactggtcaaaatcgcgtcgtccgtgtttaaaaacatggttactaagtcattttcgagggtcgtagacaacgaaacccgattttggctgctttgcttttggtgatccgccatgtcactaattcccaaatgcttttgcgcctttaaattaaaaatttgtcgctgacttaatttccagccaaagaacaaataaataatcaagccaattcccggtaacaacacaattaccagtaaccaggcccacgcggctgaaatgtcccgtttttccattagcgcaatcccaaaggcaaacaataagttcaataaatatcccactacactagctaaaagcatggcgcttcctcccttaacccctctttgttctttcagtgtatcaaaaaggctggaaatcgctaaatttccagcctgaatgccattacttaccgaaccatttctggttaattcgttgtaattctcccgttttacgtaagtgttcaattccttggtcaattttttgtttgacctcttgattgccctttttaatgcccaccgcaaaatattcgttaggcatgccactcttaatcacccggtagtcacctggatttggtaaatgctgcaggtagtaatttgcataaacactatcaatcagcaagccctgaatccggtcggccttcaagtcaataaaagcgttgttaaacgtatcataaagtacgggggtatgctttttaatccgctgtttcaaaagttttgggtaacggtcaatgtcctgggccccagacgagccgctttgaacccctagtgttttaccattcatatcctgtggtgagtgaatatgctgacttttcttcactaccaatacctgttggttgaccaagtagggctcgctaaaggtcatcgctcgttgccgttcatcggtaatcgtcaatccgttccaaatcaaatcgacggtttggttacgcaattcagtaacgttcatcgaccaatcgatggtttgaaaatcgaccttaattccatattgcttaaaaacggcgcgggctaaatcaatatcgtatcccgccagcttcccatttttctgacgaaagcccatcggcacgaagctatcatccaaaccaattaccacgtggtgtttagcttgaatacttttccagctgcttggctggggattattttggccagtttttccgcaccctgctaatcctggaattaatagcgcacaggccatcacgagtaagctaaattttactaactttttcatttaattcaccggctttacagtcaaagtttcgtcagcaattttttcagcaaattcaatgtcatgcgtgatgatgacttgcgtaatttgattttgtttcaggtctagaatcatccgactaacttcatcccgaagttctggatcaagcgctgaagttggctcatcgtagcaaaggatccggggattcatcgccaatgcgcgggcaattgccacccgttgcttttggccccccgaaagctggtagggatattgattaataattttagctaagcttagtcggtcgataatttcttccacccgttgtaaagcttctcgttcactaaggtgcaacacgttcatgggtgccaacgtaatgttttcaattaccgataaattaggaaatagttgaaaatcttggaaaaccaccccgatgacgctcttactgtcccgcgtttcaaacgggttaaacggcttaccatctaatagaaatgaacccgaatcaatcttttcaagcccactaatacaccttagcaaagtagtctttcccgctcccgacggccccacaatcgttaaaatatggccatcttggatctgcaggtttaaattatcaataattgtccgtccgttataacttttagaaatattttttaattcaagcatattgatttcccccaatcctagcgaaagtacgaatagtgtttttcaactttacgtaaaaagaaagtgcaaattccggttaaaatcaagtacataaccccgaccaggataaacggaaccaaggtaacgtcacgggccgccgctacgtttcctgcccggagcaggtccccaatcccgattacgtaaactagcgaagaatccttaaccaggttaattacttcgttaccaatcgatgggaggacaattttggctacctgaggcaaaaccacctttttagttgtttgccagtaggtcatttgcaaaacccggcctgcttcatactgtcccttatccaccgactgcaacccgccccggaagatttccgcaaagtacgctgcgtaatttaggataaaggcaaacaacgccgcttcgtaacgcggaaagacaattcctacggttggtaaaccgtaaaagacaaaaattaattgcaacaataacggagtcccccgcattagccaaacgtacgcgctaattatgtattgcaacggtttgaatttcgaaaccagtcctagcgctaaaaatactcccaaaattaaagaaccgataatcgtccaaataaaaacttgtaacgtcatcgccgctccggaaagcagcgaaggcaatatttcgctaatgtattgaatattaaacatcttttcaactcccttagtattaaaaaatccccttagactaaattgtctaagaggacgagttaatcgcggttccaccccattttcgttactcgctcgcgcaaagtaacctcactaagttaaacaccttttattggtaaatgagctgtaattacccacgttaccatttccagtacagtgggaagccaaatctaccgcgaaaataaaaaaatccccttaggccgtagcctaagaggacgaattatcgcggttccacctcatatttatcaactgctcgcgcagtcaacctcagaaagttgcattaacttaaatgataacggaattaccggataaccctagttatttttcaggctatcaactcacagatgtggttcatctacggcttcgcctaggcttgcaccattccctaggtcgcttttcgaagtaacgtagactactcttctgatcattgtcaaacataagtaaaataatagcaattattctttaaatgtcaagcactccttaaccaaaactccgataattagttccccgggtccgccgaaagaaggtcttgattgggtaatataaaaccacgaagagtgccaaatttaaaataatggttgggaaaaacgaatacccaataaaaaagcttgccgacacgtttgccaaatgaatcgcttggaaaactgcgtagaatatcacgttgtacaatgccattgcaagcgtatcaagcaccatcacgatcaaaaacgatgtattgacgtataagcgaacttcccgcacaaacatgaccactaacgggataatgaaggtatttaccccaaagacccccgtatagtaccagtcaaagacgattccaatcacgaacgcccataacgtaaaattaatctgggactctccttcaaaaaagattcccatcacaaaccacatcagcgttaggttgcaaatcatcgagtacggatattgaaataaaaccgccgaaaatatttggtttaaggcgccgtccaaaaagaaggtcccaaataaaataattggaaaaagatatttaagttttgccgattgtaacatactttcaccctaatctagcttagcaatataaacatcgttaacgttgctcaactttgcagctggcttaatacgaatttcatttgctaacccataatcttcttttgaaacttttgctaccttcccaacgtagagtcccttcggggttacacctcccagaccggaagtaattacctgactaccaaccgccacatctttatcttcagtaacttgtcccataatgatttcgttggtctttttgtcatagccagtaataattccattaacgtaatttccgtctttagcctggacttggatcgcaaaccggttagccgattcattattgtcgctgatcaattctactttactggttgaatagttagcttccactacccggccaactaagccatttccggcaagcactggttgatttttcttaactccgttagccgttcccttattaacggtcactaggtcctgccacgaacttggtgaacgggtcagcacgattgctggggttaaagaataatccgtcatggagttcttcaaccccactagttgctttaattcccgattttcttccttgaggctcttgttttcagcatgagtcgcgcttaatttatcaatgtcttggcgcaatcgttcattttcttcgtaagttgcaacaaagttatttaagttagtcgataacgtctgcataccgtaggcagggatggcgatcacccggctaacggcgccaaaaaggtcgtttcccaatttttggacggccggtgtcttatctttctttcccaatgccaacgatcccgtaattaaccctgcagcaataattgcacaaattaccgttaacactagctttcgattagaaaaaaatttatgcatgagctttgaaccccttaattaatctcattaaaatgacttcataaattataacacacaaaacggccaaactagcgctaattgagattgtttaacaatcattaagaactcgattttccgccgcactccaataggtttggtcacccacaatcagatgatcaattagccgaatccccattaaatcgccaatttttttcatctttttagtaaacgccacgtcgttcatggaaggctctacgtttccactcggatggttgtgtaccaaaataaaaccgttcgagctataccgtaaaacttccgccataatttctcgtggatgcacttcggcagagtttagcccgcctttaaaaattacccgttcctgtttgatttggttttttgtgtccaaacaaagcaacactaagtgttcttgcggatttttttgaaaacgagctaccatcaagttcccaatctgcgcactgcccaacaccttgcctaatagatggattggttggcgttggacgcggcgtcctaactcgattgcggcttctagagctaacgattccgctggtaattgcgaaaaaatcgtttgccgttctcgttgggttaataaactataccccactatatcgcccacctgatcccaaaattcttgggatagccggttaaccgcctgctcttgaccgcaacaacttaaaaatgcccgcaataattccgcgttggtcaaattttctgcgccaatttttgtaagtttttcacgtgcgccatcttttaataacatttttaccacctcttagatacaaagtacctaaaaagcagctaattatttcttaaacaacgggcgaacttcggaaacgaagtacaaggatccggtgatgatcacgacgtcccttgggttggcctgcttaatcaattgccgtaacgccgttcgccagtttgcttcataattaatttgccgcgcttcattggctacgagttctccgggttgcaccacttgccgatggagcggattttgaaaattagttaacgttagttgggcgttcggaatcgttaacaattcatcaatcatcggctgaaatagcttatcatcaagaattgccgctaagatatggatgggacgatcctgccaataggtttgtagcgactgctttaacgcttgtactcctggtagattatgcgctccgtcaaggaccactagcggctcttgttgcatgatttccatccgacccggccagcgagcctgcaagctggctctgcgaatctgatcagcgctaagtttccaccctcgctgtcgactcaagactaccgcagcttggattgctacggctaaatttttaagttgataaacacctaataacccgctttttatatttgaaacgtggcaatcgttgctttcgaaatctgcaggatcaccagtcaacttaaaatcagcatcaagtaccattaacggtgcatgctgctcgttagcaacccgtttaattactgttaacgcctctggcgcttgtacgccagtaaccaccggaacgtgcggtttgatgattcccgccttttgttgggcaatttccggtaaagtattccctaaaagtgccatgtggtcccagcccacgtttgtaatcaccgataccaacggagtgaagacgtttgtggaatcatacacccccccaattcctacttctactaaaactacgtcaaccggatgttgcgcaaagtataaaaacatcatcgcggtgacaatctcaaactctaatggaccacccaattcagtttggtccattttttccaccaccggccgtacttgggtaactaaatgcaccaccgcttcatcgctaattggctgaccattaaccgcaatccgctcgttaaagcgggtaataaagggcgacgtaaaagtccctacctgacgaccttcttggcctaacaaactagttagaaaggcgatcgtggaacctttaccattggttccagcaacgtggaccgcctggattttagtttggggatttcctaattcagttaaaaattgttgcatcctttttaaggtgggcgcctttcttaaccggggccgcccgtgaacaaatgccagcgcctcttcataattcatccgctctcctccttatcacggtgccattaaaaaaggccgagaaaaatcgcgtaatttttctcagcccctatttttcaagtactaacggttctaatcgctaatcttaacgaggttgggaaagttggttcccataaccttaaagtactaatttttattgttattttccagaacggatatctgccaaacgacgacgagtagccgcaagcttaccttcgtaatcggtcttcttggttcgctgttcttcaacgacggctgccggagcgttattaacaaatttttcgttttgaagcttcttaaccacccggttaacttcttgttcgtacttttgctcttctttttccagacgagcaatttcttcgtctaggtcaactagttcagctagtggaatgtaaatttcaccatcggtaattactgccgacatggaaagctttggcgcttcgacagttgcccctagttcaaattctgctggatggcagaagcggtcaatgtaatcgcgattttcgttaaacaacttaaccaacgcttcgttatccgtcttgattaagaggtctacaggactagacattggagctcccgcttcagaacgaatgtttcgaaccgccttaatcaattcgattaagtggctcattccttcttcagcagcttcgtcagttaattctggatgactaactgggtaagccgccgttaccaacgattcaccttcgtgtggcatcgataaccaaatcttttcagttacaaacggcattactggatgtaaaagccgcaaagtttggtctaggacgtatgccaatacgttttgggtatttacttgagcagtttggtcgtcaccgttgagaatttccttactcatttcgatgtaccaatcacagaaatcatcccaaatgaaggtgtacaatgcccgaccggcttccccgaagtcgtaaacgtcaaagaagtgggtaacttgttccaccgtgtggtttaggcgacttaaaatccagcggtcagcaaggttaagttcgttcaatgctggtaactgtggcttatcaacttggtctaagttcataattacgtagcggcttgcgttccaaatcttattaataaagttccaagctgcatccatcttagtgtagctaaaccgtaaatcttgtcccgcagtagaaccgttagaaaggaaccaacgcagtgcatccgcaccatatttatcaattacgtccattgggtcgattccgtttcctagcgacttactcatcttacgaccctgttcgtcacggattaatccgtgcaacaatacgtctttaaacggccgcttgccggtaaacttcaagctttggaagatcatccgagcaacccagaagaagatgatgtcatagccggttaccaacgtgctagttgggaagtagcgcttaaagtccgccgcgttttcgtccggccagcccatcgtggtaaatggccacaatgcactagagaaccaagtgtctagtacgtcgggatcttgttcccagttttcaacgtctttaggagcttcttcgcctacgtaaacttcgccagtttccttgtgataccaagctggaatttggtgtccccaccacaattgccgggaaattacccaatcgtgagcattttccatccactgcttgaaggtgtgttcaaaacgttcggggatgaaattaaccttgtcatccgtatcttgatttgctaaagccatcttggcaagtttatccattttaacaaaccattgcgtcgacaaacgggattccacttgtacacccgtccgttccgaatgacccacactgtgaacaattgggtcaatcttaatcatgtagccctggtcttcgaggtccttaaccatcgccttgcgtgcttcaaaccggtctaagccttcgtacttgcccgcgttctcgttcattgaagcatcgtcattcatcgtgttgatccgttcaaggttatgccggttacccacttggaaatcgttagggtcgtgcgcaggcgtaatcttcaccattccagtcccaaactcaggatccacgtactggtcagcaatgattgggagatgacggccttgaagcggcaaaataacttccttgcctaccaagtcttggtaacgttcgtcacttgggtgaacggcaatggcaacgtccccgaacatcgtttctggccgggttgtcgcaatttcaatataatttttcccattaaaagtaaaatcaggatctgcgaagaagtacttcacgtggtagaaagcgccttggtcgtcttggtgctctacttcgatatctgaaagtgccgtccgcgcctgcggatcccagttaataatgtattcaccacgataaatcaacccttcgttatataaagtaacgaatactttccgaacggccttggaaagtccttcgtcaagggtaaaacgttcccgaccgtagtcgagcgaaagccccattttagcccattgttgatggatggtgtcggcatattcatctttccattcccataccttatcaatgaacttgtcccgtccaagatcataacgggaaactccttgttcacgcagtttagcttccacctttgcttgggtagcgattccggcatggtccattcctggtacccaaaccgtatcatatccttgcatccgtttttgccggatcaacatatcttgtaacgtagtatcccaagcatgacctaaatgcaattttccggtaacgttaggaggcggaattacaattgaatatggttttgcttttttatctccattaggcttaaataaacccttttcgacccactcttggtagcggccctgttcgaccttttgaggttcgtactttgtcgacatctcaacttctttggtcatcaaacttcacttccctttccaaaataaaaagcactttcttcctaagaaataggacgaaagtgcttcgcggtaccacctaaattgggcataactgccccgctttgtctttgataacgaacgtactgttcgatctttaagttctgcgccttaaagattggttcataagcaacccgatcttccgtgtttagagacttgcagccccgtcccctctctgaaaaacactgatggaaaatctcctcttaatcatcaccgtcaaaaataataataaagaataaatcttggtacgtcaattaagtttttacatttgtttaattacttctagcgcagcttcgtagtttggctcagaatgtaattcaggaacgatttcccggtaaacgattttaccagatgcatcagcaatgaaaatactccgcgctaagtaaccagcattcggaatgtataatttcatttcataaccaaacgacaattcgtgatctgaaagaacttctaggttattaaccccttcggcagcacaccagtttgcttgatcttgcggtaaattattagaaatcgtgacaaaccgaacttccggatagttatccgcctgctggttaaaggcctttgtttgaatgctgcaaactcgcgtattcaaatcaggcaccacgcttaataacaacggtttgccaagtaaatcacgcgtttttactttcgcgccttttgccgtaaagactttaaactttggtaattggtcgcccacttctggcgggttaccaactagttcaaccttttgtccaccacgtaatatttccatgaccttacgctcctttattctaacgactagtcaaaatggattgttctccactaactttgtcagataacttaattagtcaattaatcgaggactaaatttctcaatatccaccgatatttacgttaaccttatcccaaaacaccccaaatagcaactaatcaatttaagcttaaagaagttctgcaaaaacttcttcattctggttcaaaaattcttcgccagcgtggatgttagtaacttgcaccccgtcaagagcacgcttcatcaagccttccacgtcaatcttgctttcgtaatagcgggctttttctaaatccggacgcgtctttggagctggcggagcgaaaatggtacaacagtcctcaaatggcataattgataaatcgtaggtatcaatttccttggcaatttcaatgatttcgtttttatccatcgaaactaccggtcggataattggcatggtagttacgtcgtttatcgccatcatgctttccattgtttgagaagccacttggccgagcgactcgccgttaaaaatagctaagccaccccgcctttgtgctaacgccacggtcaaacgaagcatcatccgccgttggatcgtcattaagtaaccttccggacacttctccttaatggtttcttgaatttcagcaaacggaacttgcaaaaactgaacgttcccggaataagcagctaatttaccgcttagctccttagcttttgcaagggcttgttcactcgtgtatggcgggctaaagaaatgaaccatttccatctcaacgccccgtttcatacctagatatgcggcaactggcgaatcaatccccccagaaagcatcatcattcccttaccagccgttcccactggcaagccgccagctccatcaatcacttcgctagttaggaagattccgtttgaacgaatttccactcgtaaagtaatgtcaggattcttcattttaacctgactttcaggaaagttttctaaaatgaatccgcctagttcccggttcatcgtatcggtattgatggggaagtccttatctgaacgacgggtgttaatcttaaaagtcatttggggctttaactgttctttcatcattgctagcgcgccttcttgaacagcttccattgatttttcaacttttaacattggtgataaattttgaattccaaaaacccgtttcaagcgggcaattactgccgcactgctcgccccgtttaaagtaacgtgggtgcggtcccgattagggtggaccaccacttgttcaaagtcttttaaacttttacgaatgttaccgcctaagcgggcgataaaatcttttcggttttttccctttgtagatagctcgccgtagcgaaccataatttccgtatattccataaaaactcctatctaagcattttgattaattttagaaaagtcttggtacaactggtcgaaaactttattaaagcgttcagcttcttccatagtgttagcactgtctaaactgacccgcaccgcactagtggaaatctgttgaccaacgttcatggccgtcaaggtactagaagcttgttgttttttggaagagcaagcactcgtcgtcgagatgtaaatgtcgtggctttcaaacgcgtgaacaattgtttccccacggactcccttaatcgcaaagcacaggatgtggggcgcaaagccagcatcacatttcgaaaaggcgactactttgtcaaaactagtaacgtgatcataaatagcctgttttacttgagcttggtgcgcaactttttgcttttcatcagttagtaacaaccgcaaagccttggccatcgctgcaattgctggtaaattttcggtaccgctgcgtaaattcttttcttgtccgccaccagtcattaacggcgcaattcgccgaccttgccgcgcgtagataaagccgacgcctcgcggagcgtggaatttatgtcccgagaaagtgacaaagtctacccggtcgttcatgatggccgattgaattcccttaccgattccttggactgcatccacatgaaaatgaattttagggtaatccttcaacacttcggcaacttcggtgagcggttgtaccgtaccaatttcattgttaaccgccatgattgaaaccaaaattgtatccggccgaatcgcatccttcaaatcttggatactaatccgtccttcatcatctacgggtaaataagtaacgtcaaagccgagttgctctaattgagccatcgtattttggaccgccggatgttccaccgtagtggtaatcaggtgttttccgtaagcacgtttttcgattgccgttcccttaatcacccagttgtcgccttccgtacctccgctggtaaagaagatctcgtgtggctgcacgtttaacaagtccgcaatttgtttacgtgattgttcaagcaaattaaacgcagtttcacccatgttgtgtaaactagaggggtttccccaaatctgattgctaaccttttggtaagtttctaagactgttttatcaacttgcgtagttgcactattgtcaaagtaaatcattttcctcatccctaacttaaaatcccgcttaatcacattccattattatacttacaaatgggaagcgtgtcaaaattttaccattttcaaaaccagttaaaattctacctaattttgaaaaaaattccatccccattacataaaacagaggccgagaaaaaatttcccagcctccgttgccgctttttaattgtggaaccttgatccctatatcagttaacctaatatttctagattaatattccgttttcttttgttggtagtagttttccgtaatgttctcgattgctcccggttcaaccttgtccaacgccttcgaaattactgaaaggctttcgttgtaacggtggtctttatcaaaaagcttttgcgcttgttgactggctgccgcaacctcttcatcagtatgccggtaacggttagcgtattggatggccgcctcactaattgcagcatcatcggttaaatcagaagtcttcttaatcaaggtttggatgtcggtgctaaccatgtctaattcgcggttaatcatccccatattgatccggacttgattcatatcactgccaactttttcgatttcgtcgctaaccacaaagaagtaatccatgtagccttctggaataccaggtaagttgagcgtttcgacgtgccgtttaatgttatgaatttcattgtcgtattgttgcaaacgcgtccgtgcgtccttttcactatcgaccatttcctgtaattcactattcaaggctgcctgccggtcttcaatttcagttagctgttcgttttcttcctttagccgttctacgatttcggaataaaccaccggttggttagtaatgcgttccgtgtcccggtcgtgttcattgcgaatgtcgtttaattgaccctctagaacttgaccaaggtttagctgatcatcgtttaaaacgtagctttggtctagccgagcaatttcagaaaggagcactttattttgtttttcagcatgatcaaggaatcgagtaatgacgttgaagttgtgctctacagatttacgagcgtcaatttcggtttgtaaaatgtcgtataattcatcaattcgaatttcaatcgccttgttattagctcgcacagcatccaaccgtaaattgctaagggtttccaaattatcattaatcttggctttaattgccttgatttcgtccttaaccgtgtcattttcaaaagcgtagttatgattaattaactggtcatagccatcgcgaacttcttcgatttgtgaaggaaataagttggttaattcatcgtataacgaaggaattgccttaatttctgcttcaatttcagaagtgctggcctttaatttcttaagttgaccttcggctttttcgtgatccccagcatccacggtctggttaaacgtatcgaaatcgtcgtttaaccgggatagcttttcttcaagcaaatcaatgcttggtcccagagataggttttggtcaagcagttgcttgccaatctcttggtacttcatccggaggaccttaaccgcatcacgttgttcttgatcaattcgttggatattatccaattggtcattcaaacgcttggtttcctcttcaatcgcatcgagagtctcactaaccgtcgtaatatctttccgcgcctcaaatatcttcatatcattaatattttgacgtgaatggttagcgatatcttcaacttcgggcaagcggtgatcaatgatttcttggtagtcattgcggatgttatctaagccgaccgcagacgatccggttaagttcattgaagatacttccattaacttctggcggatcggtgattcgctaatatccgccttgcggtttaacagttcatcgacctgttttagtaaataacgttgatatgcaacaatcccgaggtaaactaaaatcgctaccacgatgactgaaatcaatactatgatcatatctaaaatcccatccttcttgcttcactcaattcctttatgaaaaacttgctttttaagattcttcaatttagaatttaatccattataaattatagcataccctatctactgttaaagcagtgattttaattaaactacttaaaattaggaagtgaccaccatgtccaagacaattgctccaattatcattgaccaaattgacgcccttttaactgacgaaccacacccgattgctaacctagctaacgcagcggcgttgttgtatagcgaaattagcgacctcaactgggcaggtttctacctatacgatgctaatgctgacgaactcatcttaggtcccttccaaggcaaagttgcctgcatgcatattcaaaacggccgcggcgtttgcggcaccgctctaaaacagcaaagtactttgcgcgttgctaacgttcacgaatttccaggtcacattgcttgcgatagtgcatctaactctgaaattgtaattcctttaatggtagaaaagcaaccaataggcgttttagatattgattcacctagtttaaaccggttcagcgcaacggatgaacaggttcttaatgattttgttgctactttaatgaaacacattgacaagtccgttttgcgtgcgttaaactagctagagtgtaaaataatgcagcggtgggcggtaagctcgtcaacagattgttgcctttttaaatggttaattagtacccttagcggctgcaaaggtgaaaattacagagcaatctgcacgaatactaaacccacatttgtttattttactccaacaaaaataatttattggaggattttttaatgtctagatatacaggtccaagttggaaagtttctcgtcgtcttggtatttcattgtcaggtactggtaaggaattggctcgccgtccttacgcacctggtgaccacggtcaaaacaaccgtcgtaagatttctgaatacggtatgcaacttcgtgaaaagcaaaagttacggatgatgtacggtttaactgaacgtcaattcgcaaacctttttgatcgtgctagcaagatgcgcgaaggtgttccaggtactaacttcatgatcttacttgaacgtcgtttggacaacatggtttaccgtttaggtttggcaactactcgtcgtcaagctcgtcaattagtaaaccacggccacatcactgtggatggcaagcgcgttgatattccatcatacgaagttgaaattggtcaagtaatcggcgttcgtgaaaaatcaaaagatcttaagatcattaacgaagctgttgaagcagtcgttggacgtcctcaattcgttcaattcgatgctgacaagcttgaaggttcacttgttcgccttccagaacgtgacgagcttgaagcagaaatcgacgactcacttatcgttgaatactacaacaagctataataggaaaacggctacggccgtttttttatttactttcatttattttgaggaggaaaaatgcaaccattagcatatcggatgcgcccccgaacccttgaagaagtggttgggcaaaagcacttagttggcccgggaaaaatcattagccgaatggtcaaggccaaacgattatcttccatgattttatacggcccccctggaaccggaaagactagtatcgctagtgcgattgctggttcgaccaaatacgcgtttcgcatgttaaatgcggctacggattctaaaaaacaactccagattgttgctgaagaagctaaaatgagtgggacggtcgtcctcttgctcgatgaaattcatcgactagacaagactaagcaggactttttgcttccccacttggaaagcggacagattattttaattggggccactacggaaaatccatacattaatatcaacccggcgattcgtagtcgtactcaaatttttgaggttaagccccttactcccgctgacattaaggaagccgttgaaatggcacttcaggattctcaacgtgggttaggtgacctccccctccaaatggatgaaaacgcgttgcaatttgttagcgaagcaaccgggggtgatctccgcagtgccttaaacgcggtagaattggccgctcgttccacctcaccaagtgacgacgataaaatccacctcactttgaaaattcttcaggaatgtctccaaaaacgggcactcacccaggataaggacggggacgcccattacgacgtgatttcagcgtttcaaaaatcaattcggggcagcgatacggatgccgcgctgcattacatggcccgtttattagaaagcggtgacttaaagagcgtaattcgccgtctgcttgtaatcgcttatgaagacataggtcttgcaaaccctcccgtatgtcaacgaacggtcgctgcggttaccgcggctgaacacattggcttacccgaagcccggattccccttgctaacgccgtaattgaactatgtgtttctcccaaatcaaatgctgcaattacggcaattgataacgcactcggtgacattcgcgatggcaaaatcggtgaagtccctgatcacctgcgtgatgctcactatcaaggtgcaaaagcgttgggtcggggaactgactatctttacccgcataattatcaaaacgactgggttccccagcaatatttgcctgatcaattaaagaatgctacctaccttgaggctaagggaaatagtccttttgaatctaaaatttacgaacagtaccaaaacctgaaaaaatcacaaaaatcaggactttaatattgtcttttaggtaaaagttatagtactatgaatgtgaagaaaccgaggcatgcgagaggattggtttcatattcttccaacaaacatctaaccgggaacccggatcgtacgtgaattgtaggctcgtaagcgagaaacgtgcagcgtaggtatgggtacccaccttgccttttgggttagatcctggccaatctgaacggtgtcgttagttcttcccccacgttaggtggggctttttttatatcatgaaagtaggttattttatgttaatcccaggcttaatggttattttttcacttattattttttacatcggcaattacttatatcgccatcagcaccgagattttatgttatttaaaccaacttctaattcgcttttaagcagtagtctacgagttatcggtattttacttatgatcgttagcctgctgactttaattgcgggaattagtagcagtactcccctaattgtggccgggttggtacttggaattgtgtcaaccacgggcacgctgctatttttattaaaatttttatagcaaattcctttttattttctaatttttaacgtacaattagtgtaaatagataggggtggttatgttatggctcaacaatataagcatattctcgtgccagtagatggttctaaggaagcagaattagcctttcgcaaggcggtcgcggtagctaaacgtaatgatggagctgaattgcatctccttcacgtaattgatacccgtgcctttcaaaatatttctaactttgacaacgcaatggtggaacaagttacggaaactgccaaaaagacgttagaccgttacgttgaggaagctaaaaacgatggtttagaaaacatcgcctattcaatcgaatacggtacgccaaaagcagtgatttctcaggacgtccccaaagaattgcacacggacttaatcatgatcggtgcgaccggtttgaatgctgttgaacgcttattaatcggttcagtaaccgaatacgtcacccggacagcaacttgcgacgtgttagtggttcgtactagtctagaaaacaactaaattgttagtatagagtgactaaaagtcgaactttttacgcgactaatgctggaaactcatcaaattgataaattaaagcggctggaaaaaactaaacaacttttcaaggatgcaaaggtcctcgaaaagttgttttggtgatttgacttcaatagagccaaaagtcagtttgttcctcttaaccaaaaattgaccatgatgccaaatttaggcatcatggtcaattttcagttaatgctcgcaaactaccgacttttgtcccactctctttttaattttccagcttaaggattaattacctaattccacttttgataatactcgcagttgacccagtgcccgttaagtaatcctgcatcttgtagaaaaaagctgacgttccggggaccaacaaattcaaacccctgcgccttcatttcctggcaaactcgtttagcaaccggatgctgaaccagcacctttgtgttagtccgttgctgtaagtctaggggaacgtaacctacttgtgcccataaccagtcgctgaaggattgcttatgctgggccatttgctggattatccgcgcattatggattactgagcgaaccttacgttcatttttaatcatcagtgggtcttgtaaaagctgttggaccttagcttctgaataccggctgaccgcctcaatttgccagtcgtccattacaggcgccatctcaggaagtttagctaacaccatttgcattttgagcccggattgaaaaaactgacgagttaaactttcaaatagggcttggtcagtaaacacgggccttccccaaacttgatcatgatacttttttaacactgggctggccgtggcccattgacaactttctcgcataaaaaaacctcccttagatgtagttactctaagggaggtttctttatttatttttctgcttcttgataaagtttttgcttgcctagaatgatactttcacagaggtcctcataactgattcccgctgcttctgcctcttgtggcaatagtgatagcggcgtcatgcccggtaagttgtttgcttcaattacgtaaactccctggtcattaaccaagaaatccacccggccatagttagtcattcccaataccttcatggtttttaccgcaacccgcttcatttcgtcatggacttcttcatcgatgtccggtggcgtgataaattgggtcgtcgtaccagtcttaaacttatgctcgtagtcataccaaccatcattaaccacaatttcaattgcaggcatggcttgttcattaactaccccaagagaaaattcccggccagtaatgaactcttccacaatgatttcatcgtcaaatcggtaagcatcacgtaacgaatcagccaattcttcttcgtcgtgtacaatcatcgttcctacactagatcccccgctattaggtttaaccactactggaaaaccaaaatctaactgaggatgaattccgtcttcttcatggagaaccacaaagcgtgccgtcttaatatcgttataaagcatgatttcctttgaaatcgccttatccattgcaattcccgatgctaaagttccgcttcccgtatacttaatatcgttcaggtctaaaacagcttgtaccttaccattttcgccatcaccaccgtgtaatgcgagaaaaacaaagtcggcagcccggaggatttccaaaacgtttttcccaaataatccaaccgtgccatccgtccgaagtttttcgatatcagcatccgttaaaacgtccgtctgaatttcgtagtccgaatccgtattactagtcttaaaaacatcttcaacagtctgcccttcttgtagatcatatcccaagaataggtcaatcatcgttgcttcgtggcctttagcacgcaaagcatcggtgatttttgaaccagaggaaagtgaaacgtttcgttccgtactctttccaccagcaagcactgcaattttcatttttttcacctcatgtgtaagataattacaaacttcagtttgctccgccaattatcaaacgttttttgaaactcaagtataccacaaaacaacttcaagaatgagatgaaaattaaaaatatcgcgcttaaattgtaaaatcattcgaatcttctaaatattccaccactgccttagccatgttggagtttagcatcatggcttgtagtaatcgctgccggttaaaaatcgcattccacattgcctgggtttcccggacttgggttgatgccagggcgcgccgccattcgcgaagttcgattaataaaaactgttggtagacgtcatcttctaacaattgatcagcaaaataaaccgctaaacgcgttggttccccgtatattaaaggggtggtgagtcggcggaatttttcaatgaccgttgccattaataaaattttatcagcgcgtaacagttcttcatcactagctagctcgtccaaaacgttgccaatgtgagtatatgcgtgaacccatccttgattagccacaaatcccctagtatcattttccaacattatatatatggctagttgctcgactagcttattttttcgcgcatggtcgataaacgctgccccggctcggtcaatataaattaacgatgccagcatcatcactgcaaaggaacgcaaaaaggctgcgtcattttctttttcattgatgtgcgcaaataacacttggtcgctagttagtcgatcaaacgcccgcaccatctgcgccttagttaaaacttgattttgaatgagatcattaaaaaggtaaaaaacccccttatcccgaataattgggttgggcgatcccaaatgttgcaacattaagtctaaatcagcatcactaagctcttctagttttcccttccccaaggctgcccgaattcgctggagcaactcttcaatgccgtcctgatcatcaggcaatgtcactggtttaacggtttgattctcgttagcagcgtcaataattgcccctaccgaacgacctaaagaggcaaaaattttgccctgttgcagcctaacgcgtaattgtcttagcttctggcgggtcgtttcgattgcatccattttttcgtactcctcttctttttactactttgattctaacactttccataacctacacgaagaaacttgccgttacgatttcctagaaaaactttccttaaattaacatcagattaaaaaatgatgataatttatggtatgatatttaaatcagatacttttacgagggggaaagctgatgagttcattcattaaaaagtttattcataaagaggatccttcccaatacgaagataaggacgccaacctggtgcgcacgttgactgtcaaagattttctatctttaggggtgggaaccattgtttcgaccactatttttacactacctggagtggtggctgcggaacacgctggtccggcggtagttctatcatttctagctgcagcagtagttgctggtttagtggcctttgcttacgctgaaatggcttcggcaatgccgttcgccggttcggcatactcctggatcaacgtaatttttggggaaggctttggttggattgctggctgggcacttctggccgagtatttcatcgcagtagcttttgtagcttccgggctttcggctaatttccgggggttaatttctacggtaggcttaaaattgccggctgccctggccaatcccctaggaaccaacggcggcattattgacattgtcgccttgattgtcatcctactggttgccattctactagcctgtggaacttctgaggccgcacggatcgaaaacgccctcgtggtattaaaggttttggccattattttatttatcatcgtaggcgttacttcggttcatttatctaattacgttccctttattccacatccgcgcgtgttacccgacggtagtcattttggcggctggagcggaatttacgctggagtttcgatgattttcttatcctacattggttttgattcaatcgctgccaacgctggtgaagctaaagatccccaaaaaacgatgccgcgtgggattttgggatccctagcaattgcggtaaccctttttgtagcggttgcccttgtgctagtcgggatgtttcattactctaattacgcaaataatgcggaaccggttggctgggcattacgcactgccggacatcctgcagtagctagcttagtacaagcaatcgcggtaatcggaatgtttaccgccctgattggaatgatgatggctggttcccggttgctgtattcatttggccgggacggcatgctgcctaagtggcttggtaaattaaatcgtcatcaattgcctaaccaagcgttgctatttttaaccgttaccggaattattattgggtcgctgttcccgtttgcctttttggcacaattaatttcagcaggaacgttaattgccttcatgtttgttacgttaggaatttacgcccttcgtccgcgtgaaggaaaggatatcgcggtgccaagcttcaagatgccattttacccagttttaccggcgttagcctttttaggaacgttggcagtgttctggggactagattaccaagctaagttgtactcgttgatctggtttgcaattggcttggtagtatacttggcatacggagcaagaaattcgaggattaaataaagagaacggaagccaccgggtaatcttcgaggattagcttaatcattcgattaatcactacttttggcgattaatcgaatgattggggctaaccggaaaagattggtggctggagttcatttcaaccatattgcagaaaatatcaaaaggactaaccacgaaattcgtggttagtcctttaatttagttaaccggaagaagctaggatgcgcagttcatttcggctccgcaacaagcaaccacacttaacaaacaaaaaaattccttctacgattggaacccttgaggcgctcccattcttagaaggaatttttaatatttttaaatagcaagttttatcttagctttatgcaaaaatttctggcaccacttgcttaccccgtttttcaactaaatcttcgtaaaaggcggtgtacactccgttacggtacggaatgtaccataggaagccaatcccaaaggttaatacgcttaggataaaccagcccaacaacgataattgaagcagtaagaagcgagctttgtagccgttcatcaagcggcgactaaacgtaataaaggtgacaaattcaaattggtccgtcaattgccgttcttgtgcgtccttgtacagcaaatacgactgcgaataagagtaaaacttaataatcgcgggaattacgaacaaaaaggaccacagcgttaagaaaataaactcaaataaaaagatggccaacgtagacgtaaagtatttccgagtaaacgtttgaaatggcgctccccacgaaggaatccgggtccgattgcgcaaccaatctagcgtaccgtattgaattcctaccataaagaaggtcgcgattgccattgatagaaaatcacgcgccatccccgttccggaatatgcagaattaacactcgctgcttgatcataatttgtagcctgacgcaacgtcgctgggtcagtttgggtaaatactactacggcaatcccaataaaagtcataatcataaaactagtaaacgcggcacttataattggtaagatattggctttaatggccgccatccaatttccttgatacgtatccaaagtacgtttctttagtgctttaatacttgtaaaatcattcattaaacggctattctcctcgtttcagtcttaagcgcacgtttaaccatcgcgaaattgctaaacatgctaacattaatactaacataattatggaaggaactaccgggttaagatgccccattggtcctgtatcacccatgacaaatctaatgaaattatcaattctttcccacgtaattactttttcactaaccattcgtccaataatcgtgaaaataacaatcagcactagcggaatccccactaggattgcccgctgctgccgccggttaagcagtgcaaagagtgctcctaacatcattccacccgctgccactagaagcagaaaaattaagttagttagaatcattgaaaggatgttgaggacgccattcttataaaaatgtccgtaaagtgaccagtaaaaggaaacattcttgctctggtcacccattaaggaaagcatgttagctaataagccataaataatggctaccccagctaaaactaagagtgaaattaatttagcaatccaccccgttcgccgagagaccccattttggattaaaaatgcaaatcgttcgtaagttaggaaaccacaataaaatatcagcacgaggttaacgaaaattgcgccaaacgatagcgtcgttaattgggccccaattgtctcagtagttcccgtaaagcctttgccaattacgtgaataatggttggcacccccagcattaacccgataatccacgcgtacgcgattagcacgaggcgtaaataattgcttaaatcatatttaaccaccgccgcaattttattcatgagtttctcccccatttgttaaattaataaaaagcgtctgcaaatccattggatcgatattgatctcatctggaattggtcgatcatttagcggcccatacacgtaattagccttaatccgtgctagtcgatcactgccaatgacgtttaaccccgcggtgtattgatcaactgcttgaacaggcccgctgatggtgtatgcgttcgccaagaccgtttccgtttcgtcgtcaaccacgatccgcccctggtccataaccattacgtgctcaatcaatttggcaaattcttcaattaaatgagtagcaatcacaaaagttcggggcttttccgcgtaactttctactaatgcattgtaaaaaagttcccggtggttagcatccaaacctaaaactggttcatctaaaaaaacatattcagccgggacagatagcgccacgattaacttggtaatcgttcggtatcccgtagagagatggtgaaaaagcatggactcttttagaccgaattgtttactcaacgaatgtgctaactcactatcaaagctaccataaaaattggcagaccatttaaaaatgtccttaacccgaatatttttgggataaagatccacttcgctcattaagaatagctttcccagttgccgatcattatcaccaatcaattcgttatccagcttaatttcgccttcatcgggcctaattcggttaaccagcaaattcaaaagcgtactttttccagccccgtttcgccctagtaaaccgtatatcttgttcggttctagagttaatccaattccatttaaaaccaagtggtggtcaaaagttttcgttacttgccttacttcgatacctttcataacgattgatacccctgttcaattaatttttttaactctgtttcggtgatgtttaagcggatcgcttccttaacgacgcccaccacgtacttttggtaaaaattctgttgccggtctaaagtaatttgtttactcgccccgggcactacaaacatgccgactccccgatgtttttctaagaggttccgcgctaccaactggttcattccttttaaaaccgttgccggattgatgtgaaactccttagaaatttccgttgttgaggggatttgttctccttctttaaaaccacccgtgaagattgcatcttcgatttgttgggcgacttggagatagattggttcgctgctattaaagttaaaatgcataaaatccaccttcaaattatattatttactaacctaattactcacgtaactaactatatgggttctcagcctaaaagtcaattgccgcccatcatctaaacaattaattcccttacaagttggacctttttccataaaaaagagtgggatcaaagtcgggtagtttgcgagcattaactgaaaattgaccattatgcaaaattcaagcataatggccaatttttggttaagcggaaccaactgacttttggcacacgttttggctctattaaagtcaaaaaactaaaaccactttttaaagaccctttcatctttgaaaagcattttttagttttgtcccactatccttactagcatttagtcacagcaatggaaaagttctcctattcaacaggagcaaccgcacccttgaaatgttgtttaatccatttctgagttgacttggactttaattccttcatgagttttttaatggctggtcgatttttttcatccggtcgaatagcaacaatattactataaggagaggcggagttttccgttgcaatcgcgtccttttgtggatttaaatgcgcttgcaccgcataattagaattaattacttccgcactgccctgtttatttttaagtagctggggcataatttttggttcgtaacccgtcttaaattgcaattgcttaggattctttgcgatgtcactaaattttgccttggttaggtcggtacctttctttaaggtaattaatccggcatcccgaaaaatttgtagcacccggccataatccgaaacgttattgctaaccaaaattttagcatgcttaggcaattcctttaaagaattatattttttagaataaaccgcaatcggctccaagtggaccgccccagcgctcaccaagtgcccgtgattcttttcattccattcttttaaaaaggggccatgttgaaaatagttggcatcaatgttgccgctcgcgagggctttattaggtaaaacgtaatcctgaaaagttttgatatctaattcgacaccctctttttttaatgcgggttggatatgttttagaatttccgtgtggggaaccgccgaagcaccaatcgtgattttttgagtattcgcggatttttttccgcaccctgctaaaagcaagatgattactaagccactaaccaaaaaaattaatttatttcttttcatttaaccactcctaaactaaccgcttatcgattttcttaactaaccaatcgccagtccactgtaatgcaaaaacaaaaagtatgatcaaaacggtggcaactaagataatggctccgttatattgcaaaaaaccattattgtaagccaacgctcccagaccgccggccccgattgcccctgccatagcggtgtatcctactaacgaaatggcggtaaccgttaagccggaaactagcgcgggcatgctttctggaagcaatactttgaaaatgatggtcgattttttggcacccatggcggcagcggcttccaaaactccggaatcaatttctcgaaatgcaatttccaccaatcgcccaaaaaatggtgccgcggctaaaatcagcgatggcaacgccgcggttggtcccacaatggtatgcaccaacacgttagttaccgggattaaaactacaatcaaaataatgtatggaatcgagcgaaatacgtttaccaagaaggataccagccaattgattaggcgaattccccaatttttactgtttcgggtttcaaaaagcagtaggccgattaggagtcccaagaaggcggtaaaaatgaccgccaccaacgttacccaaatcgtttcccaagttgcttgacccatttcattccaatccacggtactaaagtctaagatactactgttcatcactaactacctccgtttccacccttaacttacgtagaaaacttaccgcgccatccaattggctttggggcccggttaattgcacgtacaagcttccaattgaaccttcctgggtccgtttgatatttccagcaatgatgttcagcgccacctctggaaattcatgaaccatttcagaaacgattggcaatttagcttgatcaccgtggaaagttaaccgcaccacccgtccgtttggattctgatcaactaattcatccaaaatcatttcggtatcttgcggagttggatcggtttctgcggtaataaatcgtttggttaatgcttgctgtgggtgtttaaagacgtctaataccgccccatcttcaatgatttttccgccgtcgagaaccgccacttggtcacaaattttacggattacgtgcatttcatgagtaatcaagacgatcgtaatttttcgcttgcgtttaatttctaataacaaatctaaaacttcatccgtagtttcggggtctagtgcactagttgcctcgtctgataaaagaatttccgggtcgttcgccaatgcacgggcgatgcccacccgttgcttttgtccgccagacagctcgctagggtaacgatcttcctttccagtaagccccactagttcgattagttcacgtactttttgctcccgttgcgggcgactaactcccgcaatttctagcggaaacatgatgttagcctttaccgttcgggaccataataggttaaaatgctggaaaatcatcccaattttatgccgctgttgcgctagtgccgcgcccgttagttgattaatgaccacatcattgattttaacttcacccgtggtcggcttttctagtccgtttaacatccgaatcaaagttgtttttcccgcaccggaataaccaatgatgccaaaaatttgaccatttggaatcgctaaattaacatcctcaattgcggttactggccccgtcttggtcgagaaagttttggacacgttcttaaattcaatcatttcagttcctccttcaaacaaaaaaacttccgtccgagaataatgactaagcaccattctcaaggacgaaagtttatcgcgttaccaccttgtttttccacccttctcacgaagggcagactctgcgggtccatcaacccgtgcgctatattgggcgctcccatgatttgctagcaccgggctcacaaatcgctgaaaataaccaaagaccatcttcgataacgttctcgttcctttttcaccacccaaggactctctaagcgtagaaccgtaatctactcatctttttttaataatttgttaatacgctaaagtataccttccaatatcaagccttgtcaacaactaaatcactaaaaaaagaaccctcccggcgaagtacctaagtgcgagcacttccgacggtgcggattctttcaatggcttaattaaaaatcggcattttcttcgatgcttgccttactatacgaatagtaatgatagcgcatcgacattatcaatccaattccaatcatgtttccaattaacgcggaaccaccggcactcacaaatggtagtgggatcccggtcaacggtaaaagtccgatattcattccgatgttttcaaaaacgtggaataaaatcatcatgatgactccggtagctacgtaagcgtaaaactcgtttttggtgtcaaaaattacttgtaaaattttgtaaatcaataagaagtacaaaccaatcagaacaatacttccaatgaatccgaagttttcgccaattacggaaaaaatcatatcggattcccggaccggcacgttaacgttagagacgttgaagcccttgccaaataattgacccgaaccaatcgccttcatgctttgccaaagttgatatccggaattggtagtatccgaagacggatgcaaccagttatctacccgagcaaattggtaactttcaaagccgattttttgcaatagggcttgcccccaaggaagcgccactaacataagcgtcgtactacctaaaactaccattcctacgaaagatgggattaagatccgccaggttaccccagaaacaactaccagcccaataaagattgcaataaacaccaacatggttccaaagtcatgctggagcaacaacaggattggaatcggcaaagtccaaagggccatggtcccaattaaccgccaatctgattgaattgtacgattttttacccggtggttataaaccgtaatcacccgcgccatcatcaaaatgtacgcaggcttcattacctcggacggctgaaaggtaaagcccccaaaggcaaaccaactcttagctccggtatttgcggcgtacgagcgactgtacaagaagagcaccaggatgagcaaaacgatccctgctccgtacgcaattggtgctaaccaccaaagctggtctgcatcaaattgcataagtaccaccacgatgccgactcccaaaaggtaccaaattagttgggagaacacttggcgaaatacgctggtagcactagtatcgtgcgtagcagctacatagatcgatgctagcccaataatggccaacataagtaccggaaagataattccatagtcaatgcgagagctgtcgtctttacgcgctactcgagaatcatttctttccatcgaagtagctcctttctatagcgaatgtaaattaaattcagcgataatccactgaatcccctcatcaattgattttactcgcatttctccgctttggttggaagctacccaattcttatcatttacttgagatatttgtccaatcatccgttggttaacgtaaacttcgttaaccgtagtaccgttattgttagtttctttgacttcaatagcaaactttttttcttttcgtgacattttaactcctattttctttctgcactattttttgaatttctttttaaagaaaattgatcaggcacagggtcgtaaccaccccgtacgaacggattacaccgcaggatccgggcaatccccattaaagtgccctgcaacgcaccaaagcgcttgagcgcccccaccatgtaattagaacacgttggatagtaacggcacgaagggggaaataaaggtgagatcaccctttgatatccgcgaaccagcattaataagaagctcttcattatcgctaaccttctaacgcactaaaaaagttaagttctgaattgccgtaatcaaacctaagaaaaaactagcaacggtgtaacctaacgcaattgaaagcaaaacaattaacatttttgcctgactttcaaaccggcccataaacttatgaaacggaattgcttgaatacaccaaaaagccagtaaaataaagaataaataactaattaacgtaattatggcttgaattcccaatcgctttccctccaaaattcatacatatagtattgtaccagaaaatcaagctaagaataactttttactcacaaaaacagcggttaattcgctccgcaattctgctcaatttgtgaaaatttaccggcccattcccaaaaaaaacgttcagttgtgaggaaaaattcctcataaactgaacgttatcaataataatattaactagctttaatgttttgaaacgttgattcggttaatcgcccgccgcaaatgaatttgtgcacgccgaagctcgctattatcgtgagcttgttgtgctttacggatcgttgcctcagcacgtttcttagcactttcagctcgcgctacgtcaatgtcagcttgattttcagcagtatccgcaacaatcgttgccgtgttatctgaaaactcaacaaaaccaccgttcaccgccactacatcttcagctttgtcatgcttaatgcgcacttcgtcaatcgctaaagttgcaattactggaacgtgattaggtaagattcccaattcaccttctctggtattgactaccagcatggtaacttggtcatcattataaatctgaccatcaggagtaacaatactaactgttaatactgaattttcagccaattagatccctcctaatcttctgtagcagttaatttcttagccttttcaaccacatcgtcaattgaaccaaccaaacggaatgcttcttctgggaggtcatcgtacttaccttcaaggatgcccttgaagccagcgatggtgtcttccaatttgacgtaatgtcctggtaaaccagtaaattgtgccgcaacactaaagtcttgtgacaagaagagttgaatccgccgtgcccgtgcaactacggtcttttcttcgtcagacagttcatccatcccaaggattgagataatatcttgcaattccttgtaacgttggagaacatgttgtacttcactagcaacttcgtaatgttcttcgccaacaatttctgggtccaaagctgtcgatgtggaagctaatggatccaccgcaggataaatcccttgttgggttaagctacgttccaagttggttgtagcatccaagtgagcgaaggtagttgctggcgcagggtcagtatagtcatcggcaggaacgtaaaccgcttgaatcgaggtaactgaacctttcttcgtagaagtaatccgttcttgcaattgacccatttcagtagccaaggttggttggtaaccaacggctgaaggaatccgaccaagtaaggcagaaacttctgaaccagcttgggtaaagcggaaaatgttgtcaatgaataacaacacgtcttgaccttcaacatcacggaagtgttccgcaatcgtcaaaccagtcaaagcaacccgcatccgagccccaggcggctcgttcatttgtccatacaccatggccgtacgttcaagaacgcccgattccttcatttcgaagtacaagtcgttaccttcacgtgtccgttctccaaccccagtaaatactgagataccattatgttcttgtgcaatgttatgaattaattcctgaatcaaaacggttttaccaactccggcaccaccgaagagaccaatcttaccaccccgaatatatggagcaagtaagtcaataactttgatccctgtttcaagaatttctgtacttggattcaattcgtcgtattctggtggatcacgatgaattggatcgcgttttatatctggacctagctctttaccaccatcaattgtttcacccaagacgttgaaaacacgaccaagtgtttcatcaccaactggtactttaattgagtctccagtatcttcaacttccaggccacgttgtagcccttccgttccgtccatagcgatggttcttacgacaccatcacctaactcaagcgttacttcagaaactaaaattgtaccgtctgcttttttaattttcaaagcattattgattgttgggatttcttcgtcaagggggaattcaacgtcgataactggtccgataacttgaacaactttaccagtactcatattgtttaattcctctcgttaatttattcaagtgcggcttgaccaccggtaatttcggtgatttcagtcgtaatagcactttgtctagcgcgattatactgtagctctaaatctgcaattaaatcacttgcattatcagaagcggtgcgcatagctgaagaactagcggcgtgttccgccgtcttagcatccaaaatggcaccgtaaaccaaactctcagcatattgtggcaagatttcttgcaacaatacttcgggagatggttcggtttcatattcagcagtaatcgtttcatgcttaccatcgtttaccaattcttcgccgccaattggcaacaatttagtaacgtggaagctgttcgaaagtcgatttacaaagtgattgtagcaaacgtataattcatcgaattcaccgtctttgtacatcttggtgacggtagtgacgatttcccgaacttcgttaaaagtaggcacgtcgctaaccccgcggtattcgtagccgaccttttgtgggcgattcttgtaaaaatcagccccggtactacctaccgcaagaattatggcatcatcaccgccatcatgaccgtgttctttcatgaaatcgttagtttgcttaatcacactactgttatatgagcccactaacccgcgatcagacgtaataactaagtatccggtctttttcactggccgttgaactaataaatcagctgctgatatagcctgatcagagctagctttgccagccactcccgcattcattaaatgcgatttagccaggtgagcaacaatactctcaactttctgcgcgtacacttgatatccaactgtatgtttctgaatctggcttaacttagccgttgaaaccatttgcatagcagtcgtaatctgactagttttcttagtcgaatcaattcgccgcttaacatcttgttcagatattgccattaattctcaccacttttcctctcgttagctgatatccttatttagcttccttggttggttgaaaatgttctgcaaaagccttgatggctgcatccattttttccgtgtccggaagttgttttgtttcacggatttcatcggtgagctctttgttgttgcttgcaacataatcaaagagttcatcttggaaccgttgaatatcatctactggaaccttatccaagaaaccatgtgtcaaagcgtaaagaatcaacacttggtcttcaacaggaagtggtttgtgtagcggttgcttcaaaacttctaccgtccgacgtccccgagctaatttagcttgggttgccttatccaaatcagaaccaaattgagcaaatgattccaattcacggtaagaagctaagtctagacgcaacgttccagaaactttcttcatcgccttgatttgcgcatccccaccaacccgggaaacggacgtaccagcgtcgatcgctggacgaactccggaatggaagtagtcgctatccaagaagacttgtccatcagtgatggaaattacgttagttggaatgtaagctgaaacgtctccagccttggtttcaacgaatggcaaggcggtcattgaaccaccgcccaagtcatcgcttaacttagctgcccgttctagcaaacgtgagtgggtatagaaaatatccccagggtaagcttcacgcccaggcggccgacgaagaatcaaggagagctcacgataagcgtcagcttgttttgatagatcatcataaacgatcaaaacgtgcttgccgttgtacataaactcttcacccatcgctgcccccgcatatggtgcaaggtatagtaatggagctggttctgaaggacccgcactaaccacgatggtgtaatccatcgcgccataacgccgaagcgtttctacttgggtccgaacagttgattccttttgtccgatcgcaacgtagatacaaatcatatcttcgttcttttggttcaaaattgtatcaattgctaaagcagttttaccagttttccggtccccgataatcaactcacgttgaccacggccaattggtactaacgagtcaatcgccttaataccagtttggagaggttggtcaacggatttccgttgcataacccctggagccttatgttcaactggacgagttttgtcagttttaatggcgcctttaccatcaagcggttcacctaatgggttaacaactcgaccgattaaggcatctcctactggaacttccatgatccgaccagttctcttaacggtgtcgccttcgtgaatttcatcatagttacccatgataacaatcccgacgtcgtttgattcaaggttttgaaccattccgtaaacaccgttagagaattcgagaagttcaccagaaagagcattatctaagccatgagcgcgagcaatcccgtcaccaacgtaggtaactgtacccgtttcttcaacgttaagctcggcttggtagttttctaattgctgtttgattagagcactgatttcctcagccttaatgctcataaaagtttcacctctttacaaatttcgagctaaccaacgaggcgctgtctaatttgattaatttgggtttgaatactaccgtcgtagatcaaaccatctgttttaatgattgcaccgccgataatcgaattatcgacttcactatccaaaataaccttgctaactttcaaacgtttagcaaagttttcagccattttttgaagttgttcatcacttaatggaatggcggaaataactttagcacgaacgactgaagcatcagcatcgcataagcggttaaactcagcgatgattgcggtcaaatcatccattcgaccgtaatcaaaagccattttaattaagttgccaacgtactttgaagcatccttggtcaaaagcgccataattgaacgtttttgatcatccttcaaacccttatcggtcaacattttgcctaatccttcattatcatcaaagatctgttgaatttgctttaattcatctcgaacttgatcaatttggttttgttcagcgaccacgtcaaacaaagctttggagtagcgcttagcaattgtagttttatctaaactcatttactctcacctaaaccttcaatgtacgaatcaatcaattctttttgactattttcatcaagttcttttttgataactttggaagcaatctcaatagataatgacgcaatatcgtcttgtgcactcttgagtgcgtcagcacgttcttgttcaatatcttgtttagccttgtccttcaatgacttcgcttctgcttgagcattgccgacaattagttcacgttccttagcaccactattcttagcattgttaataatggtagttgcttcggcgtgagagttgtctaaggcttccttgcgttgttcagcaagtttttgggcttcctttttagcttgttcagctgattcgatatcattagaaatccgatccgcacgttcttttaacattgcattgaccggaccccaagcaaacttagcaattaatgccattaagaccacaaaaaggatcgcataaaacaacatatcgccaacgtacaaagtactaccttgtgccgctcctaatatcatgtgcgaaaacatctattgacacctccttctttcgataaattgcttaatttatcacgcttacttgttcattacaagaagtgaaataacgaaggctaagattggcatagcttcaaccaaaccaacaccaatgaacatggttgttcttaattgacctgataattcaggttgacgagccataccttcaagcatttttgcgataacgattccgtcaccgataccaccaccaatagcggctccaaacatagcgattccagctgcaatagcacccataatagttgttcctcctacctaaaaatataatattattcgtcttcgaccttatgagaaatataaacggttgtcaacgtaacgaatacgaacgcttgaatactacctaagaatacggaaaatccttgccaaatcaaggcaagtggaatggcgattaccatatttaagatgccaccagagaacgcaattcccccgatcatcttaagtaacatttcaccagcgaaaataacaccgaagatacgtaacccaagggtcaagaaatcaatgaattctgtaaaaacaccaatcggtaaccaaattttaaatggcgacaagtacgttctttcgaagtacgatttgaagccaaattttgccacaccagaatagtgcgctatcatcattgtgatcaacgataatgttaaagtgacaatcggatcagctgtcgggcttcttagatacgtaacatcgttccacgcaatttgtagaaacagcccaagctgattggcaacaaaaatgaataagaacaatgtaaatgcatacaagccgaagttacgggtttccgtttcgtcaactgagctccgcaaaattccatttgtaaaatcaattacccactctaaggcattttgtttaccagtcggctttagttttaaatttcgagaaaatgcaaacacaactgcaaatacaattatggccgcaaccaatcccgaaatgacgtttgccgtactaaatgttagaccaagaaactgaaaagttgaaattgattcaccacccacagaatatcacctcttttctacctaagtgtacctaaatttaccatccaaaaatgataaaaattaagtcaaaaacttgaacaaaagacagtattttccgtccgaaaatacaattgaaatgataccaccaattttgacaaaagacaaagcaatgattaccgatatctacgactttttttatatggtaccgcttcaatttttaaacacacttttttaacgttgaattcttgtcaaattctcaccctaatcgttggacttcaatgccgctaccatgtcgattttttgaagttttcggtgggtaatataaactacggctaggttaaagatgaccattaataaaaccgccaccaaataagcgaatggtttgatagttagcggaaaaattacgttattagtttcggcttgtctaatcacgtaaccagttaaaaggttgcccaagccaaaaccagctaaaataccaattatcgctagaataatactttcccgagctacgtaaaacgtcacttctcgattataaaaccctaaaactttaatagtagaaagttcgtataatcgctccgcaatgttgatattgtttaaattgtaaagtactacaaacgacaggatggctgaaagtccaataaaaatcattacaatcggtcctaactgcttggtcattttttggatcatttctgcttggtcagccattaaactaatgcctaaaattttgtcgttatccgacatccatcgttttgtaagccgtgctgaaggctggtgatcagtcttaactaagacgctcgcaaaatttggcgcgtggccaaacgcacgttgataggcgcttggtgatgcatagataacgttaccggcataatttgtcactaccttagcgattcgaacctggaccgttttttgattaggcacccgtattttaatttggtcgccaacctgtacgtgcaaaattcgagctaccttaggtgaaaccaccactcccctagttggtaaaccaatggaatgattgctctgataatcacgtagccggacaaactggtcaaattgccctggattctttggtacggtcaacgtaacgtcccgcacggtcttttgtcgttggttaacttgtactaccgcggtataaactggcagtgttgctcgagtagccgcgctccgttctaaagaattttggacactagttaaatctttcggttgccgagctcgtactactgcgtcatatcgaagaacgtgttgaaactgctgatttccagcctctttgattgagctcgcaattccaaacccggtcaaaattaaggccgtgccgccagcaattcctaaaatggtcattaatcctcgtagcttagcgcgtgataagttacggtaactaattttttggaagaaccgtagccgccgccataacccgggcacccgttctaaaaagattttatgcgccgcacggggggctcggggccggagtaacgctgctggggtggtgcgaacctctcgaagtgaaactagggttgccgccccaatagttactaacagcgtcaggagcgccgctaaagcaattgcgcgccaatccacaggaattttaacgatttccaccacgtactcctgatacattgctaacacgatccggggaatcaactggttccctagcactgctcccacagctgcaccgctaattccggctaaacctgcgtaggcaacgtattggaaaacaattgcacctttcccatagcccaaagccttaagcgtccccatttgtccgcgctgttcctccaccattcgcgttacggttgtgaaggtgattaagcccgctaataggaagaaaaataacgggaaaacgttggcaattgctgcaatccgttgcgaactttctccgtagcccgtaaaacctggcaggtcttggcgggtttggtaaagtaatgaaggttgaagcgcttgtttaacccgctgcgcttgctgatcaagttgccgacgttgttgctgcaactttgcttcttgacgttgcaaggtgcgcattgtggacgcattcgttaaaccttgctgtttaagcgcttgttgggcagctaccagcttttgtcggctctgtgtcagcttttgttttccttgttcaatttgcgctagtgcagtctttgccaaactttgccgacgttttttaactgccggcgttaagtggcggcgtacttgagcaattttttgttttaccgcccgctgatacttgttagaaaacattttttggttttgcagctccggaaaatatacttgcatcctggagtacacggacgagcggaaagctaaatgggatacgtaagcaaagtaagttactttcccagtacctaaattactcgctcccctagtcgaatggtcaacatattggggagaatccgcaaaacccacgattcggtatttttgatatttcagctggggatttttctctaaattaaagtagtccccaattttataaccctcgcgtagccgggcctgctggtctaaaacaatttcgtgctgattgcgaggaagccgtccctgttttaaaatcaactgattttggtgattatttttttgataaccatacaaggcgattacgtcccgattcttgccaccaagtacattttgcaataaaactccttcaacctgcgctcccggaacctgccgaactgctttaagttcggtttcggtgaagccttggctagataaaatctctagatcacttagatgatgctttactacagtcgcttgcagtgaatcattgagtgccgggccggtcgcctttacccctacaaaaatcagcgtccccagcataatgatcaaactaattgcaatgaagcgccccaaagaattcttaatcgtgcttaacaatagttttatcatctcagccacctaccacttaatttcttcgaccggagcaggctggggattatctacgatgctccggacctgggcatcattaatttgaattacccgatccgccattttcgcaattgctgaattatgggtgataatgatgaccgtctttttaaattttcggctagcatcgtggagcagttgtaaaatttgtttacccgtttgataatccaatgcaccagtcggttcgtcacatagtaatagtttcggattctttgctaaagcacgggcgattgccagccgttgctgctcgccgccagataactgggcaggaaaattatccaaacgttctgccagcccaacatctcttaggacggttaccggatctagtccgtcattgaccagtgcggtagctagttctacgttttcggtagtcgttagatttggaattagattgtaaaattgaaaaataaatccaacgtcgttacgccgatacttcgttaactggcggtcgttaaattgcgcaatgtccgtcccggcaatgttgatgctccccttcgtcgggctgtccatgcccccgagcatatttaaaaccgtggattttcccgccccgctcggtcctaaaatcacggcaatctgcccttgctcaatcgtaaaattcacgtcccggttcgcgacaatttgattgtcccccatttgataaattttaaattcgtgttgtacttcgatgtaagccatacgttcctcctgatttgtaagcgcattctattaaccccatgataaaactattttttctcaattgacaaatcttttcacttaccaaaccgcgcagaaaacaaaaaagagagtgggacaaaagtcgggtagtttgcgagcattaactgaaaattgaccatgatgcctgattttggcatgatggtcaatttttggttaagcggaacaaactgacttttgtcccacgttttggctctattgaagtcaaaacgccaaaataaaaacgattcatgaggaagtttcacctcatgaatcgttttttgtttaaagacttttgtcacagcagcttaaccgttggttataaaatccaacgtacctatttatttagtaccaaacaagcggtcaccggcgtcacctagtccaggaacgatgtaaccatcttcatttagtttttcatctaatgcagctgtataaatatcaatatctggatgagcttcttctaaagcttttaccccttcaggagcggctactagactgcaaaaacgaatgtcccttgcgccacgttttttcaacgcatccaccgccatgattgctgaaccaccggtggcaagcattgggtcaactacgaatacttggcgttcgctaatgtcgcttggcaacttaacaaagtattcggttggctttaaggtctcttcatcgcgatacatcccgatatgaccaatccgagcaacgggtagcaattcagccatcccgtctaccattcccaatcccgcacgtaaaattggcacgatggccacttttttacccgagatttgtttttgaatagattttccgattggtgtttcgatttcaacatcttctaacggcatatcccgtgaaacttcataagccatcaatgttgaaatttcgttaactatttcacgaaactcctttgtactgcaattcttgtctctaattaacgtcaacttatgttgaatcaacgggtggtcgagaacttcaaacttccccatgtctaaactcgctcctttcaaattccttatcaattgtagctaaaaaaccgtaaaaaaactaggtttaatttaagatagtggatattgatccgttaaatcaaacacttcttgtttaatttgggcgagtacttctggttcgtcaacgtggtgaattgcgcgaatgatcagctccgcgaccttgcgactgtccgcttcgttaaagccccgggtagtaacggcgggagtcccaatccgaattcccgaagttttaaatgggcttaacttttcgtcaggaattgcctctttatttagcgtgatataaacggtatctaataagtcttgaatttccttcccgttatgtccggtttgggtcaaatcaaccgtcattaagtgattatcagtcccaccggtaactacgtgcagatctggttcgttttcaaaaacttctgccattgcttgagcatttttgatcacctgagcttgataatccttaaactcggggcgtaaagcttcccctaacgcaactgctttagcagcaattacgtgttctaacggaccaccctggttttgaggaaagactgcgaaattaatttgttttgcgtattttgcttgcgacaaaatcatcccgcctcgaggtccccgaagcgttttgtgggtagtggtagtcactacgtcagcaattcctactggtgacggatgcaatccaacagctactagccccgcaatatgcgccatgtccaccattaagaaggcgcccacttcgtcagcaatttctcggaacttttgccaatcgataatccgactgtatgccgaagcccccgccacgatcatttgtggccgttccttcaaggcaatctgccggatttgttcataatctaaccgttcggtctgcggatcaattccgtaagtcaccgattcatagaatgtgccgctgaaactaaccttggcaccgtgggttaagtgaccgcccgcgttcagatccattccaaggattttatccccgggtttgataaatgcagcgtacgcggctgcgttagcttgggaaccggagtggggctgcacgttggcatattccgcgccaaacagttctttagcccgatcaatggctaattgttctacttggtcaatgtactcgcaaccaccataataacggcgtcctgggtaaccttccgcatacttattagttaaaacgctgccttgcgcagcccggaccgctgccgaaacaatgttttctgaagcaatcaactcaatattatgttgttggcgatcggcttcccgatcaatcgctgcccacaattgcggatcctgttcttggtagttcattggcaatccctcctagttaatttcgtcgaagtaagtattccccgcagatttctgcaaccggttcatataagctgcaccaatcccagtaggatcaaacgcttgcgcaaaaatcaccttaatctgcggattcccatcaaaggtacgcaatccgtcaaagaggtggtgacttgcggttcgcgcatcttctcctaacgaaataaaatcaacgttatcaaaattcatcaacttggtactatcaaaaatggccgacgttgctaataccccaacgggctgttgtgcatgttgggctacccagtccgccacttttgaccactgagcgtccttgacgatgtacacctgggcattcggagcgtagtgcttatacttcattcctggagctttcggcacttcgtccttaccaactttatggtgatcagtttgcacttctcctaagattggggttaaatcctcaggagtaacggcacctggccgtaaaacgcttggtaccgcaccagacatatccaataccgtcgactcaaccccgattttagtttcgccaccatctaaaacgcccgcaattttgccatctaaatcgtgcataacgtgggctggcttagttggactcggctttccagaagtatttgcagatggccccactaatggcactcccgcctgctcgattaacttaagggttaccggggtatctgggttacgaaacgcagcggtcgtcaagcctccagttactactggatccaatgcgtgcggtttgatcggcaaaataatggtaagcggtcctggccaaaaagtatccatcaactgcttactttgggcgtcgatttcggcaaactcggctacctgtgctgggcccgtaacgtgaacaatcaacgggttatctgatggtcggccctttgcttgataaactttctttaccgcatctgggttagtagcatccgctcctaagccatatacggtttcggttggaaatgccaccaattccccgcgctgaattgccgcggctgcgtcagctaaattttcactttgaaatatttcactcattctaaatcaccgatcctccccttacccaaagtatccggtcgtggccacttaagtcttggagcacgtccacgtccttaactccaggcaattcactaaaatattgttttaactttgctccttggtgataaccaaattcacaccatagttggccagcattcgttaaatgattagccagctgtctaccaatttgtttataccaaaacaaaccatcgtctggtgcaaaaagtgccttatctggttcgtattctatcacggattggtccattacgtcccgctcattttcggcaatgtacggcggattgctaacaatgatgtcaaaacgttcccctttaaccgcgtcaaataaggaaccttgccgaaaatcaaccaccgcttcttgctggtgagcattttgctgggcgaccgctagtgcctcactagcaatgtctacggcggtaacttgccaatctggacgttcaagttttaaggtgatggcaatgttgccgctccccgttccaatgtctaaaacccggagcggttggtttaattgagggtgcgcatttaaaatgttttcaactaattcttcagtctccacccgcgggattagcacccgagaatccacgtaaaattcacgcccataaaaattggccttgttagtaatgtactggacgggttccccgttaaccgctcgttgaacgtctttttgaaactgttgccactggtcaagacgtaattgctggcgatagtgtacaagtaattccgtccgattccattccatccggtccatcataatcagttcgggagcattttcatcgccatgatgttcctgaataagcaaagaagcccatttcagggcttcaaaatatgttggattattcatttcgtaaagcttccattttcttagcttgatcgtctaggattaacgcttcaataatttcattaagctccccattcatcacccggtccaacttgttcagcgtcaaaccaatgcggtggtcggtaacccggttttgcgggaagttgtaagtccggatccgttccgaacggtcccccgttccgacggcgttcttccgttcttcattataagcatcttcttcttgggattgatagtagtcgtaaacccgggccttcaaaattcgcatggccttttcccggttttgttgctgagaacgttcatcttgcatcgcaaccacaattccggttggcaagtgggtcatccgcaccgcagaagaagtcttattaatatgctgtccaccagcacctgaagaacggtatacgtcggtacgaatgtccttaggatcaatctcgatatccacgtcttcagcttcgggcattacccccaccgtggcggtagaagtgtgcacccgtccagcggattccgttaccggcactcgttgtacacggtgagcaccgttttcgtatttcaatttagaataaactttgtcacccgaaatcattaaaacgatttccttgaaaccacctacatccgtggcgttttcgtcgacaatttgtactttccagccttgtgattcagcatagcgagtgtacatattgtataaatcagccgcaaacaaactggcttcatctccgccggccgccccgtgaatttccataatgatgtttttatcgtcgttagggtccttaggtaacattaatactttaatttcttcttcaagcttttctttttggtcgcgtaagtccgctagctccgcttttaccaaactatccatttctggatcaagcttttcgcgttgtagttcttcattttccgcgatggaatcaaccactttgcggtattcccggtatttttcgaccgtttcacggatttcgccttcttcttttgataattcttgataacgttgtgaatcagccaacacttccggatccgccaacaattcgcttaattcatcgtagcgatccgcaactgcttgcactttatccataatatccattaattaattcctcatttcttcaattagtgggttaaagtagtgacgccggcaaaccggatagtaagattcatttccgccgatttggacctgttcgccttcgtaaactggtttaccattatgcacccgtaagttcattagcgctttatgtttgcagaaccagcaaatggtcttcatttcgacaatcttatccgcgtataacaaaaggtacttcgaaccttcaaaaagttcgttgcggaagtcgttttttaagccaaaagtcatcacgggaatccctagttcatcaaccaccttggccaattctagtacgtgatgcttctttaaaaactgggcttcatcaatcagcacgcacgccggattcgtttccgcctgtttgattaccgcgtaaatatcggtatcgtcaaaaattggaaatgcatcccggcgtaacccaattcggctggaaatttcgccaactccagaacgggtgtcaatgccactagtcattaaaacaacctgtttgtcctgctcttcgtaattatgagcaacctttaaaatctcaatcgatttgccactattcatggctccataatggaaaaataactgtgccattttgccccactcctaattttattctccaagaaataagtatagctgatataaactaaaaattcatccgctcaaaaataaaatgtagttttttcctcaaacaggggcaacgcaacgtttaaacgcctttttccggtccgaaatattcaaaatcttcctattattactttaacaacccggctttcgaaatttaatatcagacccgcttggctaaatgccggcctaaatatagttaagattttgcacagcccgctactctttgcttttctttttgccaaaatcagcttaaaatattgttttagatgtttgagaagaatcgggaggagtagcatgtcatttagaagttcaattgccaaaatggcgggaaaatcatcgtattggtttttgcatacatttcgttccggaggtagttcactccctggtaaaattactaccaaaatcgaccctacaattttaaaagatctgggccaaaactatgacgtaatcgtcatcacgggaactaacgggaagaccttaacaaccgcacttacggtaaaggttttacgtcaaaaatacgagcacgttttaaccaaccccacgggttctaatatggagcaagggatcgtcaccacttttttgaccgatcaccgttctaaaaacgggaaaaacattgccgttttagaagttgacgaggctaacgtaattaaggtcacccagtatattaaaccgattgcctttgtatttaccaacattttccgggatcaaatggaccggtacggcgaaatttacaccacttaccaaaaaatcttagacggggtcaagttagctccggaagccaccatcattgctaacggcgacatgccaatctttaattcggtggatttaccaaacccgattttatattacggttttaataaccaagcggatggcgaaatgaaagccgatccaaacacggacggcgtagtttgtccgcgttgtgaacacattattcactataaattcattagctatagcaaccagggtaagtactactgccctcactgcggttggcaccggccagaacttaatttccaactaacgcagattactaagttgacacctaactattctaagtttttcatcgacgcgtccaactttaccctgcacatcggtgggttgtacaacgtctacaacgcccttgcggcttactccgtgggtaagttcatgggcgtacccacttcgcaaattcaaaaggcgcttaacgatcctgacgaacgggtctttggccgccaagagcaaattaacgtggatggtaaggaactaaccattgtgctagtgaagaacccggtaggtttaaaccaggtcatcgacatggtggctaccgaaaccgagccgttctcctttgtgggtcttttaaacgccaactatgccgacggaattgatacaagctggatttgggacggtaatttcgaaaaattagcacaaatgaacattcaacaatacatcaccggtggcgagcggtacaaagacattaccttccgtttgaaggtggctggcgtcactgatgaccaactttggacttacgataacttgcccgacgcgattgcaaatattaaacggctccctactacccgggtttacgtttttgcaacctacacggccatgttacaactacgtaagcaactaattagtgatggctatattaaggagggggtttaattatgaaatacgaattaaaagtcgcccatttatatggtgatttgcttaatacctacggggataacggcaatttattagcccttaactactacgctaaaatgatggacactaagttagacatccaaatcgttagccttgacgaccagtttgtcgctaaggattgggacatcgttttcttcggcggcggtcaagattacgaacaaaccatcgtttcccgagacttacaaaataaaaaggcggagctgaccagctatattgaagatggcggtcctcttctagcaatctgtggaggctaccaactccttggtcactattacgtaggcgcaaacggtgaaaaaattagcgggattggtgccttagatcactacacattgagtcaagacgataaccggttcattggcgatatcgtaattaaaaaccaggaaactggcgaaacttaccatggttttgaaaaccacaacggtaaaacttatctaggtaaggacgaacgtcccctaggaaaagtggtcaccggaaacggaaataacggtgaagacgaatcggaaggcgttatctacaaaaatgtttacggttcgtatttccacggcccgattcttactagaaacggaaacctcgccaagcgaattctcctgacagcgttacaccggcgttaccctgatgctgatttaagcgcccaggaagcattaaaaatcgaaccaaccttttaatcaaatattaaaaagagtaggaagagtaaccgcgtgattacctttcctactctttttatttatagttcaatccctatttttactattcttcgccaggttcgctaacgattaattctaagctaccttgataacgccactgcttaactgggttcggtaaaatgaagtgttgccccttcttaattggatagtcttgaccatccaccgtgagcgttccttcaccgtctaacaccgaaactaaggtgtacaaaccttcccggttgaattctgcgctaccatcatgtagttccacccgtttaaccgagaaatacttcgatactggcggttgcacaaaggtggttacttgagcatccccaacttgttcattggtaatgtttaattggggatcgtgatgaggcacgttagtaacgtcgatggactgttgtaagtgtagctctcgtttcttaccagtcgtcttatccacccggtcaaaatcgtacaaccggtaagtggtgtcactgctttgttgggtttctagtaccataatgcccttgcccaacgcatgaatggttccgctaggtacgtagtaaaattcgcccgctttaaccggaactttgcggaataatttatcccatttaccatggttaatccagtcggcaagttcttcgcgagtttgcgcattatgtccgtagtataattcagcccctggttcagctgaaataatgtaccagcattcagtcttgcccaattcatgttcgtgttcggcagcgtaagcatcgtccggatggacctgcacggacaagtcttggttagcatctaaaattttagtcaataaaggaaagacatcgcccttggcattgccaaactgctcgcgatgctggtcccataattgatcgagggtcatccccttaaattcaccgttcgcaattgcggcaggtccgtgtggatgggcagaaattgcccaacattcaccggtatggtcactaggaatatcataaccaaacttagtcttcaaatggtcgccgccccaaattttctcatggaaaaccgggttcaaaaataatggttcgctcatagtttataaaacccctttcattcactcaataataagaataccataaccccttttcatctttaagcccttactttaatttatcttctgccgcaaaagtttgataaatttgttggcgataatccaaaaattctaagttaggttctggataaagccggttggacaacagcactaacgcattttgggtcattcggtcccataagataaacgtcccggtaaatccgctatgccgcaacaccacttggtcagcattgtggcaaacaaacgcccagccccacgagcgttgtaacgctggattagcagtctggttatttaaaaaatcctgctgctggttaatcccaaacagttcgttttggggcgcaagcattttttgggtgaatttaactacgtcagccttggttgcaaacaaccctgccgaggcggcatgtgctcccagggaggcggcttttgggtcatgaacttgtccgcgtaataagacgccatcccgaattcccgtcggcaccgtttggaacggatccgggttgaacgtgctctgggtgagctgccacggcattaaaactaattgctggattgccttttgaactggcagatgggttattttttccgcaatgaagcccagtaaaaggtaattataatcgttgtattcaatttcttggttgaacttcgtcccaaaactaacttgggcgtaaatggcttcgcgcagttgactggcggacaagtcatcccggtgatcaatccacgcggtgactcccgacgtgtgcgttaataagtgccggatggtaacccgggagtccttaatttctggtaagtatgtatttaccgatccatcaagttccaattgtttttccgccgctaaccgcaaaatcagcggcaccgtcccaatcaccttggtcagcgacgctaaatcaaaatagcgtccttcaaccagccggggcgcgtctggtatcccggcctcggttccttgtgttaccgcgtattcaattttcccatgccgaattaacgtatagtctacgccaggaataacttgtcgctcaagcatttccgcaatcaacgcccgtgttttttcaaaactcattttatccccgtccctttccaaactaaatttccccttgaattatatcctactttctacaagaaaaacgtcggagaaaataaaaaggcacttcaagaatctaaaaattcttgaaatgcctttatagtcgttttacgttaacgaagtcaaaacgcatccgaacacgaatcattttggttatgtcggccgcgacctagtttaattttacctgggcaaattaaatcacttcaccactggcaaactgtgaattatataaatcagcgtagaagccattttgggccattaagccgtcatggttaccagtttccacaatctgtccatggttcatgaccacgatattttgcgcatttcggatggtcgaaagtcggtgcgcaaccacgaaactggtccggttcttcaacaatcggttcatcgccttttgaattagcacttcggtccgggtatctaccgaactagttgcttcatccaaaatcaagatgtcagggtctgctaagaacgcgcgggcaatcgttagtaattgtcgctgtccttgcgaaatgttagatgccgcctcatttaagaccgtgtcatagccgtctggtaattggcggatgaagccgtccgcgtgggctgctttggctgctgcgtacatttcttcgtcagtagccccttcccggccatacttaatattttcccgaatggttccggtaaacaaccaggtatcttgcaataccatggcaatgtgtttccgtaactcgttgcgggacatgttacgagtatcttctccatctaaataaatggttccagaattaacgtcgtaaaaacgttctaacaggttaatgatggtagtttttccagctccggttggtccaacaattgcgaccatttcacccggttcaacccgcaagttaaagttacggatcaacggtttgtccggcacgtaacggaaatcaacgtcatcaataattaccttagcacttgtatcaaccttggcaacgtccgtatgggtttcttccatttcaggttgatccagtacttcaaagacccgttctgcagatgccatggtcatttgtaaggtgttggcaatgttggccacttgagtaatcggttgggaaaactgttgtgtgtattgcaggaatgcttgtacgttacctaatgataaccttccgtgagcaacctgaacgccacctaggacggcgaccatcaagtaacccaggttcttaacaaagttcattagcggcataatcaatccgctaataaattgcgccttccaagctgaccgataatacttaacgttttctttttcaaaatcttcaatggccttttgctcgtggttgtaagttttaattaccgtgtgtccggcataagtttcttcaacctgatcgttcattaatcctagatgtttttgttgggacttgaagtaacgttgtgacttaggagcaacgatcgttaccacaatcaaacttaatggaacggtagccacggctactaaagtcaatttccaactaatcgtcagcatcatgtacaaaacaccgacgaattgcaaagcactcgtgaccaactgagtcaaactttgttgcagtgtggaactgatattatccatatcgttagtcatccgactcatgatgtccccgtttgaatgggtatcatagtatgaaatcggtaatttttgcatcttgtctttaaaatcgctccgcaattgggcaactgccttttgcgaaacccgggtcattaccacttgttgaataaagctgaaggctgcggagagtccgtaaagaattcctaccgtaaccaagatttggaagaccttatcaaagttaaccggaaaatgatgaacgggcatccccatcttcattttcatagcgcccttcatcacgcccttaaaaatttcggtagtggcctcccctaaaacttttggtgcccgaatttgcaatagggtggatagggctgcaaggatcaacacgatgatgaagccgaacatccaaggagataaatactttgctaaccgaaccgctgatttccaaaagttctgcggtttttcaattaccccaccgggaccgccatgtcgtccaggacgaggtgcgtttactggttttgttggtttagccatttgcttggtctcctttcttgatttgggaatcaataatttctctataggtttcgttattagccttcaattcagcatgcgttccttgaccaacaacctttccgccgtccaagacgaggattaagtcagcatccgcaaccgttgcaatccgttgggccacgataatcacaatccccttttggatttctgggtcttcgcgtaacgccttccgtaagttagcgtcggtcttaaaatcgagtgctgaaaatgaatcatcaaacacgtaaacttgggcctttttaaccaacgtacgggcaatcgacaaccgttgcttttgcccaccggagaagttatccccgttttgttctacaaaggtatccaatccatcgccgtcccgactaataaattcggttgcttgggctacttccaaggcgtgccaaatttcttcatcggttgcctttggattaccgtaacgcatattttcacgaatcgttcccttgaagagcacggccttttgttgtgcaaaggcaatttgttcgtgcaatgcgtgttggctgagctggcggatatcaactccgtccaactccacctttcctgccgtcacgtcaaacaaccgtggtagtaaactaatcaaggtcgtctttcctgaaccagttcccccaatgattgccacggtatcgccagccttagcttggaaattggcgttgtcaatcgaaaggcgttctgcgccaggataacggaattctacgttcttataagctagcgtagttgcgggttgggctggtaaatccgtcgtggtggtctcgtcagtaacgctgttttgggtttccaaaacttcgttgatccgggctgccgaagcagaagcccgcggaatcattacgaaaaccatcgaaagcatcataaaactcattaaaatttgggtggcgtacgtcatgaaggccactaggttaccaacttccatcgtccgatcggcaattaagtgcgccccgtaccaaacgattccaatgttagttccgctcatgattaacgtcatgattgggaacatgaacgagacgatggtaaataccttaatcccggtacgcatgtaatcatggttggcatcggcaaaccggtcttgttcaaattggtcttggttgaacgcccggattacccgcacaccggttaagccttcccggaaaaccaagttaatccggtcaatctttttctgtaatcctttaaagagcggaaccgcgaagtacattaccaggcccacaaaaattgccagcaccggtaacgcaacgaggaagacgcccgttaattccgattgtttctggtaagccatgaagccggcgcccaccaacataattggcgacatcagcatcattcgtaaaatcattaccactacgttttgaatttgaataacgtcgttagtggtccgggtaattagcgaagcttccccaaaccgttcgaattcatagttagacatgaaggaaatctttttaaataaagaactcctcaacttattgccaaccttttgcgcctgagttgcggcaaaatacacgttcaccgcggccccaattaacccgatcagggaaacgcctaacattttaaatcctgagttccaaatgtagtcgatattgttcttagcgaccccgttattgataatatccgaggtgatgtttggtaaaattaaatcgccaacaatttgaacgactaaaaagacggtgccgattaaaacagctccccagcttaaccgttttttcaatattttccacataaactacttttcctccgttcttcttacgccatattctagccaatccaagttatgttcaatttctttttgcaccatagcaggttcttcatccgtttcatcagcgtggataaaataactagcaaatgcatgaaagaaaatcatcatgatcaactgttgaatcatggcttggtccttttgactggtaacttttaattgatcccagtcgactacctcccgcaattgggaacgcaattcccgcatccgtttggagtggaagacgttaaatccggttccgggatggtgattttcccgggcgcgaatcgaagcgttagctcccaaaaagaaattccggtagaaatcgcggtgttcgcccgcaaggatctcttccaaaaaaacgcccgcgtactttcgcaccgcagcaaaaatgtctccgtgattttggcgaacctcgtcaatgagtctcgcttgaatatcttccaaaatcaaactaaaataatagccatataaatcagcaatatcctcaaaatattggtaaaaactcccccggggaattttagcctctttaatgatattgttgatggagctttcatataaagggtggtgactaaattcacgtcgcgccgccgcgataattcggcgctgcttttcatcctttaaattaaagaaagtttgttttggcatgttgcacctcccaaaaatgacaacttgtcataaacagctattatacactggaatacgcgaattgcaacaactttaaaccgaaaaataaccgttacagaaaggaacttattatggccaccaattctgattctttgtacaatgttttataccggatcgataacaaacctgaaatggcgcggatcaatccgctaggttaccgaaacgttttaaacatgactttcccagatagcacccccgtcgctaatccggaggtttatttcccggataatagtttgctagtggaccgctttgctgatgattttgtggccaaaaacggggcattattggggcggttccttgctaaaactgaagcacttgatcacggacttgattcagtttgggtcaccacttcgcacattgttgaccaacacgaatacatgatcgaactaacttttgaatcttcaccaatgtaaaggacctgagcatatgcaaccccaattcgtaccgatgactaaaaccggatatcaaaagattcaacaagagattgctgatttaaaaaagacccgccccagcttaattaaggcgttagcggacgcccgcgcactgggtgatttatccgaaaatgcagaatatagtgcagccaaacgggatttacgccgaatggaagggcgcttgcggtatctggaacggcaaattaactactccaagattgtggaaaacgcggaccgttctaaaattgacctcggcagcaacgtcactctccgatttttggatgacgatttcaccgtcacttacgaaatcgtgggtaaacacgaagccgacgtggcccagcaaaaagtttcttatcaatctccgctaggcgctgccctactacaccaccaccttcatgacgtggtgacggtcaacgcccccgatgagcaatatcaggtggaaattttagcaattaattaaccatttttcgcttagtttattgacgaaatgcaaaatttagtgtaaattaatatagtaatttgcccgctggtcaaattggttaagacgtcggcctctcaagccggagttacgggttcgatccccgtgcgggtgatttattggccattcgccaaattggtaaggcagcggactctgaatccgtaatttactggttcgaacccagtatggccaatcatttaaaaagctgtcattctcaagatgcgaggatgacagcttttttgtttgatcacaaaaaaatccgttggcattaagcgtgtaaactaaatgccaacggattttattttcgctttctaaaccttccgttcagctcccgcaatttttagctgaacgccaacttgttgacttaacttttctaataacgcctctccgctttccaaagaagggttatcttctgacatgattgcaatggtgcaactgttctcgcccttgcctaagtaaccaatgctgttaacaatccagtgcccgttaggcatctgtttccaaccattctttagccaagcatacttggaacctgctgaaattccccagtcttggtcgtcggcaacgttagccatcaaatttttagtataggcctttgacttatttgagatatagccgttctcgtaaaaaatcttgtttaacaccttaatttggtcacggggggtggtgggtgtcagcgcccacccacttgctaacgcagtcgagttagtcatttttaagttgttaaacaattgtcccaaacctcgcgcgctgccgatatcattgtagatactcgtggccgcattgttatcactattttcaatcatttgtaccgttgcgttttgctctccggtggttaaagcgctggctttttggtgacgctgatgcaacagttctactaaaaggtcggttttaataatacttgccgaagggaaagtagtctgcttggtattagttgcctcataaagctgatggtcccgttttgaatacaccgcaaccgcaacctttgcatttgtgttcgctaaaaacggacgtaattgttcagcaaatcccttagcggtcgctttattgacggctttcttcattggaacttgtgggtttgtcgcgggttgatgcttagccgaaccctttttgtttactgggccgcgttgcgattgtgattgcgcaacttcttggtgtgcgctaacccgtaacatttctaagcccgctacgctagttaccaagaccagaatggttactatcgaataaaatcgcacccaatttagtttcggggaaggcttttgccaattttgattcatttaatctaaactcctactcaataaactttaatactggatcccaagcgcaaaagctactcaagttgttcaatcacccgcacaaatttaagaaacttttgcaaaatttgttcaagaaaagccactgtttttgcatcccgtaaatcaccggcttcattgaaagctgtttttgcattacttagcaaaaactcattgcccggcataacgatcccattgacgtgcggtgcctctaggatctgtttcaggtgcaattgggcgcgggaagtcccttggttataatacgacgccccaatcacccagatcggtttcccatcaaacgggtgtaatttaaacgaaaaccattcaatgaggtttttcatagctgcgggaatggtatggttatgttctggagtggctaaaatcaccccgtctaccgccttaattttttggtttagctcctgtaaaactggggatgcgcttaggtcttggtcctcgttaaatacgggaacttcccgcagatctagtacttcaattgttacgattttttgaaaatgtcgctgtaaatattccactaacattcggttatatgattgttcgccaatcgatccggcaattgccacgagtttcattctatcacaccccttctcgaggactatcatcattttgttgcacaaattgccttaattcggtttcattagcttgatgagcatggtttaactgctgggcaatctctaaaaacgccaaaaaatcggcaaacaaaccatctagctgggcaaccttagtttgatcaattaaatcaccgcgttcatcaaatgcttgtaaagaattccccaacaaaaattcagaactaggcaaaatccgggccttcagttccggtgcgtctaaaatttgccggagctgggcatgcgctcttgaggcgcccaaattaccgtaagaggcagccgtaatcattactggtttatccaaaaaaggatggatgccgtacgaaagccatgctaatgtgctaagtaaaatggccggcaccgcatggtcatattctggggtgccgataatcaccccgtctgcttgggtaattttttctgccatttgctgggctttttggggaatttccctagttgttgtctttttaaaaattggtaaaccagcaatttctagaatttcaatatctgcttgatgtacgtaccgcttctttaaatattgtagtaacatccggttggttgaatgccgtgcgttagtccccactatcgcaacgagttgtttcatttcgctaacctcctccaaattagctttgtctatcaaaccgctttacacttcattaccattatacgactcctaatgtaaacgcttaacccattttttaacgaattcgattcttcataaagttaaccccatttacaaagtttaaaaaacgtggtatcttggtcagcaaataactactaacattgctggggtgccacgcggctgagatcatacccattgaacctgatctaattaggattagcgcagggagcagtgcattagccaagctacatataattgtgtttttactaattttatgtaaccagcggtgtcctgctttgcgggagaccgctttttaactgggctttttaagcagcacccctagctaaaattgattttggaggaattaccatgcaaaataaaaccactttacgactggccatcgctgctttactgatcgccatcgacgtagttacttccccgctttttcggatcgaaggaatggcacccatgtcgagcgtgctaaacgtaatcattggctgtttggtcggccccttttacgcattcgcaatcactttaatgaccggaataattcggatgctcattctgggaattcccccgctcgccttaactggcgcagtatttggtggcgttctttccgccctcttttaccggtggactaaccgggtcggcggcgcttggctaggggaaatcatcggtaccggaattattggctccctgctaagctatccggtcatgattttattcaccggcagtagtaacggcttgtattggttcatttacactccccgtttcctcgctgcgaccctttttggcggcttagtgggcaccattttaactaagattctgcttaaaagtccgcgttttctacgatatcaacagctgtttagcaaattaaaactgtaaataaaaaatcctgaccacaatttttaaattgcgatcaggatttttaaatattagcctagtttaaaattattttaaacgagcgtttaattcttcagtcttgtcttcgtaacctggtttaccaagtaaagcaaacatgttggacttgtatgcttcaacacctggttggttgaatgggttgattccgttcaagtaaccagaaacggcaacggctgcttcaaagaagtaaatcatgtaaccaagcgtgtaagcagtttggtcagggatgttaagcgtcattactggaacgccaccatcgttgtgcgcaagggtaaccccttggtaagctttcttattaacttcgtccattgtccgaccttctaggtaacggagaccatcaaggttttctgcttccttaggaatgtcgatgtcatggtttggcttttcaacgttaattacagtttccatcaagtcgcgacgaccttcttggatgtattgtccaagtgagtgtaaatcagttgagaagtttgctgatgaagggtaaatgcccttttggtccttaccttcggattcacccatcaattgcttccaccattcgccaaagtattgtaacgttggttcgtagttttcaagcaattcggtagtgtaacccttccggtaaaggatgttccgcaatgcggcatacttgtatgcgtcgtttttattaacgtcagcatctgtgtattccttgcttgcgtcttcggcacccttcattaattgatcgatgtcgccaccagctacggcaattggaagtaaaccaactgcagaaagtactgagaaacgtcccccgatgtcatcaggcacaacaaattcttcgtagccttcagcatctgcttcagtcttcaaagcaccttttgcacggtcagttgtagcgtagatccgtttcttagcttcttcttcaccatattttgcaatcaatttttccttcaaaacgcggaaagcaattgcgggttcggtagttgtacccgacttagaaattacgttgatcgagaagtcacggtcaccaatcaagttcaaaacgtctgcaaggtatgtggaactaattgagttaccagcaaaaattacttgaggtgcaccgttacgttgttccttagtcaacatgttgtagaacgtgttgtttaagaaatcaattgcggcacgggctcccaaatatgagccaccaattccgattgcaacaaagacttcggagtcttcgcgaatcttttcagcagccttcttaatccgtgcgaattcttccttatcgtagttagatggtaagtctaaccagccccggaagtcgcttcctgcaccagtacctttgcgaactaattcgtcggcagcggtaaccattggttggatttcagcaagttcattttcatgaacgaaatcagccacgttggaactatcaaatgaaatgtgtgccattttaaataccccttttatttagaattccctactattatacaatagtttgccagactttgaagaactttggacaacttgaagcggttaaattttccttaaacaaattagtgcccgtcagcaagtcactttaaaaattaagtttttctaaagaaaattggtctatatcttttatcggattctacgcaaaaactcctcatatttttatatgattgcataaaaaaagaccgcggattttataatcccagtctgttttcttcatattaagatttctattttaacgttgctagtaacgtttcaccgataataattaaaatcgagccgataattacgaactgcatttcgcgatgggtcttacgttcgcctagtaaccaaattgatccgaaagtagaaattacaattccagcttgtgctaaggagtagctaattgctagtccaactgatggaattgctaagaacatgaagatgttcccgattccccaaatcaaaccagtcgtaatgtttaagaacgttggtttctttgcaatttgatccgtttctttagcaaagaaaacaaataagaaagctccgagcaacattccaactgcttgtgggaaaataattgccttcgcatcaacatttgcaaaacgtacgattaccgtataaccgatgtacccaatcgtcgaaattgtcagcgcttgaattccggctggcatattttcgtcatcattttccgtcgtggaatcactcttatcttttagtgacgttaatgccgcaccaacgattaaagcgattaccgcgatggtaccaaccatgatcatattaccggaagtccattcgtgccaaatcagtacccctgcaagggcgttccctgccaactgtaagccggttgaaattggcactgtcttagaaaccccaatgtgcttcattgaactaaactggttaaattgcccaactgcccaaaaaaggccagaaatcaaaccagcaatccaaatcttaccgtttaacgttggctggtaaatcacgagggtcactaaggagaaaatcaccgcacccatcgtcattcctaacgtttgctgcgacgcactcccgcctaagcggccactcactaaaccaatacttccccacataattgcgggaaccaaagcgagtaaaatattcatatcaatatctcctatatatttatcaatctctgtctctctcataagacaaaatattattgtaccagttatgaaaacgaattccaacattttttttgaaattaaaatggtatacttcattttccatttttttgaaactcgttatgaaaataaccattagatgcattaaaagtaatcgagtagttttatgaaaactcgtataaaattttaaggttttgtgctagaatagaagtgttgcgaagaggagaactctttgtctgtataaaaatattgggaggaaccagttttatgtcatttattaatggtacagaaacatttgcagctgctcgtaagggccactatgctgtaggtgctttcaacacaaacaaccttgaatggactcgtgctattctagcagcaggtcaagaaacacacacaccaatcttgatccaatcatcaatgggtgctgctaagtacatgggtggttacaaagcagttaagcgtcttgttgaaagcgaagtagaatcaatgggcatcaccgttccagttatcatgcacttagaccatggtaactacgaagctgctaaggaagctatcgctgctggatacagctcagttatgtttgacggtcatgaccttgacttcgaagaaaacttggttaagacaaaagaaatcgttgctttggcacatgctcaaggtatttctgttgaagctgaagttggttcaatcggtggtgaagaagacggaatcatcggtgctggtgaattagctgacgttgaagaagctaagacacttgcagctacaggtgttgactaccttgccgttggtattggtaatatccacggtgtttaccctgaaaactggaaaggtttgaacttcgatcgtcttcaagaattagctgacgctatcgacacaccacttgtattgcatggtggttcaggaattcccaaggaacaaattgttaaggcaatttcaatgggtatttcaaaagttaacgttaatactgaacaacaaattgcttggtcagaagctgttcgtaagtactacgaagaagacaatgacaagaagcctaaaggatttgaccctcgtaaagttcttgcttctggtacagaagctatcaagaacactgttaaggaacgtattgaatggttcaatactccttcaatgtggtaaaaataagcctttaattaaaaagcttggcggatttatccgtcaggcttttttctttgtcgcaaaaatcaagctccactgtttaactaaatggcagcaaaaataaaaggcgttgtccaagaacctaaagattctcgccaactccttagtatattgcctttaacgatgtcgcaacgtactctatatttataatccacccccctattgatctgcgggagctttaggaaaatgcagtttaaaggtggttccccggcctggcgcgctcgagacttcaatttcaccgccgtgaatttggactagttcatgcacaatcgccatccctaaaccagattcacctttcgtctggatccgcgaagcatctgctttgtagtaccgttcccaaatatttttaatttgatcctcggtcattccaatcccgttatcactaatttgaatattggttccgttacttgcattctgcgcacgcaccgtaatttggccgttttgggtaaattgaatcccgttttgcacaatgttgaatagaatttgaatcaaccggtcgggatctgcgtacaccaccacgtcactattcatctctactataagctggtcattttccttttccgcctttttgcccagctgttctaccacgcggagaacagcttgcttcaagttaaccatctggcagtctagtttaattttattggtgcgaattcgttcataatctaagttgtcgttaaccaaccgaatcaatcgcttagtttccctttgcatcagtcgaatgctttcttccttactatcttccggaatggcatcgtattctaagccctctaagaggccgttaattgtcgttaacggtgttcgcatttcatgagccgcatccgccataaaagctcgccgtcgttcttcttgacgcttaatttcatcattagattctttaagtgacttagtcattaagttaaaatcggcacttaactcaccaatttcgtcctgtcgaccaggatccagctgcacctcaaaatccccttcggtaactcggtgagccgcctgacgaatcttttgaatccggcgaaccatgtaccgggataggaaataggaagccacgattgctaccaggattgctaagccaaacgtgactaacaagttcttctgtacctgttgaatatcagcctgaacgtttgccaagggagagcctaccgcaatcacacaaattagctttccttgacggtcaaaatacggttttttaagctccgtcatggtgattcgatgttttacctgcccgaccgccattcgggattcttgacgaagaatattgcccttgttcaactcccgccactgttttttactgatttgcgtcgcggtattgtcattaggatagctaacccgttcgccattttccgtataaatggtgaaatgaatgtgctgattgtttaataagcgctccatccccatcaattgatctacccgaacggtcgtcaccgacgaatcttgcgggtcaaggactaccgattgctggaaaatgctatccgcatattcttgcagagaatgccacttagtgcggtaaactgaatcacgtgtaaattgaataaatactaacccaacaattagtagcgtcgccacggttaccgctaagaaggccatcatttgttgaaaaaacaacttcattagttatccctcgtcaattttactatcatcaaatttgtaaccaacgccccaaaccgtttgcactacttgtggacctactgcctcaagtttttgccgaagttttttaatgtgagcatccacggttcgttcatcaccataatactcgtaatcccacaccatttgtaataattgctcccgggagaaaacttgcattggcttttgtgccaaagtttttagtagatcaaattccttcggcgtcaaatctgaaattaattttccatctaggtagacttcgcgggtcgccgtgctaatctttaagtgcgccgtccgcacgtcgaatttaccagcctgttgctccgcattattattgtgcttattcatcaagacccggcgatgtaacgccttaatccttgcaatcagagtaattggactaaatggtttagtaatgtactcatctgctcccatttctaaccctaatacttggtcgctttcagagtctcgagcagtcaacataattagcggcaccgtatgtgaagttcgccgtaattcggccgccacttccattccatcttttcccggtaaatttaagtccaacaaaacaatgtcccactgttgcggatccgccttaaaaatttctaacgccttgactccgtcataagcaaaagtaactttccacttttccttcttgaaaaacatccccatcatatcggaaactgatttattatcttcaatcattaatatctgcattgaaattcctccaatttcatttacatcacccagtatagtctttttaatcgaaaaatttatgaaaaatacggaaaaagacccttagctttagtcgtccccccttttataataacgaaatcaaagacgcaaaaacaccttaaaaaagtcgcttttaacgttcaacgagtggacactcccgccaacttggtagttagaccatgtaaggcttcaattgaagcaaaccgtccgaatacaagcattatcgttaaactactatattagacggcttactaaaccgttctccactgcattttctttttagaatccggacaaaattataaaaagcaaaaaatcctttcaaggacaaaaatttccaaaaaaattattttaccgttttggctttaataacgcccagaattgcgtcaaagggcagtttattccgcttaactaaaaatcgaccattatacccaaattcggcataatgatcgatgttttagctagtgctcacaaactcccctggcttttgtctccctctgcaattattaaatttgctgacgatcatgcttgctctaaaaattaattgacacataatttcgtcataattttcgttagtgattattggttaaatttaattcttaattacgagcgttactattcaaaatagccttgcaccgtttatcaatcgagtaatgctatttcaaaaatcttacaccgtccctaaaaaccccattaccttatctaaaagttgctcggtttcctcgctaggtaaaaatgccctttgtttaattacctttttccattttgtttttggttccaattttctcgaataaaagttaataatatccggcgctaagaacacccgaaactccgcttctccaaactgattaccagtttctttcataattagcgcttgcaaaagcaagtgttcgaatagatcgcaataaactagttgttttttttgctggagttcaaaggagtactgatatttttttatccattctagatccgctaaatgctcatggtggttttcatttacgtgatgacaatataaacctaacgctgtttttgaaaaattccctttttctgggaattttattttcccattcaaaaaccgttcataagacttctcgcgaaaatagtcgtcctccaccgttccatacttttcttttaacttggctaccgcctccgcgtagctattttccaacagcgattcgtagtacgcaagtttaacaccgtattccttatccatccacgcatctcctaacgggttattttaaaattgttttttctgggcacagccagcaaccattactatctcagcattgaagtgccttctttgataaccaggttttcacttctaaacgaaaacagagaccagaatttacgaaattctggtctctgccatggtttgggactattttcccagtttttaacgtataaatatttttattttagtaccaaccttgtgatacccaagcgttcttagcagcactccagctaccgtaacgtgacttaacgtagttgtcagcaacgcgttcttggttagctgcggagtagtcaccatttaagtatgatgaagataattgatacttaccaatgtattgaccgttacgagctgtgtatgaaccacctgattcgcgtgccgcgatccaagctttagcagcagcttcgttgccagttgcgtttgatgagtatgagctattgttgttagttgtgcttgcttgacgaactggagcagccttttgaacaggtgcttggctagtttgtgtttgtgcttgagtttgtgttgtttgtgcttggcttgagccagcagcatttgtgttttgctttacttcaggaagttgttgaacatctttgtttgtagcttgcttgatgtcaccatcgttagtgatcttcaacttttgaccaacgtaaattacgtttacgtcagcaatgttgttagccttagcaatggtgttgtaatcaccgtttaagccaaatgagtaactaatttctgagagtgtatcgccagattttactgtgtaaatttcatcagcgctagcactaccactggtagtaatcatagcagcaccaattgcggcaccagaaagtaatgcgattgacattttagaaattttacttttaattgacatttaattatttctccttatttttaaaaacacttttttcttcttctttgtttcaacatcagtaactttacacgatgattattacagaactattttcaaattctgataaatcactgaaattttgtaaagttaagtaacattttgtaacaaaccgacccgttagccttgctatcattgcttttttacgcttgggttaattgtcaaaaatgaaatattattttttaagatccgatatttatcagcttattctccccaagccgataaaccttgtgcgttataaacgttagttgccatgttgatttgttcagcaactgacattccagcatgttcaccgtgacctagtaattggaacaaaccgtaagctccggaagaagcgttagatacgttagcgttcccgccagattcacgcatgataatttgttgccacttagcagcagaaactcccgtccgggatgccatttcgttagcaactgaagatactgagctgtttccactgtaacttgctgttttagtagaagttgcctttggtgtagcagtcttagcaggagttgcttgcttagtagctgctgcagcattagtatttttatcaacttctggaagcgacttaatttctgacttagtagccttttgaatgcttccgttatccttaattactaatttttgaccaaccgtgatgaagttaacgtctttaatgtggttagcttgcgcgattgcatcgtaattaccgttaaggttaaacgcgtagctgatttctgaaagagtgtcaccagattttacagtgtaaatttcgtccgcatttgcactaccacttgtaattgccgttgcaccgattgctgcacccgcaagtaaagcaatagatagttttgaaaatttacttttgattgacatatagattaaatatctcctttatgtttaaaaaatcatgtccgtgtttctttcgtttcaacaggttattactttaccgaacctatattacaaacatattgggatattttgggaaatagggatattttgtaagattctgtaacattttgtaataaaagctccgtcatcccccaataaattaggattccattctttcagagatatttgcaaaatgaaatattttttttgcaaaaagccttgattctgccttttttctcctaaatccccataaataaaccgttttctgtacaagacttcctaggcggatttttataaaaaacgtggtagagaaccaaaaaagacttcccaagaagctaaaactccttgaaaagtcgttctaatttatcagacgtcacggtattaaaccttgtatccatcgtccatttatattgcattagacggtcgctggctaatcaggtccaccagctaatctaagttttttaaaaaatcttgtgtatcctcgaaacattctttaccagcccagctatccaaatcaaactggtattcatggttaacttttcgttctttaccaaaaaataacgcctgcgtagccactccttcctcacgtaatttatggtatagctcttttccttgggattcaaaagatccattattaccatctgtaataaaaatcggtgggaattgcttattcacgtaattcaccgtggaaaccagccgcccctttgccgaatttttccaatccttgtcgcctaggtatgcccagccgacttgattaacaaaaagtttcgtcatggtatctacgtgctttttatttaccatttgtttaatatcatacggcccacagtataataatccgccaacaatttttacatccctcaaatggtgataatttattgcggtagctagctgatggttatactgcgcagcaattacttgagacgcaatgtgggccccagctgaatcaccaccgaccactactttttgcacatttaattgttttgcatagttacgatgcacgaattgaatggcttcccgcatctggttcacttgggtgggatactggcgatccggagcaagcggatagttaattgatacgacgttatacccatttgccgccattttagtagcccagtaagtggttcccgacttatcgccagcaacaaaggcgcccccgtgcgcccaaataatcgttggtttagtacggttatcctttttatagaaaatatccatggtgtttttagcggattgcgatgaatatctgacatcctttttaatggaaatctgatcccgataactctgatacgcgcgtggcctaattgcagcttcgtcttttgcagcgtgatttaaaaagaagacgaatggtctcggagaaacgttaattgcaataacaatcgctaagccagctcccccaattaagattagtaaatatttgatgatgcgcttaaaaagcttcatgcctactcccctaactttattactgtatcctaaataaattattcaccgttctttggattattaaattacgttgattgttccgtaataacgtagtttttaactctaaaatccatcttatcaaaaactttctttcctatatagcagtctccaacaatatgacgattttttgctaaacaccctttgttgatgtaaatagtcgtcttgacgcaaattaaaaggacttggccatttttaaccaaatcctttaatttttctacctattaaattatttttttagattgtaattatttttcaacgtgagtaccatctgtaatcgcgttataccactaaactcagaactaagactcctgctaagcctactacggaaattaccgtttcgagcatcgtccacgttaggagggtttccttaacggttaaatcaaaatactctttaaacatccaaaatccagaatcattaacatgactagccgctaaactacctgctccaacagaaaggaccatcagtgcgggatcgattcccgctccttgcatcaaaggtagtaccaaacctgccgcggtgagggctgaaacggtagctgatcctagtgccacccgcaaaatcacggcaattagccaacctaaaattaatggtgaaatgcttgaagaagcaaacgccgttttaatggcgtcgcccactcccccgtcaatcaaaacttgcttgaaggcaccgcccccgccaattacgaggagtaacatcgcgattgactttaccgcgtcttctaaagtactcataatctcaccactaggaatgttacggtgataacccattgaccaaattgcgaataataaggaaattaacattgcaatacttggcgaaccgatgaaactaattaagttgtccaagaagtttggatgtgtaggagtgaccccgttgtgaaccaccaggtcataaatcgttgtgatggccatcaaaattactggaaatagcgaggttaacaccgccattccaaaacttggcgtctctgacaacttaaattccttttggggacccaaagcctttaaattacccgtccgttcaaaagcgcttggcaccattttacgtgcaaccttagtaaataaaattcccgcaacgtaaaccgttggaatggccacgataattccgtaaagcagtaccttacccgcgttagcattcaaaactgccgcaattgcggttggtgctggatggggtggtaaaaacccgtgggtaactgataaagccgttgccattggaatccctagcgcgagaactgaaaccccggcttcagtagcgattgcaaacacgattggaactaagagtacaatgccgacttcgaagaacaacgcaatcccaataataaaggaagccactactaccgccatttgcaagaaacgccggccaaacttattaattaaggtatgggcaatgcgataagcaccgcctgcgttggcaactaaccgtcctaacattgccccaaaaccaaagaccagtgctaattcgcccagctgactaccaatcccgttttgaatggtgtccgcgattttacttgcgggcattcccagtcccagtcccacgactactgacgtaacgatcaatgaaacgtatgtgttaaatttaaatttaataattaaagtgagtaataaaataattccaacaattagaactataaactccattgttttcactccttatcagcactaagtaagcggttgcatgctttttcaaaaacacaggagactgaaaagcttcctatttataatagttcattcagtctccagtttttagaatcgcggtgctagtagcttacgattgctactttttaaaatttctgactaaattacggccctaccttggcaattaatcttcttccgcaattcgcgcgtgagggttagggtgtttgcgctggaagtccgcaatgctgtcatattcgcctgctaattcgtccgttaaccggatccaaattggtaatagttcccgataaaccccgaagttttcttggttaggatggtgttggtgtgtaacccccaccattgatttaacggcactgagatcgtcaataattcccaaactcttcattccgattacaaccgctccaagtgctgaactttcaaaactttccggaatgttaacgtcttgctcgaaaatatccgctagcatttgccgccataattcgcttcgcgcaaatccgccggtggcttgaattgatttcggtttccccgcaaccccttcgatcatcagcatgaccatgtaaaggttataaacaattccctctagtgcagcccgaaccatgtgtgctcgggtatgttgccgcgtaagtccaaagaaactgccccgggcgttagcgtcccagatcggtgcccgttcgccacctaagtacgggtggaataataacccgtcagcgccggcgggaatcttagcggcaatgtcagttaaaatttcgtacgagttaacttgcatctgttctgcagtaattttttctggagaaaacagctggtcgcgaacccaccggaaaacaattccgccattatttaccggtccaccaactacccatttgttatcgtcaaggtaataggtgaacaagcgaccacggggatcgactaccgggtggtcaaccactacccgcaccgcgcccgaggtaccaattgtgaccgccaaaacccctggatcaatggcgttcacccctagattacttaaggttccgtcactggctcctaaaataaacggcgtatcgggattgattccggtcacctctgcgtaagaacggtccatcccaactaattgttcttctggggtaactaactcaggaagttgttcccgactgattccaacgatttctagggctaaactgtcccaatccttttcaaaaatgttaaacaaaccggttgcgttggctagtgaataatcttgaacgtatttgccgtataagcggaataatacgtagtccttaatgccaataaaatgcttagcttttttaaataattctggttgatctttttttaaccaaagtaacttaaccattggcgacattggatgggtaggcaccccggtgcgtgcgtataacttagcacctaagccgttttccttaagttcttcagcttcccggctagcccggttgtctgcccaggtaatcacccgggttaacggttggtcgttttgatccattaaaattaaactgtgcatcgcactggaaaatgagaccccggcaatttggtcagccgcaacccgacttttccgcattacttccgtcaagccactgattaccgcgtcaaaaatttcttccggatcctcttccgccatgtccggagtttcttgatacaaaggatatggattattagcgtacgcaatcgattttccctttaaatcaaataaaactaccttggtactggtggtccccaaatcaacaccaatcatgtacttcatctgtttcatcccctatttttcctgatggtcaactgcatgaccgccgaattcatttcgtaatgccgcaactacctttccggtcatcgtatcatctttttccgaacggtaacgcatcatcaatgcactcgaaattaccggagtaggcacccgtagccgtaatgcttcttgtaccgtccatgctccttcaccagagctatgcattacacccttaatttcatctaagttagcatctttactaaaagcatcttgggctagttccataagccagctccggaccaccgaaccgtggttccaaactttagcaaccgcttcgttatcatagtcaaattgactttcactcaaaacttcgaaaccttccccaattgcttgcatcatgccgtattcaattccattatgcaccatctttaaataatgtcctgaacctgctttaccggtgtacaagtagccatcttcagcggcaatcgctttaaacaggggttcaattcgagcaaagattgcttgaggtcccccaatcataaagttaccattttgccgggccccagctttaccacctgaggttccaacatcaaagaagtgaattccccgttcctttaaaatttccgcgtgacgaattgaatcttggtaaaacgaatttccaccgtcaattaccacgtcgtcttcgtctagcaactcactgagttctttaattgtatcgtcagtgggtttgccagctggtagcattgaccaaacgattcggggctgcgttagtccctttactaaagattgaagatcggtaaccgtcttgatttgggccttggttgccgcttggcgcgcctcggcaaatagatcaaaagcaaccacctcaatttggtggtcacgcatattcttagctaagttaagtcccatcttgcctaaaccgattaatccaatttccataataacccctcgcttatcttcgtataattaattccatatccattctatgaaaatattttacataaatcaagcgctttcatgaaattatttttctgagctagatttagtgatatactgaacataagtaaacttgatgggagtatctacacaatgtcaaattttgcgttacgtattcaggcgtgccaaagcaacttcagcgataaagaacgccaattagcaacgtttcttttaaagaatcaaagtcaaattagtcacgccaccatttctgaactaagtcaaaaaactgcgatttctaccgcgaccatttcacgcttcgctaaaaatttggggtttaaaaattttcaggagctaaagttaagtctcgctcagaccgaaaattccgataacctttttgcagagattagtcctagtgattcgccagtcaccgttgccgaaaaggtttttgcggctaacgcagatgctttaaaagccacggtgaaatcccttagcgaagctgacttagaaacctgcgttcaactcttattagacgcccagcaggtgggcatttttggcctgggagctagtaacattgttgccctggatggctatcataaattcctgcgaaccccgctagacgtggtttacgcaaatgattttcatatgcaaattatggcagcaactcgtctaactgctaaggacgtaatgcttttgatttcgcattcgggcgaagaccgggatgcgattgccttagctaaattagcgttgcaacaccaagttcccttaattttaatcaccagttctgccaacgcaaccctagctaaaatggcggacgttaccctaatttcggttgctgaagaagcgctataccgctccgaagctcttcacgcactaattgcgcagatgagtatcgtggacgccctctttatgtcggtagcaatcaagaccaaccataaaattgctttgaaaattcaccaagaaattaaaaaaactcgtaaaaatgacccgttgttttaaaaccaaaagaaagtggaacaaaggacgagtaatttatgagcattaactaaaaattgaccaccatgcctaaattaggcgtgatggtcaattttaggttacgcggaacaaactgacttttggtacacgttttggctctcctgaagttaaatcaccaaaacaactttttaaaaatcttttcatccttgaaaaacattctttagtttttcctagccgctcaagaactttgaaacaaaaaaattagcgttttttagtcgaggcgtaatccttcaagcgccttaaccagcatttcacgatccgccttcttaaagaacttaaattggcttgcttctagttcgttaaattcttcaattaacatgtacgccgttaagtaacgctttagtgcgtccttgcttgcgcgaacatcatcggggttatctaacttagagccgctgattactgccaaagcgaattcattcgggttaatcttaatttttttctcagccatccttcattctccttaacgtatatatttgtgtctccggtattatattccttagtttctcacttttcaagtaaccaaaaaaatgagtgggccttcctcactaactaaggattgcaccactcattaatttatcgtttaggttcgactttggaaacgtctaagcctagatcaagcattttttggtaatcttcactacttactactacgcgttgaacgtagtcaatatgattttccatgattagtttaagatttccctttacttgcccaccttcaaaagccggttcttccagataaagtgtatttttagactggatgtttttcagagcatctaattcaacacctaaataagtaattccaacttcgtcttcaggcttaacaattttagcaacttgtgcagcttgaaattgcgccatgttatcgtacttttcaataatttttttagttttgggattttctaccgtaataaagttaatttccccttcataaaaataaaaccgtaaacgaacgtcaccattatcatcaaagaaatcaatttcttgcactttatccttataatagaacaagttactaaagagttttccgtcaaaagtgtactcctctaccatatcccgagtaccatcttcattaaaaaatttgatatcttgaactaaacgacgtgaacgagggaaagtccgcatttctccgaatgtaaccccatctttaatgagggtaattacaccatcatggttcataaaaatttcagcaccatctactgtatgcactttgtcgaagaatagagaattattttcgtcgtacgtccttttggtaacataatcaacgatgttaatcatctttggatattcttctttttttaaacgaacgaaaaatggctccggtaataaagtaattaaggtgctgttattcttttccgcacgttccttttgagatttccaattatccgttcctggtcgtaaaatacttactaactcatagttcattaatcaaattcctccatttatcagcaatcacatgatcacggtaattatcaacagatttatagatatcatctttcatttcagaaatgtcacgttccattaatttttggatacccttttctaattgactaacatcaaattcgtgatcttcccgcttaaaggtcatcaagtaaccattctttccatcttgaattaattctagagaaccaaagcgtgcagcaaaggtaacaactggtagtcctgcattcaatgcttcaatataagttaatccaaacccttcagagaaggacgctgaaacaaaggcatcatatttaggataaactttatcggcatgatgcgttaagcctcgtaatttaatatatttcttagcttgaactttttcgattaattctttcagcttcttctcttcttcaccggcgccataaatatctaaactaactttatgaccttgcttatgtaagttagctaccgctttaacgactaaatcgatatgcttttcagaagctagccgggagatcgtaactaatttaaagcctttatgtggggttgacttaatctgtttagtttcatcatcaatgccgccaaccggaatcgttacaatttctttttctttatttggaaaatcgactaataaatcttttcgctgtagttcagtagaaaccactatccggtcaattcgatctaaatgactaagggaatactcgtagtaattgttccaaaatggtgccttaggatcatcacgatcagctaagtggtcggcatgtacaatttctaccaatttccgatttacgttcggtacgtcttcatccattaaagcaacctcattcatttccccacggtccaagacaaaaacattttttcccgaataaaggcgttcaatttgatgaaaaaaatatctccgtaattgtactagattggggaaaaataattcttcaggctggttatataaatgaatgtttttaattacaaaactccggtcgtcgtgtggattagcaagaaattcaaacgcaactttccgcaagttagtttccgtatcaaataattctacacggtcaacgctaaccagtagtgctggatttttcttaggattaggatattttacatagtgtcgaacaatccttactcctgctgaagtaactttattttccatacgaaaagtattagtcccatcaatcacggtctcactgctcaactttgttcgcttctttaacccgtttaatgcataatcatcaccatgaacaaagtattcccaaatattaattacttgatcatcacgcagattccatttgtccattgcttcatgtaagttatcaactagtgccataaaaataaatttataatctaaattggcttggtcaaaacgttttgcccgataaaattgggcatgttcaactcccgaattaccaattcccattgcttcattaacaaaaaaattcatgtttttcctccagatgtggttctaaaaatttaaattactttaacgccggtagaaatgcaggatttttgctagctccatagttgtgtaattttctagtttaatcaaactttcttctggttctgatagtgagatggtatctggtgataaggcatcaaaagcaagctttctttccttaaccactttttcaagcgacttagttgcatgagcaattgcatcatgcagctgtcctttttgccaattagccctactatcgtactctacaaaaattcgcaaaacattctgcttccctaaataagatcctgaatacaacagtcttctacgtaaatatacttctactttttcaaagaaatgatcccgttggtcccataaacaaataacattcatattgccatcaatcgttgcaatctcaaaagtactttctactggtttgattattaaatcttcaaactccaacgaacgattatttaaattgaccaaacttaattggtaatgatccatctcttcagggacttcaaactcgccatctaagtcaattgttaatggtccatcaataatttcattctttacatcaaaaaagtctagttgaacttgaaccgaattttccggtgctattgttgccttagtaataatttgatatttagcttttcgtttcaacaagggcaactgagaatatcctgtatctagtttgtcgaaaacaacttgcgatttccaagtatggatacgttcaccaggactcattctttcattcttaaaatagattttcccattttgataattaatcactgagccatagctatacgtattattcatatgaactggccatctaattacaaagtaattactcttcatcttcgtcatcctcctgcggactaaagtctcgaccgtagttggtttcaagaatatttcgatattgatttataaaccagctactaagggctccagactgatcattatgccttccagtaaagcccttgtggataatccgagaggttggtgaatgttttcgtaaaaaacgatccagtttttcaaatgcatctccgtcataatcgtcgtctttcatataaacgattacaaaatttgtttttgaatgatcatgcttggtaaacgaatcccaaaaaatatcattcgcttgcttaatatttttatccgcaattccaccagttagtcttaacactacatccaaagaagttggaaatccaccagggcgattaatacgctcattagcggcaatgtcccctaaactagttagtggtttaccaacaattacccaatccgggttaaggaatgatgaataatataagctagcgaaagtccccatcgacaatcctgaaaggattagttcgtttggtttaaatcccagtttctttaaagttgtctgaattaacttaataatttggctttccagttttttaccaccaacgtaaaacgaaccccctaggatacgaaaatcttcaatcaaaagagtcggcccttttaatcctcgcatcatgaacatcccttctactccggggttaaaccgaaaaccagaaaagtaaaccatcaatggtggtttaaaatcacctggatcaaagtagtggtacaagggttcccccattgcttcgtcgtcgatctccacatcttcaccaattaacaaggttcctcgaccaccacggctttcgttaagggtaattgctcccattgttaaatcaacattttgacctttaactagtaattcaactaggatgaaagcaccgttatgatcaacttttagcggaattaaattatttaaatcatcgttatccacctctgttgaatagtagatttcactagtaaatgcacttattagcgaaactcttaaacgtacattagttgtgggcgtatttctcttaaattcggttcgtatttcccaaattgagtttttagctacccccaagggacctccccaattagctactcgttgatagtccttaatgtcattatctatgatttctaaataattgtgtcccaattgttttacagtgcccttaaaaaaagagtcaaattggatattatcaaatttatatttataacctaattggtcgttataaaattcttcattaagctgctttgctaaatcctgttcactttcaaagtcaataaattgaacattctttaggaaaaaggcttgcttggcttcttcgctcagctgaagcctgctatcgatgataatgttgttagccggcagttgtctcaagaaagaactttgaccagattgtaaatattccgattgagtaataaaaaacaaatcatggcgaaaaactagatttagttcccctttaataagtaatttatttttctcttctccaattggttgatctgcaaactcaaacgggacatcgaaaatatcgaactttccctcaattaactctgctaatccttcaatttcgggacccagatgtataattttacctttgctcataacgcatccttctctcccaccaatcggattggcgtccaaattctaattgttccatatacttagcagtattcaccaacgcaatattccaattacctaattttcctaagtaaaaatcaagcccttctgtcaaactgtgcccttctttaacaatccatccattctcgcaatgaattacgaatggactctcaaccttaataatttgcggtatcccagcactaatagcattaaattgcgttctagtatcatagggttctcccatatccactacaatccgggccctagccaagtcagcaaaaatttggtaatcacgagaccctacccgaaatagaacgttggacataacttcaacaaattgttcccaatcgattctttgactttcgggaatttcatctaccgttatcgtcacttctccatccttgattggatgattaatttcccaggctttccatagtcgaagttttacccgatatatcagtttttgcatttcttttccattgttttcgttgaacataatcttatttatgattttccagtctttttcaccatccagaaagtcataacggtttaataatttctgcagaactattgaaaacacctgatcagccatttcattgttaagtgttgaaattattaagccagtactctcatgttttaggtaatagtctaataattcatcacttgcgtcacgaacactttgggcttcatttgtatcaccaatattccagtaaataattagttttcgttcttcattactgttacctaaacgcatatctgcaccataaggataacctaaatctagatgtgctctacacaattcattaacttcaagttgaaattgctcgaatattgcataattagggattacaaaactgctgcatccctccatttgtgggaccagttcttgaatatctgctgaactaatttttccagggtgatctaataaataagtaattggtatttgtttttgcatctttatcattaatgaacgcattcttttattactactagcaattaccccatccgtacgttcatcaaattctttagcaaactttttgctaatgaattccatgagcaaatcatctaaactatcatattcagcgcggtcaaaattactgtaattacttaaaatttttaccgttacttcagcctgtggctcatagcgtagaatacattgtccgacttcgttgaaccaaatctgctttatcaaacggtcatccttaaaatatttggttgcagctttaaaaccccggtcatcatatatgtcgacatgataaatatcatcatctaaatactccactgcttgaataaagccctgttcattgccaatcactcgtgccgccaacttattcccacgataccccacaactgaacgagttccttgggctgtacgaatatcggcaggccactccaaactttccgggccaagaggcatgccgtcggttcgttcaatgtttagaattgcatcccacagattccaaaacggaaggttagttagcccgtttacgtgtaaaatataccttaaattaggtaagaaatttaacactaataatttcaccggtttgtcgccatcaactaacaaactcattacattttttaatgggtcgcgatttaattcctcaatattatttgtccatgctggggcaatataaaacattcgcttaactccttatcacttacaaaagatcatattgggttcttaagtacattgtcttcaattgatctaacgtagtatccataatcgttactaaaatcaatatgctggcatatgcaaacgtaaagttagtaacccccggtacgtataatccaattatcagcggagtggcaactactactaaaaagtaaccgttagccgctgtacttaatctcaccacatgatgattcaaatatctttgtgtgtcttttcctggagtaatcccaaaaatataatctccagatttttttaaattctctgcctgtcgttctgtttgaagattcataaaactaaatgcataacttaagaacacaacaactccacaataaatcgtaattcctacggggttattaaagttaatatatgcttgagtaaacctactaaacccactatcgggactaaagttagcaatataactaggaatcataaataccgtggtggtaaacataaagggcatgcttcctgaggttagaaaacgaattggcaaatacgattcggaaaaatcattctgaacattaggtctctgtaatgggattcttaattctgccttattgaaaaatactgtggcgacaaaaaccactaacaccgagattcctaaagctatccataaattagtcgaaaacgatgttatttgattagtacctagccctggccctcgaaaaaccatcaatggtaaattagtaataataccaggcataattaggacaccagcgcctcctactccaaacttagccgtcatatctgacatccaagcaacaatcattgcaccggcaaccaagatcataaaagacactactaaattaaaatcaaaaccaaaaattttgtcacctgcgagagtaatattttttctgattgcaaaaataaattgcagagtttgcaatattgcaattattaatgttatccaccgctgaataaaccctcttttctggtcgctaatcttgctcattgcatcaacattaatcaattgaattgcttggaacaagatcattccagtcatgtatggacccagtccaatcgaaaacagcgatggaaacctagactgcccaccagtaagcatagtaacgtttctcaatagtggcgaagcattaagtgctttacgacttaagtcagaatccaaagccggaatagcaatttgtcgacccagctccattaaaacaatcataaacagcgtaaacatgatgctagcaattaactcgtttttttcacttctttttctcatggaaattccaccctaattgattcattttttccaacaattaaatctgacagtagcatatatttaattgtattctgccaaaacgcttttctcatttgcctaaacgaattcatagcctctttttcatattcaaatattggattatgttggcctgtagaacgactacttaccacagtttttagctgtgataaattgtctacctgttcaatccaagccacatccagcgctttcaaaattgataaccgctttaaatagttctgcttaaattcattattgagaattaatttttggtcttcccatttctgttttgcaacttttaaaacgtattgttcaacttgttctgggtcctctagaatttttgagtcaaattgctcgtcgctataattgtaatctaggttattaattataaaatcgcttagtttatctcttgtaatacccttaccgctcgaatatagtttaaaaaagtcatcccaaattctttaggtaatctcacctaaatccccattagccatcacgtagtcacgaaaatcgtaaatcatttcgcgttggatccgtaaaatatcgtccattttaacggaactcttacgcgctgattcagcctttgtatctgcagcttgttgggcgcgttccacgatgtttttagcacgtcgtcctcttaggggctccccatacttgcgttttccttctttaagggcctgggctagccgcatccgatacttatctacccagtcaggggcattctcaataaccactttatcttcaagagaaaccaaaaaaatactctctccaggatctccttgtcgccctgcacgaccacgtaactgatcgtccactcgtcgactattcattcgttccgttccgattactaacaaaccacccttttctttcacaccagggccgagcttgatatcagtaccgcgacctgccattgaagttgccacagtaattgctccagcttggccagcatcagcaacgatcatagcttctttagattcactttgcgcatttaaaacgttatggacaatcccatttttcaataaaactcttgagtaaagtctcgacaacgataacgaaccagtttttagtagaactggccgttgaacttcgtatgcttttttaaccagcttcacagtagcttcgattttttcatccatagtggcataaacgatgtctggtcggtcaattcggatgttaggcttatgtgtgggaacctttaaaaccggtaagttataaacatccatgaattctcgtgcggatgtaaccgcagttccggtcatcccagaaagttttttaaacattttaaagaaattctgtaaagtgattgaagccattgctcgagtttgctcagtaagtggaacttcctccttggcttccattgcttgatggatcccggattcccgtttcattccagtcaatgctcgtccattttcactgtctaacagcagcacttcatcatctacaacaacataatcttgattacgctttatcgtataattagcttgcaacgctaacactaaatgacgatacaaatcagaccatcttttggaaactaggttagttatccctaaatactcctccaggtgtttaatgccctcctttgtaaaccatacgctcgttaaatcttcactaaactcataatccttatctttttgtaaactttttacaatacgatccgttgagttaaaaagattagattgtactcgaggagaacctgaaattactagcggagtttgcgcagcatcaagtaacactgaatctacttcatcaactagtgcaaaatttaaatcattaagtttcttatccgtggcgttttctacaagattgtcagttaagtagtcaaaacctagtgcactattggttgtatagactatgtcattattgtaaatagcttgcatgtctaattcttcttcatcagggctcactcccgcagcactagtcagtcccatccaatggtacactttaccaatttcttcggcatctcggttagctaagtatccgttgaccgtaactaaaaaatttcctggaccagtcaacccattcaaatacatcggcatcgttgcagttaaagttttaccttctccggtgttcatctgagcaaccattccatagtgaaggatcaccccacctaacacctgattttcaaaaggctttaaccctaagattcggtagtcggcctcacgaattgtggcgtatgcctcaaccaaaatcgattctaagcttgctccttctgctaatttttccctaaatagaatggtttttgcttgtaattgttcgtccgtcaactgttgatattctttgtctaaagctaaaatttttttagtgattttcgaatactttctaagtcgaaagtcattaaaatcgaatctcatctgtctacctctattctttatcgtacatcaaatgtaccacaatgcataaattttttatagccactatgttacacaggattaatttttaacttttttaattatcctatttacttttaagaaaaaaattgtttaaatagcatcaagagcaactcacaataaaaggaggtctttatcattaataattcatctaatcaaaaaagccacctacttgaaaaagatatcgaaaaaagggtctcgtatgaaaaggatattcaaactcctccacattcacgaaacaaatctcatactaatgcaccggaaaaagttatctctatcgttttctttctaattattttgagtaacttagtttacatgggagtttccttcatgaatcactaatcgctaagctaagttccacttacaaaccactcttagttagtggcttttttattactacttaagtcttctacgcaaatcaataaacgtttctataaattaacattcttaaattatattaccctttaatgttacacccgtgattaagatcttctgtctctaattttaaaaaaaagacataaaatagaaaactaattttcattaacatctaaatctctcctcttgaattactttgttaagcaaaaatagctttaaaattattggcatctacgctagttaattttaaagctatctgattctaatactattaatgcaatagctaacctaattcatatcgtccactaaattgtttttgtagtactgcctgaaatatttcttcttcagccctattatcttcagaattaagtagatgctgattattttccatcaaaacagaacttagcaattctaagatgcacgctcgattgcctgccaaataagctattgatgaaggtccacaatccttgctaattaataattgatgattccatggtaatttaacttctagttttcctgtattgctaataataattttttgtaactgaggatgttggataatatattcaaaagtatcactaaaaaagttgtatgaagcgacttgatgatcacttattttaatattaaaacccatccgacttaaatcgtggattaaatctaaggttacaaatttacgagatgttataaacacttgagtgccacctaaaaaggacggatgaaacttccgcttgttagtgcttttctcacaaactaacgcgtcaccctttgcttcaccagttaaaaaaattctttgaatgccattaatccattctatcggtatatcaactcgttgattttcgtttccatttttatctagaatgacgattttctgtttttcttcatcaaagtcccacatcgaatattcgttaggcctaaaagggactttccctgggaaaagtattcttccatcttctccaaactgaatcaaaaaatacgctcgaagagagcccttcttaaggaatatcgctacagaatcgtttttttcggtataatgccggtattcccaataacggtcgcaaattaattcttttaccgattttttatccactgccgagagcctcacttatgcttgaaccaagcactacttacttcttgatgcccattaaaaatagtactaacctcacgcccgtgaattaagcggttactaaagtaacggtatgccacgtaattagaaatcagcatctcaaattttcctaatcgataagaatcatcgccctgcttgatttttacctctgcctcggtaattaacttaaccataattcctaaatattcaattaacacatcgcgagttcccaccattattcctaaatttagaattggtaaatcgttattttcccaaataaaatccttcatatatgttggggcatcactattgataatgattgcagtattaaataatgagctggtttcatcgccaatataaagaattccttctcggacgctatcaaaagggtaattgagcattgtcacatcacccgcatctgttaacgcggccttttcaatttcgggatgatcctttagaaagtcaaaagccattagaatcctataaaaatacaaagtcaaatctggataatgctcaaataaatcaacatgagtaattgttagccccttctctaaattttcctgacctggtccgttcgttaatacataataagggactttaaaattcgctaaagcgtctgcctgttttttcactttttcagaaatatctattttactattgtctttgtgatacagatcatcagtcatgttgacgatgaattcacttatcaccacatttggttcaactttcatgtaaaactccctcatttatacttcggcttcaaaattgtaacggccgttaaaattccatctcgttaattataacttctatatagtgaattgtccacgccaccaataagaaatccatttttttaatacaaaaatgtactttattacttgcaaacccaattttttatcttgtaataataaccatgtattttctactaaaaaaagccaggaaagtttgtcaactttcctggcttgattaatcgttattacccttggtaaccaatcgtcatcccgataattaaaataattaaaacaattgtcgtaatcgctacgtacagtcgatccccttccttagcaaaggcgtagattgacaccacgacccgcaagacgggggttaaaattagtaaaaagattcccaacattaaaactgcgtaaggctttaattgcatagctccttggaaaatcactcccaaacgggttggtaaggcaccagcataacccgaaccgttttttactaaccataaaccgattccgcagataatgacgattgcggaaatataaacccctacttgtaaaatacggccaatcaataattcgacgtgattcatttctttttgtttagcgttcatctaaaagttcaccccaaatccttttaaaaccatttgtaagcccatgtatagcaataccggaatgaagattaaccgaatccaccggggacgcaggcgttgcataattcggcttcctaattgggcaccaaataaaattccaattgctaaagggcccgcaatgtcagcatgaatcgagccgttgaagaagtaaaccatcgcactagctgcagcggtaacccccatcattaagttgctagtggcgctggaaggttttaacggcatcttcatgatgttatccatcgccatcaccttaaacgcaccgcttccgattcctaaaagtccgctagctaatccagcgccaaacatcactgccgaacctcctggaacattttccacttggtaattaatttgtttttgcagcgccttatcgtagtaactgccgctaaggttaagtcggttagctaaacgatcgttctttgcgctaccctcttcactacccccttgacggagctttcggtacatattccaactcgaaaaaacgagaaatgagccaaacagtacgtagaggaccgtcgaattaaaaatcccggtcataatcgcccccacaatcgctccgactgtggtcgcaatttccaaaaacattgctacccgcaaattaagcatctcgtcctttaagtaggcaatggtagcacctgaactagtcgcaattacggcgatgatacttgcaccaattgcgtatttaatatcgagtcccatcccaatggtcaagaccggggtgataatcatcccgcccccaattccaaggatggcgccaaacactccggccaatagaccgaccagcagtaaaataattaaatgacttgccatagatcaaattctccttctaacttaattaagtttttaaaactccacgattcttaactagtattttaatctaaaaaacaaaagaggttgggaaaaatttcccaacctctccatgttaattcttaattttgtttgggctaatcgtgcgtcccttaaattgttaatatctatttatcttcttgggtagcaggatcagcggaactacttcctgaatgactgctatcttccgaagaactgttgcttgaagaactcgaactagccgccttatcttcattttctggtaattccggtgcatcggttacgtaatcgtcaaccgtggaccggccgtgattttgttcgagcaaactagtcttggatttttgcgccttcttcagattcttcaaggccgtcttcttagtgtagctgtaatccgccttattgaccttcttaaaccagtctaagtctgcaaagcgcagcaaatcaccattaatgatccggtcggaataattcaactcgttattaacgtactgttgaatttgtttaacctcccgtttttgactagccgtttcgtcagtaatctgttccccagtagccgtgtagtacaaatcgccaccgtacttggtgtacttcttagaaacgaaatctccgtttcggaacgccacaatttggttatactgtttagaattaatgtcgtgcccaaattgataagcccctggcgtatcaattcctaagaggttcaatagggttggcatcacgtcaatttcaccactgtaattgtggttgacgcctccctttagacccggagcatgaatcatgaacggtaccttttggaacattgccaaatcataattagtaaccccttttagacctaaaatcttggcaattgcgggtttatgattgtttgaaattccataatgatcaccgtacatcatgatcaaactcttgtcgtaaagtccggtcttcttcaagtaactaattaattccccaaccgcttggtcaaggtaatgggccgtttgaacatatggatccacggttgaatcccccgtctcccacggatcaatagaaacatttttcttttcgattccgtaagggtagtggttagaaaccgtgattaattttgcatagaacggctgtggaagctcttcaaggaatttcgcggactgttgtaagaacaacttatccttcattccatatccacttacgtatcccttcttcaacgagtagtattgcttactgaagaagtactggtaaccaaatgatttataagcgttatcgcggttccagaaactagctacgtccccgtggaaggctgcggtagtgtaaccgtgctgatccataattgcgggcatggattggaaggtgttggtagtaccatccgtaaccatcgctgatccttcaggtaatccaaacaacgaattttctaacatcatctcggcgtcggccgtctttccttgaccaacttggttaaagaagttgtcataagctagcgtgttcttgtcattgtagaacttattgatgttaggggtaatttcctttcccttccacttttggttaatgacaaattgttgcaaactttctaagtgaataataattacgttcttacccttcgcaacacccttatattcgatgttggcgggcacgttattcttctttaaaaactcgttaattggttttaattgagaacttttggcttctttcttcttattactattctgaacggtcttaacgccgtcgtataaggtgaagctttgtaatcccaaatacttaacaatgtagttattatcaaacgtccgggtcaacaatccggaccggtttgaataagcaagggctaagttagcggctaggaccccaattgatagaatcgtgaccgctaatgaattaaccagcttgaaacgctgttggtcaattttagcaaaaccaaacgctaaaattgcaatgacgaagattacatccacgaacactaaaaagtcggttggtcgtaaaattcccatcaagctttttcccaggttatccgatgcggcacccgagcccttgattaagttaaaggtgataaagtctgaaaactctcggtagtacaaaatgttggcaaacagccaggttgataagattgcatccattacaatcatgtaccaataggcccatttacctcggatatataatccaattccaaataatagaatggcaaagccaagggggctgatggctaaaattaattcctgcatcccaccttgaacacccagcgtaaacttagtttggtacgcaatgtatgatttcagccaaaacagcccggtaatcaacataaagaacccaaacttggtgttcaatccccggcgaaacttaccccataaacgattcatgctatcgttcctccacatgatatttcttaaataacttatccattatagcccataatttacttggttggctgtttgaatcggttactttagaaagttttattttttaaagttttgcggtgagttctacgtcaggatacttgcctttgaaccagcgttccgcgaattgattttcgaataggaagagcggttgtccagcgcggtccttcaccaacaaattccgggaagacgacattttttcgtccagttgttccggattgatccagcgggcaattttcttgcccattggttgcattaccacttccgaattgtattcgttttgcatccggaattggaacacttcaaattgcaattgacccacggcgccaaggatgtaatcccccgtagtgtagtttgtgtacaactgcaccgcaccttcttgaaccaattgctgaattcccttatggaaggatttttgtttcattacgttctttgcagaaacgcccatgaataattctggagtaaattgcggcagcttttcaaattgtaccggctgcttgccggcgtaaattgtatccccaatctggaaattacccgtatcgtataaaccgataatatctccagcaaccgcacgttcaacattttcccgtgcgtccgccataaattgagttgaattggaaagccgcaatgtcttaccagtccgttttaaagtaacgtccattccccggtcaaattctccggaacagatccgtaaaaaggcaatccggtcccgatggttagggttcatattcgcctgaatcttaaaaacaaatccggagaattcttcgacagtaggttgaatttgttcgccgtccgccactttatgcgcggatggtgccggagcaaattgtaaataagcatctaggaaagtttttaccccaaagttagttaaagctgaaccgaagaaaaccggagtcaattcacccttggcaatcttagcctcgtcaaattggttccccgcttccttcatcaagtccacttccatcattgcgtcttggaagacactttcttcttcaatgggattaggttcttttagttccccgttactatcaagcgctaaatattcgggctcgtcagtatgtagttcaatccggttgttgtaaatgtcatacaagcctgccagaccctttcccatcccaattggccaattcattgggtaagcgtcaattccgagaacttcttctagttcatttactaggtcgagcggttcacggccgtcgcggtccaacttgttcataaaggtaaaaattggaattccacgcatcttacaaatttggaacaattttttagtttggggctcaatcccctttgcggaatcaatcaccatcactgcggagtccacggccattagggtccggtaagtatcttccgaaaagtcctcatgtccaggagtatccaaaatgttgattcgttttcctgcataatcaaactgcatcactgaactagttacggagattccccgcttcttttcaatttccatccagtctgacttagcgtagttacccgtcttccgagccttaaccgttccggcttctcgcactacgcccccaaacaatagcaattgctcggtaatggtggtttttcccgcatccgggtgagaaataatcgcaaaagtgcgtcgcttatcaaccgccgcttttaattctgcctggttcatattcgttcctttccctctaaaaaataagattggaatcattttgatatcccaatcttaactgttgtcttaatcttttttataatcaccaagacctaaatcacgcttgattttagttgtcgagattccttcggtccgtggtaaataaataactttacagtaatccttgagaaaatcaaattgacccttccagtcgtcgcccattacgaaaatatcaatatcattttccttaacgtcatttatcttttgatcccatccgcgttctggaatcacttcgtcaacatatttaatcgcttctaaaatatactttcggtcttcgtacggggtgtaagctttcttgcccttaaccgcattaaactcgtccgttgataaacatactgtcaaatggtcgcctaattcacgtgcccgctttaacaaccggacgtgtcctttatgcaacaggtcgaaagtcccgtaagtaattactcttgtcaagatttttttctccttgaaataatttatctaactctgtagatattaccatattaatagcaaactaccaaatttagcctatttttctggcttaaccttttcttcaatcttatctcggtctaaaacccagatatggtggataaaattaattaaaactttaacaattgcgtaagtcggtaccgccaaaatcattcccaaaattcctgcaagttttcccgctaccaacaataaaataatgatggttaacggatgaatttgcaaggacttgccaatcacgttcgggtatattagatttccgtccacttgttggacaattaagaccacgatgattaccgaaattacctgttcgggggactgggcaatcgccactagcaacgaaggaaaaattccaaaataaggtccgacatacgggatgatgttgcaaattcccgcgatcacgccgagcaccaacccgtacggctgatgaataatcatatagccaatcacggtaaaggttcccacgaaaatacattcgattacttgtccagaaatgtaagaagatagcgtgtcactcatcgaataaaataaatctaacacacttttgcggttgtgttctgggacaatccgcgaaattgtcggaattaatttgtatccgtcctttaacatataaaacagaataatgggcaccgtaatcacgatgaccgtgatgttagtaagcgccgcgataatattaccgatgctgttagtcatgttcgccaaaaattgttccgcgtattggccaatctcactattcagattttttagatacgggtcaaaatcaaccttgcgcagccaggagtggtcgactagctgaggaatggcaacctgcagtttcttggcaatcattggtaaattccctaacatttgggaaatttgatcgatcaaactgggcaagaaagagctgattccccaagcaattaggagcaggaatcccacaaataccaacaccaccgcccaggtacgcgatatccgaaacttcttataatggaccttcatcaacaacttcaccaacggatggagcatgtagtataagaaggtcgccaagattaacggcatgaataccgtgctaataaacgttccaatcgggctaaacaaaaaatcaattttagtacaaacccacagtaaggtcgcaataattaacaattccaacgaccagtacattaagggcgttttacgaaatttttcaaacatttaccagactcctcattttcatctatgttcagtgtattcttttttaaagaaaagggaagtgctcttcacacctcccttttttaccgagtattgcgctccgctatattcagataacgtttgtaccaaatattaataaactcaaccgaaaacggtccacgctttttatttatccaatccgtcagttcccgtacactatccagcaaaatctgaatcgtgtccgcggaatagtgccactgccgactgaactgctcgaattcgtccgtatccaaaaggcgccgttcgccattgggaaacaccttaacatctaaatcgtaatcaatgtacttgagggcttcgcgatccaaaacatatggtgacgcaatgttacagtaataggaaactccgttatcccgaatcatcgccaccacgttaaaccaagtatgcttattaaaataaaccagcgccggttcccgggtcacccagcggcggtcgttatcctcgatcaccaccgtgtgatcattacagccaataaactcgtcttgactattttttagaaccattgtttcacgccaagtccgatgcaaactaccatcatgcttatagctttttatcgcaatatactcgccttcctttggtccatctgagtattgagacatagcataagcctacttcctacagctgaaagctttcaatttctcttcaattataccaaagtggactttaattttgcactatccattccagaaacttaagaatcattttcgtttaaaaaacgttcaattaattccatttcaaagcctttttgatataacgaccgtttaattttagttgttcgctggtattccggttgcccttggtaccgccgtaacagtcgttcacccaatttacgtagcttttcgtattctgcatcgctatcgaccgtaaattcgatttcagcgagtgctttttcgataatttcgctagtgaaacccttttgcatcaaattttgccgaattttcaactgttgttgccggagtgcttgtgcctgatgccgtttttgcagtttctgtccgacccggactgctaaagccacctgttcaacatcggtaaatagctgcaatcccgcttgcaagtcgttttccagtacccctttttgccgtaaatggttaattaggtaccggggccccttatcgcccgtccgcatcatcgtccgcacgtagcttttggcgtattcctgatcgtctaataaattcaagtcagctaacttagcaatcaccgcttcaattatcgactcctcgtaatcctgctgacgcaatttttggcgtacttcattttccgtgcgtaactggccggttatataggtcagcgcgatgttgtatgcttcggcattggtttcgtattcgccaatttcttttaataaagtgccgttcacggccatccctttacctaaccgaaagtgaatgaaggtttcctcgctaattggaaaagcgtactcgccgtccaaaaaaacgttgtaacgcccagctcgtttttgtgcggtaattttagtaatttttttagtttcttcagaattaatgttaatcaactccttttttgctatactttgataggaaaatattggaaagaaggatcaaactatgccaactgcaaaagttgtttttgctaccatcactggtaataatgaggactgtgctgacatcattaccgaagctttagaagatttaggcgtggaagttgacgaaaccgaaatttcacaaaccgacgctgccgaacttaaagactacgacattaacgtcattgtcccctacacctatgacgaaggggcactacctgaagaggggctcgacttttacgacgacctggccgaccttgatttgagcggcaaaatttacggagtcgctggatcaggagacacattctacgaagaattttattgcgtcgccgttgacaagtttagtgaagctctcactaaggctaacgcaactaagggaactgccgatcttaagattaacttagctcccgaatcgcaagaggatctcgatcacctagatcaattcgcccaggacttggttgacgcctataacgcccaaaattaattcttgtatgtagcaaagcgtagaagctgaatttgattcagtttctacgcttttttactttcaaacttttactgttgaatcctaaccaccacggctaaagttttccttcaactctattataacaaaggtacttgccaaaaaagctaaacccgtcacttaaagacgggggcgcctcgtaatcgtgacgggtttattttttgggttaagctaattgcccgggaaggacgcgcttttcttttggcggaaattgttggtcaaatttattaacgtcgctttcactgacgtaatatgctgaaggcgtgtagtagagtgctccttgtacttgctcaaagaagccttcccgtaattcctttgccaaaaaatatgggagttctccgttttcaggttcacttgcgtaacgaattcccttggtggtcgcaatttcaaaaccagcgtgtttataaaaggctaagttgccttcaatgcatagtgcagaggcaccccatttacgtgcttgagcaatgccataatcgagcagctttttcccataccccttccgttggtaagccggggcaattgataacggtccaaatgtcaaaacgggtacttcatttccgtttttatcaaccagttttgccttcacaaagcaaatttgcccgataatttggtggtccttttccatcaccaagttaagctgagggacaaactcggaacttttgcgtaaaacatgtaatacgtaatgttcataacagcctggccgataaacgttccaaaaggcttcccggaccatcgcttccgttttctggtagtcagctggttgttctaaccgaatcaaataatctttttccattttaacgatctccttaagaattgaatttaatggcaattccagaagatttataggccaaaccttctggctaacctacaatcgctaaggtgctgcaattaatcattcaaccgtctccttaatgaatttgttttgagcttaccaaagagggttagggaattcaagaaaataccctacaattacaaatttccagaattattttaattgtcattggcgttattttggctaacttagcgggtaatcattaaaataactggcatatgtaaaaaagtgtgcccccagtatccaataggtgtacactttttagtttactaaacattttaactaattaattttgccttttagtttccatttacagaaaacttattatttcttcgtcgcctagctcctcgacattactgtgacactctcaacggttcggatcttgccaatcactcgtcgccttgctcctccttcttggagtcctatcgcatggagcgtctctagcaatctcttcgtcgcctagctcctcgacattactgtgacgctctcaacatgcggcgtctgcgggaactggtctaccggcgtgattggttgatccaccttgtagccttgagcctggaaccggtcgatgtctcgaaccagcgttgctgggttacagctgacgtaaaccactcgtttaggagccattgccacagttgcgtcaatcacactttcgtcgaggcctttgcgtggtggatccactaccacaacatctggttgcatcccttcagcttgccacttcgccatttggtcttccgccttgccaaccacaaatttaacgttcttagcttggttttggacagcgttaaccttcgcgtcctgaacggcttccttaacaatttcgactccgtaaactttcttggcggcttgcgccatcgctagggaaatcgtgccaattccactataaacgtccaagaccgtttctttaccagttaagccggctttttcgattgctagctggtaaagcttttcagtttgcactgggttaacttggtagaaggaatgtgctgaaataatgaatttttgacccaacaattcatcgtgaataactgattcaccagctaacaggcgatcttccttccccataataacgttagtctgcttagggttaatattttgaattacgctaactaccccatcaatttgatgaatagctgcagcaatttcgtctaaatggggaactgagctggtgcgggtgatcaacaccaccataatttcgcccgaacgccggccccgacgaaccatgatattgcgcactacgccgcgttggttaatttcgtcgtaaggttcaatttggtattcgcgtaaaatgtctcgaacttggaggattacttggtcaattaccggatcttgaatgtaaaaatcttcgatcggtactaaatcatgcgagccgcgcttgaaaaagccggtggctaactgtcccttaacttttcgaaccggaacctgcgccttatttcggtatcccgttgggttttccatcccgaccgtttccgcaacttcaatttgttccaagtgggacttttgcaataagttcttaatttgagtttgcttaaattttaattgcgcggggtacgcaatgtgttgcaacggtgcaattcccgtttgcgtatacgcagcatcgtttcccgcaacccggtctgggctttccactagaaccttttccacccggccaaacgcaaaatttttctgcactttagtgattttgacttgaatttgttcgcctgggatactgtcggcaatgaaaattggaaaatgctcgattttagctacgcccattccttgataagttaagtcggtaatgtcgaccgtatacgtttggtttttttctactggtgctttaattttcattgatttccccttattgataatctaataaacagagtgggacaaaagccgggtagtttgtgagcattaaccggaaatcgccggttccgactgatgttgccggaattaccgatttcaggttaagcggagcaaactgacttttgtcccacattttagcttcatttaagttaatggttcaaaatgctttccagtgctttatggttccttgaaaaacacttttgattttaatgcatgacgattagaagtaatcaaccgtagttagtcacggtgcataatcactcttgatcatcctgtgataggttttgaacttcagcaacaaattgttcttcaacttggcggtactcatcgtcttccggttcactgaccgggacgctatctaaattagtaaacatgtcgatatgccgttttaagttcttgaaaaccattggggcgtcaccaccatattcgccatctaaattaaccatgacccgttcattaaccgggttaacgacgaccttacgcgccttccggtaaataatccgcgggtcgtcaacatgcttgccgttaagcgccttgaccatcaagtgtaacaggtcaggtaaactactagatttcacgatgatcatggtgaattttccatcatctaacgaggcgtcgggcacaatttgttcaaagcccccgattgaattagttaacgccaagaagaacatggacgcttgcccatggaaatgttctccgtcatactcaatatccatctcgaccggcttcacccggggcaacatttctgcccccttcacgatgtaagctaagtatccaaaaatactcttcaagttggatggcacgtcgtaagtcaattcagtcagcaaaccacccgctgcgatattaatgaagtagttatcaccggctttaccaatatccatcttcatccgttgattttggagcactacctttgcggccgccaccggatcttcccgtggaatccgcaaagcccgggcgtagtcgttggtggttccagcagggatgattgctaatttagggcgccggtggagcggagcgattccgttgaccacttcgttaatggtcccgtcgccgcccgctgccacaactaagtcaaaaccatccttagcagctcggtgcgcttcgtttttggcagaattaggttccggagttgttgcaaatgcactggtctcatatcccgccttttcaaataccgccagaatttcaactaaatgctgcttgatcatttcccgacctgaagtcgggttgtatataatacgcgcacgttttcgcatcgcacgttttcctccgcttctattccactaacgagcgttgagctcttgcattaagatttgatttaccaccttcgggttcgcctgtcccttagtttgtttcatgatttgcccaactaagaaaccaacggcccgatcttttccgttcttaaagtcaattactgattgttcgttatcatcaactacttgcgtaatgattggcttcaaaactgctggatcggaaagttgtactaagcccctttcctttacccagctaactggttcttcacccttagtaattgccttgaagactttcttagcaatcttcgaagaaatggtttcgtcactaatcatcttaaccatgctagcaaggtgttctggtgtaatcttcgtgtcttgtaagtcaaccttttgatcgttcaagtaggcgtttacgtcacccattaagtagttagcaaccaacttaggatctgcatcaaaggcaattgctgcttcaaagaagtcggacatttccttcgtttgggtaagcaccatggcatcgtagtcacttaagcccagttcgttaacgtaccgcgcacgccgtttaccaggcatttccggcatcttgtcttctaccgccttgatccattcatcactgatggtgatgcttggtaaatctggttcagggaagtaacggtaatcatccgcgccttccttaacccgcattaggatggtttgacctgtagcttcatcgtaacgccgggtttccggacgtacttctccaccggataacaaaagcttttgttgccgcttttcttcgtaagccaatcccttccggacgaagttaaaggaattgatattcttcaattcggccttggtaccataagtatttgagccttccggacggatggaaatgttaacgtccacccgcatggaaccttcttccatcttcacgtctgaaatcccagtaaactgaatccgttgccgaagtgcttccaaatatgcgtaagcttcgtccggtgattcgatgtctggtttagaaacgatttcgattaacggggtcccctgccggttcaagtcgacgtaggagtagccgttagggttatgggtattcttaccagcatcttcttcgatgtgcatttcggcaatcccaacttttttcttcttgccgtctacttcgatttcaatccagccatccgttccaatgggcgtatctgcttgggtaatttggtaggccttaggattatctgggtagaagtaattctttcggtcaaaatgctgggtccgggcaatgttagcatgcaatgccttggcagccatcattccggcttccacaacccctttgttagtttggggcaaaacgccggggtatccccagtcaattacgttagtattttcgttaggttgatccccaaattctacgggtgaaggactaaatattttggaattagtttttaattcgatgtggacttcaagtccgatagtggttttaaaattcattatttgtcctccgtttcagggtgtttttggtaaaaattagttgccgcttcaaaagcagcccctgcttgatacatagtttgttcgtcaaatggcttagcaatcatttgtaaaccaaccggcatcccttcgctgaagcctgctggtaatgacattgctggcaatcccgctaagttaactgggatcgtcaacacgtcgttcatgtacatggtcgttgggtcatcaacttccgcaccaattttataagctggagttggtgcagttggcccaatgattaagtcgtaattttcgaaaactttattgaagtcgtcgatgattaaagtccgcacttgggcagccttcttgaagaatgcatcgtatgatccagctgaaagtgcgtaagttcccaacatgatccggcgcttaacttcgtcgccaaatccttcggaacgggattttacgtaaacgtcttctaggttctttacgtcgtccgcccggtaaccgtagcgaatcccatcaaaacgttgcaagttggaagaagcttctgacgaaccaatgatgtagtaagccgccaccccgtagttactccgtggtagggaaacttcttcgaccgttgctcctaaatccgttaacgtttgaacggcttgtttgatggttgccttaacgtctgcattaattcctttgccaaggtattctttaggaagggcgattttcatccctttaatgtcttgtccaatcttagccgtgaaatcaggaacttccttatccgaactggtaaggtcccgttcgtccattccagcaatgatgttcaataaggctgcgttatccttaaccgttctcgtcatcggaccgatttggtctaaacttgaaccaaatgcaattaatccgtaccgtgaaatccggccgtacgttggttttaccccaacaattccggtataggaagctggttggcgaatggagcccccggtatctgaaccaagtgcggcaatcgaattaccagccgcgaccgtggttgctgaaccaccagaagaaccgccgggaactttagtgtggtcccacggattccgggtcgtgccgtagaaagaagtttctgttgaaccacccatcgcaaattcatctaggttggtttttccaataacgatcacgtcgttagcctttaaacgttcaattaccgtcgcgtcgtaaatgggcgtaaaattactcaacatctttgaagaagcggtcgtttttaagcccttagtaacgatgttgtccttgacggcaatgggaattcccgcccacaagttgtcagggtcaacgcccttttcgtcaatcgcttgtgcttgttttaaagcttcgtcgcggttaatggtgacaaagtcgtttaaaacggcttggtcagcttcgatttggtctaacgtttgggataccaactccgtaacggttaattcccggtcaaccaatttttgatggagttcggtcaccgtaatatcaaaaaacttcattatgcttcctcactttcatcaagaattgcgggaacccgaatgaacccgtcttcagtatcgggtgcgttatttaagagtgcttccttatctcctgaacgaacggcttgatcttcgcgcatccggttcaattgatcagttacgttgaacgttggttccacatcagtcgtatcgacttcgtttaattgttcaactaggtcgatgatgtcctcgaattgatttgtaaacttttctaattgggcatcatctaattttaatttagccaacgtagctacgtgtgctacgtcgtttttggtaatgttattttcaactgtcattgcttgcttcctttcagaattaatagcttgtaaagacgtgcgaactaaaggtcttatcctttgatgaacgggataagaagctttgaacgtcgtcactcgaacgaatcgtaatgtcgatatttaccccgcttggcaggtatttttccgcctgggtcgaaacaaactgcgtgaaactattaatttctgtctcactatagaattgagtggtaatcgtcacgctcattccttgcattgaatcccctttgtaacgagccttcgcggtaattccgctcaagttagggaagaaactttccacttgagttttgaaattatcaaaagcagtcgaatcgttgctattcggcgtactttcgttatccccgattgggtaaaccacgttcttataatccaagtttttccaactagctagctgattgccctgattattagaataccggataaaggttcccccggtcaaactatcattagacgcttgtttataaacggcaatcacaatcggaatatttttgaattcgtctttcttccgcaatcgttgcagtacttctttagcaatccgcgtactttgctctttaatttccgcgtccgaaattttagtttcgtattctgcaccgtactgcttcttttgataatagtcgaccgtgttcattgctagtccaatcgtgacccccttcaacttcaaggagttccccgatttttgcatgtagtcttgttcttcaagtgcttgcaaataaattgggtttcgcttatcaggatctttagaaccattatccttcggattgagaccatcagggttcttcttggacttccggtctagccaactttgaaccgtatccgaactaagatattgcccctcttggaaaacgtatttggatggcgcaaaaacttctttggagacgtcttgcaagcccgtttcaaaactcttcgtattatttacgttgccattttgatccgcagttaacccgcgggacttgctgaccacgtactttccgttttttatcactccggcgtattgtccagaagaggagcccgttgtttgataagttgtctttttatttttttcaccggtcacgttattggttgccgacgacatggaagaattatttaatcccccacaagccgacaaaccgactccgagtaataacgtggcaactaataaactgatttttttagttactttcatagaaaagttcctcaaactttcgttatatacctaattataccgctaaaataaatcacatcttgtctaatgctaagcttagtccgtaacccgcttaatcggtgcaaaggctgctaatagacgcttaatcccctgatctttaaaggcgatgtctaattccacgtcttcgccggtcccagaaaccttaaccaccgtaccaacgccccaagctttgtgttgcactttatcgccggccgcccaactaactttttccgcgccagtaccttggttggtagatactttagcccgttgagtaccgtaaacactagcagttgccctggcgtttcgttcccgatcaaacggatatttgtttctactccttgagctgaatccttgaacctgttcgttttcgtcttgtaaatattctgcgctaatttccccaataaagcgagatgcaggattattttgcgtccttccgtataacatccgggaataagcgttcgttaagtataacttcttttgtgcgcgagtaattcccacgtaagccaaccggcgttcttcttcaagttcatcaggatcggtagccgccctggataatgggaagactccttcttccattcctactaagaagactacggggaactcaagccccttcgccgcgtgcagggtcatcagcgttactgccgatggttcttcttctacatcgtcttggtcagaaactaaggcaaggtctgctaaaaagtccaccaagcgaacgttatcaccattttcatcggcaacttcggtcccttccgcgtcgttttgctcgtcaaattgcttggttaccgtgaggaattcgttgatattttctaaccgagcttccgcttccatggttcgggtttgttccaaggcagcccggtagccggttttatctagtaaagtttccgttaattccgtgatggaaagaaattcggccgacttccgtaaagcatcgattgtcttggcaaaatcttcaatcgcgttgcgcgtgcgtcgagcaattccgttagcaatttgcacgttgcgcgccgcttgtaaaagcgaccaactattttcgtccgcaaacgcctgtagcttagccattgaagttgcaccaatccctcgtttgggttcgttgattacccgttcaaaactcatggaatcctcttcgttagcgattaacgtgaggtaactgagaacgtctcgaatttccttgcggtcgtagaacttatgtccccccaccatggtataaggaatgttggccttcacgaaggtatcttcaatcaatcgggattgcgcgttcgtccggtataggattgcaaaatcaccgtaatcaaaattattttcttcaatttgtttgcgaatttgttgaacaatgaaatggacctcgtcattgccggtttgcccccggtagtacgaaattttagccccttcagcattatccgtccacaattgcttaggcttgcgttccacgttgttagcaatcacgtcgttagccgcgttcaaaatgttttgggtagaacggtaattttgttccaacataaccgtgtgcgcgtcgggataatcggattcaaaattcaaaatattttgcatgtcggcaccccgccaaccgtaaatgctttggtcagaatcccccactacgcataggttccgaaaaccttttgccagcatgttaaccaattggtattgcgcttggttagtatcctggtattcatccacgtgaatatagtggaatttgttttggtaaaattgcaacgtttcgggactttgttcaaacaaccgaattgtttgcatgattaagtcgtcaaaatccaacgcttgattggcttttaaccgtcgttgatattcgtcataaatcttaccaaccgcctcatcatgcgggttacttgcattttcttggtaatccgccggagtcattaaatcgtttttggcgttggaaatctttcccaataccgaccgaggatcgtatacttttggatcgtaattcaaatctgcaagtacgtgtttgatcagcgtccgttgttcactagggtcagcgattgaaaaagcccggttgtacccgatctgttcaatgtcacgccgtaaaattcgtacgcacaacgcatggaaagtggagacccaaatttcagatgccacttcgcccaataaattagccacccgttcacgcatctcccgagccgccttattggtaaaggtaatggccaaaatgttccaaggatttacatccttttcttcaatcaaataggccacccggtgcgttaacacccgtgtctttccactaccagcacccgccatgatcagcaacgggccctccgttgtttggacggcttgctgttgcatatcattaagaccttttaataaatcattttcaggcaattcgttcaatcctctctatttgtaactaaaaaacaaccacagaccattatagcaaaaaagccggttcattaaccgactttaaagcgacttttaccaaacatctgtattatcaatttgctcttgaatttgcttgacgttgtcgccatccgccaacacgtagcccacgtgattttcatccttgtgttcgctaacctgcggatagaaatggaagtgccaattatctttgattaaccactgtgttttaattttttgcatttgcggttcggcaacgttcaacatgatggtcggcacttgaagccgaatatcactgatcaccatcccactgagggcccgcaaggtttcttcgtaaaccgtcgtattcgaagctaagttaaagatattttgggaacggtgaattccaggaatcaaccgttttaagtaaatttctccatcttggacgtagaacacaattgaaaagacccctacgtattcaattgaattggcgattttcgttgcttgttccaataggttattttgaatccgcggatcaatatctaccggaacccgggtttcttttaagtgatggttttgatagatattttccaccattgggaacattttttgccggtggttttggccctttactacgcttaacgccacttcacgaccagtgtctggccatgattgtagtaaataggtcccccgttcgagcaatggagccgctttgggaacgtcaatttcactttccaacagtaagctttgttcatttaacggatctttcaagattggttgtaaaattccgggatacccaatctcattaaccgaatcgtataaatcatccaaatcgacgatggtaacgtacggtgccgttttaattcccagttgttccatcgtggccttttcaatgattcgatcttggttgagctcaagtaactgggttccttgagggatggaaacaaattgttgtaggtatttaatgatcttaatatcgaccatctcagattcgtacatcacaattttgcaacgttccgcaaatcgttgaagtttttccccatcgtttaagcttcccacgaaacttttatccgcatagtgaaccacttcattttgctccgacgtgacgtaaacggaaactttaaagcccatcgacttagcggtggttaccaattgaacactggaacgcccttcgccgataatcccaatcatatcacctggataaataatctttttcgaagtaattacctcattttccacttttgatcatcctgcctgttcctcaatctataattactcaaattcaacttgaccatcgtcagttaacgccttaattttagctaaggactctagttgcacgttgcgatccttgatgatttgacttcccttttggaaggtcttttcaatcacgattccgacgcccaccacgtcgattttagcagcgtccgcaatgtcaaataaaccggacacggcttgtccattagctaagaagtcgtcaataattagtacccgatcgttagaatcaatgaaccgtttagaaatcgaaatttgattgctggtttgtttggtatatgaataaactgacgccgtatataagtcatctttcaacgttaaacttttgtgcttccgcgcaaaaattaccggaacgtccattgccaatccggtcattactgcgggagcaatccctgaagattctacggttaagattttagttaccttttggtccttaaacaaccgcgcgaattcttttccaatttcaaacattaattgtggatcaacttgatgatttaagaagccatcaacctttaagacattgtgtggtaaaacaattccttctgatctaatcttgtcttcaagtaacttcatcccgtaactccccctgaattattatttatcatattgatttaaattatatttttgaatcaagttaattaacttggctggataatccggatccgtggcgtattgagcgtcgtacagcgcttgggcagcttgcttataatcacttgctgtaattaccgcttgatattgccgaggattccaattagtcccgttcaccagtagtaacgaatggtcacgcattgattcttgccacgaagaatagactttaaaacgggccgccaccgtgacccatttgccgtttacaaattcctgcgttttaaaataacgactgttctgatcggagtcacctttaattccgtagtaattattaaactttttggacaacgtgctttgtccccagtctgattctagaattgcctgagccatcgtaatgctcggcaaaataccatattgccgctgcatctgctgagcatatggcgcaattgtttttataaactgttggtgacgttgtgcggtggcactggtggtggtcaagttatccgtaacctgggtagcttccgtgcggagcttcattcccagttcaactaccaagcataccactaaaagcagcccaataattgacgaaacttttaactgtccctgctgataaaaaaagttattctttcgcctacgttttttcttcgccactggtggtcaagaccctccattttagtgtacattcttagtttaaccgaagcaccttaaaaataatagtccggttccccgagattaaacaaaaaataattttttactgcttaaaacgttgctgcccgattttagaaaacttcaagagcggcgtagctagtagtggcacaataattccagcagcaattgcttcgggaataccgtgcatcccggcgaccgttagtaaatatggcatcagttcttttaaattgagcgccgtgtatacttgggaaccgttatggtagaagacgtaaatcaggctcaatactaacaccgtgttaactaaagaaccgacgattgcgccaattaagaacgtcgcttgctgtggaacccgcgtttttatcaaccaattaactaaccagccggtaataaccccgattagaattcggggaacgattgaaattaacggattaaccattactacgttgcctaacgcgctagaagtaacggtaattgcgcgaagccaatccactaggccccaaattccgccgataattccaccgtcaacggggcctagaagaattgccgccacgataaccgtaatatgaatggtagtaatttctaatggaccaactggaatgtagccgattaagggcacgtaattttgaataataataatggctgcaaataaagctaggatactgattttgcgtgcataatttgcctgttgcatggtgtaaacccctcgctgaaaaaagattggatatattatagcatgagagagtggaaacctcccgggtaggcttggaggattaacaaaatcttcggatgaatcggggtggatttgtccgaagatttagttaaccgtacaaggctggggggtggaactcattttatctatattgctactatactgaaattgggttaaccgcaacgaactgggggatggggcgtgttttggcttcgtagcaaagtcccgtttagttaacaagcctggaaggcagaactacatcttaatcacctacataacaaatttcctcgataaaagcttgctaattaggttacagaacgttattgacagtctcaattactccccccgaaagtgatttaaattaaatttaacgctacttctgcctaaacggcgttaaaatacatgtaacattgataaattacgtatttaaggagctcttatgaatcttgaacccaactttaataattcgatcttagctgcgctgagtaattatcagctgccggctgacgatgagtaccttccccaattaattactaatcaggctacggtcaaccttaaacttcatttagaacaggaattgcaaaattgtactggtttcaccctggcggtggctttcatcacgaacggggttcttaccgatttaaaggtgcaatttgctgatttggcaagccaaaatattaccggacgaattttaacttctacttatttgtattttaaccagccgcacgtttttgaagagctgcttaaaattcctaacgtggaagttcgaatcattgatcagcaacaaaacttccatgcaaaagcctacctctttgataaacctgaggggtaccaaactttcatcctcggaagtgctaatttaaccgaagcggccttaatccaaaactacgaatggaacattaaactaactgcccagcgtcatggacagctagctcgcactattaatcgtgaaattgagcaactctggcaaacggcccagccgcttaataaaacttggctcgaccaatacaaagaagcctatcgccaggccgctcctcgttttggctcaaccaaattaccaacgttaattgcgccaacgataacccccaacaccatgcaaaaagatgccctcgcctcactaaccgaattgcgacaatccggggcaaagcgtggccttatcgtttcggctaccggaactggtaaaacctacttaggtgcttttgatgtacgcaattttaacccgcgcaaattcttatttgttgttcatcgcgaacaaattctacgcaaatccttacgtagttttcgaaaagtacttggcggtccggcaagtgattacggaattctttccggaaatcagcacgataccgactgtaaatatctttttgctaccattcaaaccttgtcacgtgagtcagttttacagtctttgcccgcagacacgtttgactacgttttaatcgacgaagcgcataaagccggtgcgcccacttaccaacgggtgatcgaccatttccagcccgagtttcttttagggatgaccgccacgccggaacgaacggatgattttaacatttacgagcttttcgattaccacattgcctatgaaattcgcttacaagcggccattgaatccgacatgctcagtcaatttcattacgtaggaattaccgattacgaatatcagggccagttaattgacgagaaaactccgttacgccatttactcgctcaagaacggatggactacgtggctaaacaaattgattactatggtcacgatggagaacgagtttatggcttaattttttgtagtcgccaagctgaagccgcggaggtcgctcaaatcatgacggcaaaggggcaccctgcccttgctttgacaggaaacacctcggtgagtgagcgtgaaaaaatcatccggcgatttgaaaagggtgaattagaatatttagttaccgtcgacatttttaatgaaggggtcgacattccgaaggttaaccaagtgattatgctacgcaacaccgaatccagcatcatcttcattcaacaactcgggcgtggcttaagaaaagctccgggaaaatcttttgtaacgattattgactttattggtaattacaaaaacaactacttaatcccaattgcgttgactggtgaccaatccctgaataaaaatcggcttcggcagcaaattgccaccaaccaaaccatcgggttgtcttccattaactttagtcgaattgctaaggaacggatctatcagtcgatcaaccatagtaatctcaccctgttggcaaccttacgcgaggcctatcaagcattgaaaaacaaattgggacgcgtacctcgattggctgattttcaaaaattcggctcggtagatggtcaagttttagtcgacaagtacgaaaactatcagcagtttttgattaaaatgcatgacgaacagccacttactaagtcagcagacgcctttttacgcctaatttcacgagaatttttaaatggcatgcgcattcatgaactagttttgcttcaacagttgtttaaacagccccggtacgctaagcaagcgttggtcaaccaacttcatgaactgggaacttatactgatccagcaactttgcagtcggtaaacaaccatctcgatttaagttattttcagcctcgtgatcaagttaaatacgggcaaacagcttgggttactctgcaagatggttattatcagcttaacgatgagctctgggcacaataccagcaaaatccgtactttaaagacttggttgacgatgtcttacaagttggcatgtggaatagtaaacgatacgaccaacaaacgaagttcacccgcaaccaacgttacacccgtcgacacgtcaaccgcttattgggctggcctaaagaccaatcttccgcgatttacggctacaaagctaatcaaggaagttgtccgctttttgtcatctaccaaaaacggccccagtctccggttgctgctcgccaccaaaacgttttctacgatacccagacgttaagctggttcaccaaaacgcctcgtaagttagattctaaagaagtggtccaccttcttaagggaaatcggcaacaaaccatcgcttttcccctcttcgtgaagaaaagtgaggacgaaggtgcggatttctactatcttggcctggtagattttgattttcagtctttagaacaacagacccggataatcaatggacacgaaaagccaattgttaaagctaacttacaattgcggacgccggtagactatcaactgtatctaaacctcattaattaaggtacaccataaactgtaaacaattattcagtttggaggagtaattttgcagaatttaaaacgaactttcggctggttagctagtattggaatgggagccttattactaaccgcctgcggaaattctaattcttcatcatcgtccgtgcaccaaaataccgcaacggacctcactaaatcgagtcaagcacgctcaaccacccataaagcaaccccaagcgcgctgtgggatcaacggaaagctgaacaacttagcagctttatggaatccttcggtcaaacgatggatcaaagttatactgcttgtactcccgggcataacaccacttacgccggattgcattaccctgacgatctcaaacagcaacgcactgcttttgatgatcaaaagctttccgccggatgggcacccactgggaagggacattatcgcgttaacgtcgtagcagtatatgaagatcccggacaaggcaccttaggcggtcacgtttacctgttcgccattaaagatggcaaacccgtcgtgtaccacacttcccaaaaccagggaatgccagacaaccttacccacttcaccactactgagaatcagacgcttaggcaaggattcgctaagattgttgcgggccagcaagtagcgttgccaaataagtcctcatcttctaaaaaagcggtagctcctacgcaccattacgttaaatttgtttttccacaatggatgcagggaacttggtattccgctgatgacgatggcaaaatagaaaaattagttgttactggtaacctccttaatacggacggcgtgaaaaccccgacctacgacagagcgtcccgtaccgcagccgacatgaaagtattgaatggcggcggaaaacccgatcctgctaaaaccgattggggtgccggagggttaaacagcccttctggaagtttatttgacgaccctagcaaagtttcgcaagtagtcaacgtccgcggctggtatcaaggtgctggagacggcacgtacttttatactagtaccgaaaaagatggcggacagccgttcaccgtccttactcaagctggcggggccggcatgtggctgactgcgcactattaccgtagcgtgggcctcgctaaacaacaccaagacgagcattactcaactgatcgcgataattaagcccctacgctttcataacaaaaatagactaaaaaatgcttttcaagaacttaaaaattctcgaaaagcattttaaatttgttgattttaaaataggtttaaaagatacgttaaaaattagtttatcctacttatctggaacagtaattatgctaaattcagccctaattactagttttcagttagcactcgtaaactacccgatataccattattctctatactaattcaccattaacaaatcaggaggttgccctagctttgttaatggtgttttttactgctgatttgtttaatttcttcacgtgctaattcatttaaatccaagtctaaataaactgccaatgcaaatagcgcttcaattgacattcgtcgcggtactggagttaattcatcttcataacgagaaagcatactagttgatatgtcaattccatactcatcatgaatactacgaatcaactcgatttgtgacagatttcgttgctttcgtgcatttttcagtatagttccaaaaatcaaaggtaaatcctccttactactagatgtattaattctagtacatttataccgaatagagtacaaagcattgataaggagacccttttagggttataatcccacaagaggaatctttaaaaggaacaaaaaattgaactaattggatggtgatttttttgtgtgataactaccgggattttcgcggcgtcttagcttatctaaaagaaaatcaaattaaacaggaaacggtcgcaaattttttaggcattggccggaccaccctgaaccgtaagttaaacggcgcaagtgaatttaagctctctgaagtcaaattgattcatgagcattttaacgtgcctttagaaatcttttttaaggatgtctgagttaatcgattaaatatcagttcactatcaattagttgcaatatccttattgataactaactataaatttagcaattatattttaaacatcattgcagtagtcttgtccgaagttaggtattccccatatgccgcgattcatgtcagccaacgtgaagataaacttctactactactgcaatgttttcatccgcgatgtagccgtgcagactcattgcggttttatttttgccaaataaagtttaaatttttaataacgttgttacatattggttttaatttattacgccttacaaatattcgtttcagaatcccatttatctccggtcgaaaatgatatatcttaaataaaagttatcccttatatcattatcatattttttataattttagctcaaaaactaaaaaaattgagacgcacctaatctcaatttgtcttattataatattgcaacatgaagttgcgaattcgcttgtattttttaatgcttctccgcactcaaaaaatatatcgagttatcttttctttctaaccgctgaacgtcctcctcgggacgttcttttttatgaccctttccctggctctgctccggttccatggtggttttcatcccattgtagttttgccgttcgctgttcagcatcccttttcaacgcacttaaatggtcggataaatagtatccctgccatttaacgatgccccggtcaacataataataatcaaaaaattcttgtacatccgtttccgtaaatcgatcgtatcgcattgtaatttctcctaaagaaccgtaattaaactattcgtacgcgtttccgccattatggcctcctaccaagtcagcacggttaatcgccgtagcccccggagttttacttcgtgcgtatactagcgctttaaaaccatactgctggcgaattttatccacggctttttcgatatcgtaatgcttaatctgctgggtagctgggtgaaataaatctagttgctggccagttgcgggagctaatttacttgcataaacggcaatatttcgcaccgcttcgccttgccaattttctcgaaaaagctgaatcaggacatgcgtaagcgcaaaattttcgttagtaggcgtaattttttgggccacgtgaaagccgccccgtccatcctcaacgcttgctgcataggaaaaaccaatccctaatgagatgcaccgggtctgcttttggcgatggcgtaaccgggctgctacctgttctccaatttccttgattaccgtctcaatttctaactgttgacaataatcgcgcggtaaaacctgcgaatttcccacactactatccttaggctggatcggctgttgtaatttactacggtcaatcccccacgcggttgcgtaaagttgccagccgataattcccaacgcttcttttaacttaaagggattggcgtgagcaagttcttccattgtattgatccctaaccgattcaaccgccgttcagtgcgtttaccgattccccaaacttcagttaagttagcaattggccaaattttttgggctacgctttcataatgaatctcgccaattagcgcgggactttttttcgcgtaaagatcaagcgctaactttgcttgcaccgggttatccccgattccaatcgtggtgtagagccccagttgctcacgaacggtgcgttggattttttgggcaacttctcgtggagtttgcccaaataattgccaagaatgggtgacgtctaaaattgattcatcaattgaatatggcagcaaatcttcatcagcgacaaattgccgaaaaatattgttaatttgtaagtttttctgtatgtacaaattcattcgcggcgggaccacccaaagctggttcgtattgggtaagtcccgttgtcgggagacgtttgcatgcaaattaaacatctgcttagccattggtgaagttgccaaaatcaatcccccgttagtattagcttgttccgacattaccaccatcaccgcctctagtgggttaagtccccgctgaactgcttccacgctggcgtaaaaggatttattatcaatcaaaaaaaacacgccccggggttcctttcgataatccatctgctaattgccacctttaaattaacttattcatcaccattatcgaacaaacgttcgtattggtcaagaaatacttagccctcaaaatattttttgccgttatatcgatccacctctttaattaatataaaaacatatcagcaattaataaaataagtcaccaaaaattatcaattattgaaaacggctttttttaatgagataattccattacaacaaccaaaaacaaggtttgaaagtgatcataagtgtaactctttatatcactatttaaacataaggaggttcaaaaaatacatagatacgcagatacacatttagataattaactagctatctacaagaccgaagtatcaaattaagttaccacacacattttttaggaggagaatcaccgttatggactcaaaaaaaggatttttatcattcatttctaaaaacaaaaaaataggtattggcattattattctcttgctgggagttggggtattcgttcattatcaaaatagtcaagttgaccacctcattaagaaccatacatataaaataatggtcgaaggccctgacaaatccggagatacggtcaaacaagcgggagttttgatttttaataaagacacttacaaaaaaggaagcaatttggatgaggatttttctgatttaaatagcctgatttccagtgcgcaagaaaacgattcttcgtcttacacggcaaataaggatgccattactttaaataccggatactctgacgacacccctagtaacggagaaatcgctaaacttaaaaatttgaaagcatctaatggtggaaaaaccattaagggcgagattacttatcaatacgaagatgatagcgctgtagaaaacaacgaaaatgaccttgcagcatacgatgacatcagtgccaaaacagcccatgctaccgttcaactagaacgtatcaaataattaagttctaacctctattaatggttattcaattaatttttgtgaaattctaaatcaaaggtgatttttatgacaaaaaacacgtccatgctattaataactattatgagtgcattactattaaccgcttgtacggcgccttcccattcgtcaaccagtacaggtaacgcaagtcactctagcaaaaaagtatccaagaatcatcgcactacgacaccagccgctaatagcagtaaacaacattctactaacgcacccacaactgggaagccgctaactttcgacgaaggtatgcaaattttacggcgaagtgtctataaagacctacttgcagactcacctcagcttgttagtaaccagcctcaaaaattaatgatttccacttatgctggtgctaagggaatcaactattttaccttaaccatggctggaactaatcaagttcaaattcatgctaaatttggcactctggacggaggaaaatttactcagcttcatgacgttaatttgccagaatatcaaacgataacccgtgctttttccaataagtccgcttccaacacagtttcgaaatcatctgctttccaaaccaaccaagtccctactaaattcattggcaaatggaagaaaagcgacaaaattgtcactaattcagacggtaagcgttatgaatatgcgcaactttttcacggcaggcctcattctatcactctaggaacaacctatgccgacctaaccaagtacaccgttttgtcttgtaaaccacttggcaacaacgattatgttttaaaagttgaagtacccctgtcacacgagaccgatactttttatttgcattactattctaaagaccatatcggtgtaaaaactagttcatcaaatggcttcatggaatataatagcaaagcgcccgttctcaattacaatgcgacagaatggtaattgagaacgtatgaaaaacaatgtcaattaaagataattactgaagtcacacaaacaagggtgtgggtaaatggtttaactactatttatccacgctttttaaatccttggaaattaaaaagccaggaacttacttagttcctagctccttcattcctatgattgatcaacgttatcatctgatcaatcaggtatcggtccgttcaataatgtggtttttagaatatagttcgtacagggcaaatcctaccacgagccatcctaaataaaactcccatgccgaaaaagtaatattagccaataaaagcgcacaaattaacatcgcagctattgggattacgttcccaaacgggattctaaaaggtcgtggcaaatccggatactgccgacgtaataaaatcacgattaaggaaattaagaaaaataccgataacgagcccacgttagcaatcaacgctagatttcgtaaatcgaaaaagccggctagcaacgccgcaaaacatccactaatccacaatgctaagttaggactttgcgttttggggtttagctttgcccagttttggggtaagaacccgccccggctcatcgccttcatgacgttggagttagcataaataaacgcgtaaactaccgccataatccccaaaatagctcctgcggaaaccacttgcgccgctaaatcatgccccttgctcaataaaacatacgccattgcttccgaaacgtttaggtgtggataagccaccactccggtcattacaatgctaaccacaatgtaaagtgaagtggttaccactaacgagatgacaatcgcgcgcgggaggttatggcgcacatttttagcatcttcagccgaagttgctagcgcgtcaaatccaagaaacgtgaagaaaacggtcgaggcccccgtgacaatccccttaattccatacgggttaaaggaactccaattacccgtcttgacattggggacgctcaccacgataaatagcaaaatgatcgtcaacttcactaaaaccagcgcgttattgatccacttactttctcccgtccccttcgttaaaacgaaggtgattaaaaggatcatcaaaaaggctggtaaattcatccaaccgcccatggacggcgctaccaacagttggtgcggtaggttaactcctaattcgtgtaagaacgagcgaacgtagccggtccatccgttggcaaccgtcgctgccgtagtcatgtacacgcccaatagagtccaacccgctaaaaaaccaactagctgtccaatggtaacccaggcatatacgtaagcgctaccagaattagggattgccgttgccaattcagagtagcataacccaattaagccacttgccaatgcagcaatcaaaaaggaaaaaactaccgctggtccggcagtggtggccgccacaattccagtcagaaccaaaattccggttccaataatcgcgccgatccccaaaattgataaatcaaacaaacttaaagttcgttcctcttcgcttttagcagcgtttttgaaaataaggtctaaattaatcttatttttcatcaggatcatcaactaactcatgaacggtgtgtattcgatatttaaactatccgcaaccgctttagaagtcaattgaccattgaacgtgttgattcccgtcaaaatggtccggtcattagccgcatcttctacaccttggttagcaatcattattgcgtagcgtaccgtcgcactagttaatgcgtccgtggaagtctttggtaccgcacccggtacgttagctaccgtgtagtggattacgtcgtgggagatgtaaatcggatctttaagcgttgttgctttgacgctagtttcaaaaattccaccttggtcaattggaatatccaccactacggaacctggttccatactatcaaccatcgcggaagtaactagcttcggtgccaaagcgcccggaattaacaccgctccaattacgaggtcggcttccttaactgcttttgcaatgttgtaagaattagaaatcaacgtttgaactttgccactaaataagttgtcgatttctgctagtcgttgagcattgatgtctaaaaccgtgacttgtgctcccagaccgactgctgttttagtggcgttaaatccaaccgttccagcgccaatgatagtaacctttcctcgaggaaccccagtaactccggataacaataatcccttgccagattgtggccgttccaggaagtgcgctccgacttgaactgccatccttcccgcaatttcactcattggaaagagcagtggtaaatcgccattaggtcctaccatcgtttcataagcaatactggtaaccctgctctttagcaattcctcagttagtcgccgatctgctgcaaggtggaagtaggtgtaaataatgagcccgggacggaagtattggtattcttctggtaagggctctttaaccttaatgatcatctcacagtcccatacatcttctaccgagccgatttttgctccaaactcttcgtaggcttcgtcaggataacctgagcctactcccgcacctgattcaataattacttcgtgtccagcctggattaaattagcgaccgtgattggtgctgctccgatccgttgctcctgcgctttaatttctttaggtataccaattttcatgagattccattcccttcttttgtgaacaacttaacgactatcattaaaccggtacaatttacttattcaaacgtaccttacttcactaagttatcattttaaatccagggtagaatattctatcaacatcgctaaaaagcattgttatttcaacatttactactatttaattttacacctctggtcacctccaaccaccctttttcggttccagaataacacacttaagcgtaaattgcagtaagaatccaaataaaaagtctggttgatttcatccactaaaaacaaccagaccaattttattatctttctttctacaactaattaattattttacgtttttttgagtaatccacggggctttccattaataaccataaaatcaagtacacgatgattcctggaaaaataggtgtgaagcttacaagtaggtaaattattcggacgtgactagcattccatccgtaatgctccgatagtcctcctaaaactccagccaataaccgattatttgccgaacggtgaatgttaattttcatacgttttccctcctcgttatttttatcaattttaccattcaaatgatttacccggtattttattgcttcacgatcagctttttaaaaatcctccgtcggttagcatcccggggtaaaacgctctttattaaatgataatctcatttatattcatcaacaaaattaatttaatctcaaagacccgttctattttatcgctaagtttctattccaaaatagataacatgacaacttaattactagtcgcagttatgactgcacaaaaaaacaccctccatttctggaaggtgttgtaatcgttgtgtatagtaacgattaacgttttgagaattgtgcagccttacgagctttcttaagaccgtacttcttacgttccttcatacgagggtcacgtgtaagtaaaccagccttcttcaaaggtgcacggaaatcaggatcaacatccaaaagagcacgagcaataccatgacggattgcgccagcttgtccggagaatccaccaccattaacgttagcaataacgtcatagttgccgtttgtttcagttacgccgaatggttggataactacttgacgtaagtttgcaaatggaatgtattcttcgattggacgatcgtttacagtgattttaccggttcccggtacaagacgtacacgagcaacggagtttttacgacggccagtgccgcgatattgtgcttcagccaaaattcatttcctccttaaattaagttcgtgatgtcaagcttttctgggctttgagcttgatgcttatgatctgtaccagcataaacatgcaacttcaaaccaagcttacgacctagtgagttgtgtggaagcattcccttaactgatgtttcaatcaagcgttcaggagtcttttcacgcatttcacctgcagtcttcatcttcaaaccacctggatgcaatgtgtggtggtagtagatcttgtctgtcgccttgtgaccagtcaacttaaccttgtctgcattaataacgataacgaagtcaccagtatccacattaggagtgtatgttggtttgttcttaccacgtaaaatagatgcaacaactgttgaaagacgtcccaaaggaacatcggtcgcatcaacgacataccatttacgttctacttcacctggtttagccatatatgttgtacgcacttgaatttcctccaatttctgttttgtttaactcaactataataagtttccggggcttattttgtggaggtaaacaataccaacttccattatattgacagtctcggttaaagtcaatcaaaaatctaataatcgacttcttttaaatataacccacttgctggggcagttccccgggcttggttgcgatccttgaccgccaaaagccgcgggatatcatccactggccgccgtttactaccgatttcaactaaaacggccaccatgattcgcaccatgttatataaaaagccattgccgtaaaattcaaaaataatttcgttttgggcttcatccttccaagccttggcctcgtaaatggtccgcacgtgatttttggccgtgcttcccgaagccacaaaactagaaaagtcgtgggtaccctctaaatctttaattgcttgttgaatcaattcaatgctaatcggaaatttccaatgtccggtgtaattgcgtttaaacgggtcaacaaactcccctaacgccatccggtactgatatcgtttgccatgggtggtaaagcgtgcgtgaaagtcttcgtccacgatctccaccttttttacctgcgtatctaacggtaaaatactgttcaacgcgtgcaacatgttattggccgtcatttcaattggcaaatcaaaatgcactacctgaccaaaggcgtggactccggcgtccgttcgaccagaaccgaaaatcggaatttcaggttgggggttcttcgcaattttattcaccgcgcgttttaacactccctcaaccgttcgttggttaggctgcgcttgaaagcccgcaaagttagttccatcgtaagccattgtaatcttataacgcatgtcaacctcatcttctaagggcgataatcactactgctgcaagtagcatcgttaccgtcccgataatatcattttttgtataatttaaaacccggtacttactgcgcccttctccaccttgataaccgcgcgattccatcgccgtagcaagctcctcagcgcgactaaaggcactttcaaacagtggaatgaggatggccacgagcttctttaaacgcactaaaatcgacccagagctaaaatcagccccccgggaccgttgtgcatttaaaatcttttccgtctcgtcgattaatgttggcacaaaacgcaaagcaatcgacagcattaacgccatttcatagaccggaaagtgcactttctttagcggcataaagatggcttcaatcgctcccgaaatttccaagggagaagttgtcagtgtaagtacggtagaaactagaataattaaaataaaccttatcgcaatgtacatggcatttaaaagtccgttgctggttatggacagaattccccaatgccagtagacgtgacccccgacaccaaagaacacctggataatcatcgtcagtaaaatgaccccaattaacggctttaccccatcccaaaagaaacgtggaccaattgccgacgctgcgataatcaccattgctaaaacaaagcttgctaggtaagctgcccaactattggcaagaaatacggcgacaatgtataccaaacttaaaattagcttagcgcgcgggtccatttggtggataaaagaatgaccaggaatgtaccgcccaaataaaatcttattcacgtgcacggcccccgttctgcttaagctgttcaattagttcgcccatttgcagcggaactgggtcgaagtgcaatccacgttgcattaaccgttgggcaaactccgtaacctggggcaatcctaactggtgttctaataaccactctggagcgctgaaaacggctcggggacttcccaccttaataatttgtccgtcatccattaccacaacctgatcggcatagttggcaacgtcatccatctgatgggtcactaacaggattgttaagtgctcttgatcatgtaattccgcaaaaagctccatcatttcggtccgtccctgcggatccagacctgccgtgggctcgtccaaaattaagattgccgggttggttgctaaaattccggcaattgccacccgacgcatttgcccacccgataattcaaaaggtgatttttgccaagtgttttcgggcatgtgtacctttgcaagcgcctgctgagctcgttgagtcgcttccgcgtcacttaaaccaaaatttagcggaccgaatttaacgtcgtccaacacggtttccgcaaataactgactttcaggaaattgaaaaacaattcccacgtgctgccttagagccaccagtgccttattttttgtggttgcatcaattacttgattatcaacctcgaccgtccccgtcgtgggcttcaatagaccattaacgtgctgaatcagcgtcgactttccactaccggtgtggccaatgatcgcggtatacgaaccagtaggaatcgttaaattaacgtcctttaacgacagattttcaaaaggagtatgggcttggtaaacgtaacttactgatttgaacttaattgacatacccattcctccaatttagcttcgtccatctttaatgttggcggcactttaaacccgtgggccacaagctcgtcataaagctgcccactaaagggcttttctaatccagtctgttctaaaagctgattatccgcgaaaaccgcttgaggggtccctgtagtcactactttaccatcatttaatacaattacctgatcggctagcattgcttcgctaacgtcatgggtaattgaaagaacggttaaatcttgttgttggtgcacttggttgattagttgaataatttccgtgcgtccctgtggatcaagcatgctggtggcctcgtccaaaatcataatttccggtttagtcgccaacactccggcaatcgccacccgctgtttttgcccaccagacaactggtcgggttgccgggacttaaagtcactcattcgcacctgagtaagcacccgctcaacaatctggtgcatctccgcagtaggaattcctaagttttccagtccaaaggccacgtcatcttccaccgtggcgccaacaaactggttgtctggattctgaaaaatcatgccaatcttttttctgacgtcccataccgtatcctcactaaggggaattccggctaccgtgaccgtgccttcccgaaacgtcatcaatccgtcaattgtgcgtgctaaggtgcttttaccgctcccgttatgtccaacaattgccgtccaggttcccttttgaatagcgaccgagacatcatccagtgcttttttatcaccgttattagcgtatttatacgtaagatgctttacttcaataatgttttccacagtcctactctcccgatacaatatggaactaattttatcattgtatacaaaaaaaatcactgaagataaaggtagcaagtccgtaaactcgccgtgggctagactcggatttctccagcatcgtaacaccctaccaatatcttagtgatagattttgttattcttataattgcttagaattagtcaactaattctaagacaaccattggggcaccgtctccgcggcgtggcatcgttttgtagatacgagtatatccaccattacgatcagcataacgtggagccaattcagcaaataatttttgaagtgctgaagaaactttaacatcttcaccatcttctgtaacatcagcaacgacgttacgaacaaatgctgcagcttgacgacgggcatgtaagtcgccacgcttacccaatgtaatcattttttcagttgtagaacgtacttccttagcacgggcttcagttgtaacgatcttttcattaacaattaattctgttgtaagatcgcgaagcaacgctttacgttgggagcttgtacgacctaatttacgataactcatctatgggaaccctccttatgattagtcttctgaacggaaactcaagcccaaagcattcagtttttcttggatttcaacaagtgatttacgtccaaggttacgaactttcatcatttgagcctcagtgcgatcagttaattcttgaacactgttaatacctgctcgttttaagcaattgtatgagcgaaccgaaagatctaactcttcgattgtcatttcaagcattttttccttgtgagtttcttctttttccaccataatttcagtctctttagcctggtcattaaggtttacaaagatagcaaggtgttcagttaaaattttagcagataaacttgttgcctcactaggagtgatcgaaccatcagtccaaatatcgagcgtaagtttatcgtagtcatctcgttgaccaacacgagttttttcaacttgataattaacacgttcaattggggtataaatagaatcgattggcaatacgccaattggcatatccgcctttcgagccttgttttcgtccgcagaagtatatccacggccagtatcagcagttaaaacggcatggaatgtcgttccttctgcaacagtacaaattggtgaatctggattgagaaccgtaacatcaccgtctcccataatatcaccagcagtaacgttggcaggtcccactacgttgatatctaacgtcttttcgtcatcagattcaatctttaaggaaaccttctttaggttcaaaataatttgtgtaacgtcttctacaacaccttcaatagtggagaattcgtgtaacacgttatcaatttgaacactggtaatcgctgctcctggaagcgacgataataggattcgacgaagtgaattaccaagcgttgtaccatatccccgttctaagggttcaataacaaatcggccataattgtcattttcgtcaattttatgaatttttggcttctcaaattcgatcattctaatttttacccctttcaaaacgcagtctgcatttcgactttgaatgcattataaagtttgccctcaaacagaaccgaactctatacacgacggcgctttggaggacgagatccgttatgaggaactggtgtaacatcacgaattgcgcttacttcaagcccagttgcttggagagcacgaattgcagcttcacgaccagaaccaggtcccttaacagcaacttcaacattcttcataccatattccatagcagcctttgcagcagcttctgaagccatttgagcagcaaatggagtcgacttacgactacccttgaagccaagtgcaccagcagatgaccaagcaactgcgttaccttgagggtctgtaatcataaccagagtattgttgaatgttgaatggatatgagctactccagattcaatattcttttttactcgacgcttacgagtatttcttttcgttgccataaatgtttagcctcctttaattatttttttctacctgcgatagaaactttcttacctttacgtgtccgagcgttattcttcgtgtgttgtccacgaactggcaaaccacgacgatgacgcataccacggtatgaaccgatttcttggagacgtttgatattgagactaactgtacgacgaagatcaccttcaacaagatacttgtctacttctgcacgaatcttgtcttcttgatctgctgttaaatcgcgaacgcgaacatcttcagaaacatctgcgtcctttaagattttttgagcggtagtgttaccaataccgtaaatatatgtcaaaccgatgacaatacgcttgtcacgtggtaaatcaacacctgcaatacgggccattaaatttcacctccaagtataataattattttccttgacgctgtttgtgcttaggatttgctgagcaaattaccataacgcgtcctttacgtttaatgatcttgcaatgttcacacattggcttaactgatggacgtaccttcatgaataaatcctcctaaacgaataaaacttatttgaaacgataggtaatgcgacccttggtaagatcgtacggcgacatctcaaccgtaacccgatctccaggtagaatcttgatgtaatgcatccgaatcttacccgaaacgtgggcaagaatttcatgaccattttcaagctctactttaaacatcgcattaggcatagtttctttgactttgccctcaatttcaatgacattatctttagccactaaatttgtgcctcctaattaacttttctaacagtaaaaaccaacaaaaagcttcaaaatatgtattccgaagctaaacctgaatcagcttaccatacgaaaaaactatttgcaaacaatgaacgttatctatagtaccaacaagcacgaaattagagagcctctaatacttttttgacttcagaataaacatcgttgatatcctgatcgccattaatattgtaaaggagatgcttttcttcatagtaatcaatcaaaggcgcgttaagttttgtgttaacggcaattcgattttttaccgtttctggcttgtcgtcctcacgttgatagaattcatgatgtccgcaaacatcacaagttccttcaacctttggtggattgtagagcttatgataagtagctccacaattcttacaaataaatctgccagatagtctttcaaccaagacttcaggttcaacatgaatgttgatcactgccgtcaatggtttatttaagcgagatgtcatttcgtctaacgccttagcttgttcgaggtttcgagggaaaccatcaagcataaaaccatcattgacatcgtccattgctagacgatcttcgacaatcccgttagttacactatcgggaactagttcacccttatcgatgaactttttagcttcaatccccatcttggtttcatttttcattgcttcacggaaaatgtcaccggtggagatgtgcggaattttaaaatcctcaataatcttttgagcttgggtacctttaccagcaccaggcaaacccatcaaaacgaggtttaatttagtcattagtaattctccttcattgctaaacgacgaattagttacgaataaacccgatgtattctcgtttcatcattagaccttcaagttggtcaaacaactgaattgcaactccgaccacgattagtaagcttgtcccacctaatccaattgattcatctaaaccaaagatgttagatgcaagtaacggaattaacgcaactaaacctaagaaaagtgctccgactacgctcaaccgaatcaaaagactcgaaacgtagctttgcgttttcttcccaggccaaacacctgggatgtaactgccctgcttttgtaaattctccgctaatttttcgggattaacctgaacaaatgcgtagaagaacgtgaacaagacgattaacacggtgtataagattgcgccatctgtcgtttgcatattaaacacgttggtcaagatattgtaccaatcatcttctgaatgagatgaagcaaacgccattaagatggtctggggagttgaaataaacgaactagcaaaaattaccggaataactcccgcaacgttaacttttaatggtaagtaactgctgtcagatgcgcccgaagcccggcgtgtatattggattggaattttacggcttgcttgttgtacccaagttacgaaaataacaatgactaaaacagcaagtaaaattaatccaacatacaagaagctttggccccactgacttttcggcgtattaacaaactgttcagtataaatttgttgaattccagttggtgtccgggcaatgatccctgcaaagatgatcattgaaaccccttgaccaataccccgttctgtaatcatatctcctaaccaagttgttaacatcgttcccgctgttaaaatcaacccgatggttaagaaggtgtgtacatttggtgtttcaactaaattcatttgactcaagtagttaaaaccagcagtgattccgattgattgcgcaaaagcaaggacgattgttaaccaccgggttgcttgattaagcttccgacggccaacctcaccttgcttactccattccacaaattttggaacaatgtccatttgtaacaattgaacaataatttgcgccgtaatgtatggagaaactcccattgcgaaaatggagtagtttgtcaatccgccaccactaaaggtattaagaattccaactaatcccgaagaggaaatgctttgcaaagcatgcgcattaactcccggaacggtgatgtatgatcctaaccgaaatacaatcaaaataccaagtgtgaagaatatcttatgacggatatccttcacttttaaagcattgatgacggttgaaaacattaaatcacctcggtcttaccaccagcagcttcgattgcctttacagcactcgcagagaatttttgagctttaacagtgaatttctttgaaacttcaccattaccgagaattttaacaccgctaagttgtttcttgatgataccagccttaagcaatgcttcaggtgtaatttcagcaccttcgtcaaatacgttaagtgcatcaagattaacaattgcgtattctttgcggttaatgtttgtaaaaccacgttttggaatccgacggtaaagaggcatttggccaccttcaaaacctaaacgaacttttccacgtgccttttgtcccttttgaccacgaccagctgtcttaccgttaccgcttgaatcaccacggccgatccgcttgcggctagtccgtgagccttcgctaggctttaattcattcaacttcatgcaaggaaacctccaatcttacaatattattttacttcttcgacttcgattaagtgtgcaatgtggaaaattgctccacgagttgcctcattgttaggtaggacaaccgaactgttaacccggccaagacctaattccttaacaatttttctttgtttagggaggcgatgtgcggcacttttaattaatgtaacttttaattgtgacatcagaatatcctccttattcagctaaatgatcgactgaaaccccacgtagggcagcaacttcttctgcattacgcatgctcttaaggccttcgaaagtagcacggataacgttaactggagtgtttgaacccaaacgcttacttgtaacatcatcaacaccggctaattccataacggcacgaacagcaccaccagcagtaactccagaaccttcagcagctggcttcatcagaatccgtccaccaccgtaaacaccgatggcttcgtgagggagagttgttccaacgattggaacttcgatcaaactcttacgtgcagtttcaactgctttacggattgcttctggaacttcttgagctttaccagtaccaaaaccaacatgaccgttcttgtcaccaacaacgactaaagcagcaaaacgaagacgacgtccacctttaacaacctttgtaacccggttgatggcaactacgcggtcttccaattccaatttttctggatcgataaacttagacatgtacgtatttccctcctatccttaaaatttaagtccgttttcgcgagcagcttcagctaaagcttgcacacgaccatggtaaaggtatccaccacgatcaaaaacgacattttcgattttcttttcaacagctctcttggcaaccaaagcaccaacttgtgcagcagcttcagtctttgagccacctgaaacttcgctatctaatgttgaggcactaactagcgttacacccgctacgtcatcaattacttgagcgtagatgtttttgttagaacgatatacatttaagcgtgggcactctgcagtaccagagatttttgaacgaatacgtgcgtgacgacgttgacgtttcttattcttatctggttttgaaatcaaaattttcacctcatatttttaaattatcagctaactatatcaagctgctagattacttacctgtcttaccttccttgcggcgaacgtattcaccaacgtagcgaacccctttacctttgtaaggttctggtgaacgtacggcacggatttcagcggcaaaatcaccaacacgttgcttgctaattccactgatattaatgtgtgtgttgtcaggtacttctaccttaaggtcttcaggagcttccatttcaactgggtttgagtaacctaggttcaaaacaagcttcttacctttaagttgagcacggtaaccaacaccgactaattcgagtttcttttcgaaaccgttggttactccttcaaccatgttgttaaagttagcgcgtgtagtaccatgtaatgcgcgcatcttgttatcatcgcttggacgatcaaatgtaacaacatttccttcaacgttcattttaatatccgcactcattgtgcgtgttaattcacccttaggtcctttaacagtaacgacgtttccgtcttgtttaatttcaacaccagctggaacttcaactggttttctaccgatacggctcattgaacggcacctccttatctaaaaaattaccagatgtaagctaatacttctccaccgattttcttagcgcgtgcttctttatctgtgattacaccttcagaagttgagatgattgcgatacccaaaccattcaacaccttcggaacttcatcagcttttacgtatgaacgtaatccaggttttgaaatacgcttcaaaccagagataactcgttcgttgttctttccatattttaggaatacacgaatgatgccttgtttgtcatcgtcaatatattcaacatctttgataaagccttcgttcttaagaatttcagcaatatccttcttaatttttgatgcaggtacttctaaagattcgtgacgaaccatgttcgcattacgaatacgagtaagaaagtctgcaatcggatctgtcatagacattcagtattaccctcctttaactctgatttctttttaccaactagctttcttcataccaggaatttgtccttcatgagctaattcacgaaggcaaatacggcataaatggaatttacggtatacagagtgtggacggccacaacgttcgcaacgagtatatgcttgagttgagaacttagcaggacgttcactctttacaactaatgattttttagccaatttgtttgctcccttcgcttacttttcaaatggcattccaaattctgccaataattcacgtgattcttcgtcagtgtttgctgtcgtaacgattacgatatccaaaccacgaacacggttaacattatcaaaatcgatttctgggaaaatcaattgttcgcgaacacctaatgtgtagttaccgcggccatcaaaggcagtacggctaacaccgtggaaatcacgaactcgaggtaatgaaacgttgatcaacttgtctaagaagtcatacattctttcaccacgaagtgtaactttggcaccaattgacataccttcacgaagacggaatccagcaattgactttttagcctttgtaacaagtggcttttgtcctgaaataagtgctaattcagcaacagcttcatcaaggttctttgagttagcaactgcatcaccaacacccatattcaaaacgattttttcaatctttggtacttgcataactgatgtgtagtcaaatttcttaactagatcaggtgtaatttcgttaacgaacttttcttttaaacgatttgccatgaatttattttcctccctccgtttagattacttgtcgatactttcgccagtttttttagaaacacgaacttttttaccatcaacaaccttgaagccaacccgagttggttcattagttgatggatcgataagcattacgtttgaaacatcgattggtgcttcaatatcaagaattccaccttgaggatttgcattgttaggcttttgatgttttttaatcatgttaatgccttcaacaacaacacggttctttttagcaagtgtttgtttgatggtaccttccttgcccttgtcttttccgctgattacgcgaactttgtcgccaacttttacgaacatttaatggcgcacctccttcgttatgatggtcgattacaatacttcaggagccaaagaaacaatcttcatgtagtccttatcacgtaattcacgtgcaactgggccaaagatacgtgttccttgtggactcttatcatctttaattaatactgcagcattttcgtcaaatttgatgtatgaaccatcagcacgatgtgcgccttgttttgtacgaacaacaaccgctttgacaacgtcaccttttttgacaacgccacctggtgttgcttgtttaaccgtagcaaccacaacgtcaccaatgtaaccaaatttaacacgggaaccacccaataccttaataaccaacagttcacgtgctccagaattgtcagcaactttcaaacgactctcttgttggatcacagttagtgtcctcccttcaattttgtatcagaatacgaaacatgagctagataataactgctttttcaacgatatcaagcaaacggaatctctttgttgcagacaaaggtcttgtttccatgattgttacgatatcgcccttctttgcagcgttattttcgtcatgtgccttatatttctttgagtactttacacgtttaccgtaaactggatgtgtcttgtaagtatcgatttggactgtgatagtcttatccatcttgtcagaaactacgcgtccttggtaaacctttcgtgcgttacgttcttcactcattgactaagtcctcccttcgtattcttttacttgtttaattcttgttgacgtagagcagttttgatccgcgcaatgttcttgcgaacagctttaaggcgagcagtgttttcaagttggccagttgccaattggaaacgtaggttgaataactcgtccttgtactctttttccttgttgatcatttcgtcagtggttaattcattaatttctttagccttcatctgattcgccacctacttcctcgcgtgcgataatctttgtcttaacaggaagtttcatagctgccaagcgaagagcttcgcgggcaacttcttcaggaacacctgcaacttcaaacataaccttttcgcgttttactggtgcaacccagccttctggagtacctttaccattacccatacgaacacccacacctttagatgtgtatgatttatgagggaaaatcttaatccaaactttaccgccacgcttcatgtaacgcgtcattgcgatacgagcagcttcaatttggcggttagtaatccatgatgaagtcaatgcttgtaagccgaattcaccaaaagtaactgtcttaccgcctttagcggcaccacgcatccgtccacgatgttcgcgacgatgttttactctcttaggtactaacatgcttatttccctccttgttctttagagttgttattagcttcctttgcttcaggtaaaatttcaccacggtaaacccatgtcttaacaccaagttgaccgtatgtagtacgagcttcaacccaagcgtaatccacatcagcacgtaatgtgtgaagaggaaccttaccttcggaatagtgttctacacgtgacatgtcggctccgtttagacgacctgcaacttgtgtcttaatacctttagcgccggcacgcattgagcgttgcatagcttgtttcatagcacgacggaatgcaacccgtccttctagttgagcagcaatgttttcaccaacaagttttgcttcaagatcaggtttcttgatttcaacgatgttgatgtgaacacgtttgccagttaattcatttagttgtttacgcaacttttcaacttctgatccacctttaccgataaccatacctggttttgcagtgtgaattgaaatgttaacacgatttgcagcacgttcaatttcaacagtagatacggaagcatcagtgagttgctttgcgataaattcacgaatcttgatgtcttcgccaaggaacttagcaaagtctttatcagcataccattttgcttgccaatcacgaatgacaccaacacggaatccattaggatttactttttgacccacgcgttatccctcctatttttctgatactacaactgtaatatgacttgtccgtttgttgattggtgatgccgagcctttagcacgtggacggaaacgtttcaacgttggtccttcgttaacaaagactttgctaattaccaaatcttcacgatccaaatcaaagttattttcagcattcgccactgcagacttcaataccttttctacgataggtgaagcactgcgcggtgtaaatttaagaattgcaaaagcttcagcgacacttttacctctgataagatcgactacgagacgaaccttacgagcggcaatccgaacagtctttgcagttgcctgtgcagatgttacttgttcagccatgattcatcctccttactttccagatgtctttttgtcgtcgccaccgtgaccacggaatgtgcgagttggaacaaattcgccaagcttatgaccaaccatatcatcttggatataaactggaacatgttttctaccatcgtatacagcgattgtgtaaccgatgaaacttggaaaaattgttgaacgacgtgaccatgtcttgataactgatttcttttcttgatctttttgtgcatcgatcttcttcaaaagatgttcatcagcgaatggtcccttttttaaactacgacccattaatttgacctccttcgaaaactgttctagatattacctaagcgaccgcgtttacgaccacgaacgataaatttgtttgacttgttatgtttgttacgagtcttcttaccaattgttttcttaccccatggagaaagtggagatggacgtccgataggtgccttaccttcaccaccaccatgtggatgatcgttagggttcattacagaaccacgaacgtgtggacgttgaccagcgtaacggttacgaccagctttaccaacgttgattaattcgtgttcttcgttaccaacagcaccaattgtggcacggtttgtagcaagaatcatacgaacttctgaagatgcaagacgaacaagtgcatacttgccttctttaccaagtaattgagctgatgtaccagcagaacgaacaagttgtccacccttacctggttttaattcgatattgtggataactgtaccaacaggaatgtttgcaagtggtagcgcgttacctactttaatgtcggcttcaggtccagattgaacttggtcgccaacttttaaacctttaggagcaatgatgtatgatttaacaccatcagcgtaaacaagcaatgcaatgttagctgaacggtttggatcatattcgattgccttaactgttgctggcacatcgtctttaatccgcttaaagtcgatgatccggtactgacgcttgttaccaccaccacgatggcgaaccgtcatccgaccgtagttgttacgaccagctgaatggctttgagattccaacaatgacttttctggacgcttctttgtaatttcagcgtagtccaattgtgtcatgccacgacgagcattcgttgttggcttaaatttcttaatccccacgttgtttccctcctattttttattcttcaccaaataattggatttcttttgaatcttctgaaagttgaacgattgccttacgccgcttctttgtgtaaccagcgtaacggccttggcgcttcaacttacctttaacattcataatgttaaccttgattaccttaacatcaaagatctcttcgatagctttcttaacttgagtctttgtagcacgaggatctacgtcaaacgtgtaacgcttgtcgtcaatcaacgccatggatgcttcggtaacaactgggcgtaaaataatatcacgtgattccattatgctagagcctcctctacttgagaaagagccttttgtgtaatgacaagtttgtcgctattcataatatctaaaacgttgataccagttggttcaacaatttttacgttagataaattacgagcagccaatacagcactttcgttatcttcttcaagaactaatagagctttcttttcaacattaagtttgcttaatgattgagcaaagtcctttgtctttggagtttcgaacttaaattcatcaacaacaaccaagctttcatccaataccttttgtgaaagtactgacttcaatgctaagcgacgcattttctttggaatgctgtatgcgtatgaacgaggagtaggtccgaagacaattcctccgccacgccattgtggtgaacgaattgaaccttgacgagcacgtccagtacccttttgacgccatggtttcttaccaccaccacgtacagcactacgattttttactgcgtgtgttccttggcgcatagatgcacgttgcataactacggcttcaaagaccacatcgttgttgggttcaataccgaagatgtcggcatttaattcaacggttccgttttgagttccgtcttgtttgaataatgatacgttagccatttattggtcctcctctcttatttagatgtgttttttacagtactcttaacaactacgtatgacttcttagcgccaggtacgttacccttaaccaaaagtacgttgttttctgtatctgccttaacgatttctagattttgaattgtaactgtcttgttacccatgcgacctggtaacttcttacctgggaacacgcggttaataattgctcccaatgaaccaggacgacggtggtaacgagaaccgtgcgccatcggaccacgacgttgaccgtcttttttgataacaccttggaaaccatgtcccttagttgtaccagttacatcgacgaagtcacctgcttcaaagatgtctgctgcgatcttgtctccgactttaacatcttccccaagctcaacatctctgatttcgtgaatgaagcgcttaggatttgtatttgcttttgctacgtggccttgttcaggtttgttactcaatacttgacgcttgtcgtcaaaacctaattgagctgctgcataaccgtcgttttcaacagtcttaagttgcaatacaacgttaggagtagtatcgattactgtaactgggattaattcaccagcttcagtgaaaacctgtgtcattccgaccttcttacctaagattccttttgtggtcattagtacacctccgtttgtgctttaaaattataatttgatttcgatatctacaccgcttggcaagtcaagcttcatcaaagaatcaactgtctttggtgtagggttaacgatatcaatcaaacgcttatgtgtgcgcatttcaaactgttcacgagccttcttgaatttgtgtggagaactcaaaacagtgtaaactgtgcgttctgttggcaatgggattggacccgaaattgttgcaccagtgcgttttgctgtttcaacaatcttgtcagcagattgatctaaaatacgatgttcgtaagccttaaggcgaatacgaattttttgttttgccattgtgttacctccctcgtctattttaaaaataagacttgctccgtgaaaattaccgccacaccctgtggcaaagcggccgggtgtgtcgcaacctttcacatcaacgctctgcttatacaccaccgtggggagggcagcatgccccctcgtttttacacggtacttgattatgatacatgaaaaacgcccccgtggcaagggcatttagcgatttttttgcaaaaaaagaagttcccttccctaacgctttaaacgttaaaaaagagaacttcgattttagaaattattcagcttttccgccatttttcttgataatttcttcttggattgactttggaactggttcgtagtgatcaaaggtcattgtaaatgtaccacgaccttgtgatgcagaacgaagcgtagttgcatagccaaacatttctgaaagtggaacaaatgcgtggatttcttcagcaccagcaattgcttccataccttcaacacgaccacgacgagcagttacttgacccatgatatcacccatgtattcttctggaacacggatttcaaccttcataactggttctaagataactggtgcagccgtcttagcagcttcccgtaaagcgattgaagcagcaaccttgaaggcagcttcactagaatcgacttcgtggtaactaccatcgtataacttagccttcaagtcaactaatggataaccagcaagaacaccgttattcatagcttccttcaaaccttgttcaactgatggaatgtattcacgaggaactacaccaccaacgatagcgtcttcgaattcgaatcctttaccttcttcgttaggtgtgaattcgatccaaacatcaccatattgacctttaccaccagattgacgaacaaacttaccttgagcagaagtttgttttgtaaatgcttcacggtaagaaacttgtggagcaccaatcttagcttcaacgttaaattcacgcttcatccggtcaacgatgatatccaagtgaagttcacccattccggcgataactgtttccccagtttctgggttagtttcagcacggaatgaaggatcttcttcagcaagtttttgtaaagcaacgtccatcttatcttggtcagcctttgattttggttcaacggcaacttcgataactggttctgggaattgcattgattccaagtgtaatggatgatctggatcagttaaagaatcaccagtagtagtgttcttcaaaccgattgcagcagcgatatcaccagagaatacttctgggatttcttgacgttggttagagtgcatttgtagcaaacgaccaacccgttcacgcttgttctttgtagcatttaatacgtatgaaccagattccaaagtaccttggtaaacacggataaatgtcaaacgaccaacaaatgggtcagtagcaaccttaaatgccaaagcagcaaatggcttgtcgtcgccggcaatcaattgaacttcttcaccagtatcaggatctgtagcaccgtatggcttaacatccaatggagatggtaagtaatccacaacagcgtctaacatcatttgaacacccttgttcttgaatgctgaaccagcaagtactgggaacaattcaagtgacaaagtacccttacggatagcagctttgatttcatcagtagaaatttcttcaccgccaaggtatttttccatgatgttttcgtcaacgtcagctaaaatttcaagcatttcgccacgacgcttttcagcttcttccttgtattggtcaggaatttcaacggtatcccattcagtacctaattcgtcttcatcatacaagtcggccttcatttcaactaagtcaataaccccttcaaagtcatcttcggcaccgattggcatttgaattggtaaagcattagcttgaagacggtcacgtaatgattgtacggagaagtcgaagttagcaccgatcttatccatcttgttagcaaaaacgatccggggaacgttgtaatcagaagcttgacgccaaactgtttcagtttgtggttcaacccctgcttgtgcatcaagaacggctaccgcaccatcaagcacccggagagaacgttcaacttcgatagtgaagtccacgtgtcctggggtatcaatgatgttaatccggtggtctttccatgctgcagttgtagcagcggatgtgattgtgatcccacgttcttgttcttgttccatccagtccatttgtgaagcaccatcatgggtttcaccgattttgtggattttacctgtatagtacaagattcgttcggttgtggtagtcttaccagcatcaatgtgagccatgataccgatgttacgagtcttttctaaaggaaactcacgtttgttagccattatttaaagtttctccttccaatgaaatcaattaatagcctgttagaaaaaatgactactatatgcatccatataatagtcatcaatggttgcaacaagtaattgcaacgactgaattttaccaacgataatgtgcaaaggcacggttagcttcagccatcttatgtgtatcttcacgtttcttaacagatgcaccagtgttgttagcagcatccatgatttcacgtgcaagacgttctgacattgtgtgttcaccacggagacgagcgtagttaactaaccaacgtaaaccaagggttgtacgacggtctggacgtacttcgatcggaacttggtagttagaaccaccaacacgacgagccttaacttcaaggacaggcatgatgttgttcattgcttcttcgaatacttcagttggttgagaacccgtttccttttcgataatatcgaaagctttgtatagaatctttgaagcttttccacgcttaccatctaacattaaacggttgattaagcgtgtaacaagctttgagttataaattggatctggtaatacttcgcgttttggtgctggaccttttcttggcatttatacacgacctccttacttcttaggcttctttgtaccgtatttagaacggctttgtttacgatcagtaacccctgctgtatcaagtgcaccacggataacatggtaacgaacaccaggtaaatcctttacacgtccaccacggatcaagacaacactatgttcttgaaggttgtgaccaataccaggaatgtatgctgtaacttcgatcaagttagataaacgaacacgagcatacttacgcaaagctgagttaggcttcttaggtgtcatagtaccgacacgtgttgcaactccacgtttttgaggagctggattattaacttgagacttcttcatgctgttgtagccgtagttcaaagctggagcctttgacttcgagctttgagaacgacgacccttacgaaccaattggttaattgtaggcatcgatgtttctccttccaaataattgaaaaataatttaagtatttttaagtacacatatccaggcggttctttttttgctataaaaaaagatggccaggacgggtaccagggctaacgtttccagtcagcatgtctgcatttgcgcagagaacctgtccacaaaaagcaccttaaatagaatatcacgcaattttattgaatgcaagttaatcaataaaaaaaacgctccgttagtttcgtagttttatatttagttacggttactgaggaggcaaatgcaatgttactattctatcattttttaattttttactttggttgttcatggggatcttttttaatggctacttatcaacgtcgcttaaccggaggctccattacttttcctgcttcccattgtgattattgtttaactcccctaccctacttttgtttattccctatttttagctactgctttagcaaggggcgctgtcttttttgcggaaaccagattcccctcaaagtgctgggtctcgaagtcattagcgggatcagcttttggttaaccatacaactaactactggcgaaccctttacacttctaactctgttgattctaagttttcttagtgtagaagattacgccactagacaaatccactcccaaattttgctatttcccgcgctatttgaaacttaccaatcctttagcggtgtgaaatttgcagcactcgtgatattaaccgttttactattaaataactttgaaaaccagcgtttttttcaaaaaatgggtcaaggcgaccttgaagtaatggtttttctcgccctcctattcgggacgtccgtaacttcaggaattatttgcttagcctgcctaattgcgttagtgcgcataatggttaccaaacaacgaatggttgccttcgtcccctgcctttttgccgccaattggttagtccttacctatattaaccattcagctccacaactaattatgctaagataaccataatcaaatttagggggttaccatcatgcaaaaaatttatttcaatcacgacggcaacgttgatgatttagtttcgttgattttattactcgcttttccagatacggaaattgtcggggttagtgccgtgggcgccgactcttacgtcgaacccgccgtttcggcatcgcgcaaaattatcgatctattcggttcgcctagccaactcgaagtggcccaatccgactcccggccggtcaaccaatttcctaaggaatggcggctaagtgcattttcgttcgatgatttcccgattttaaatgaacacctcaatgagggtaatccccaaactcggttagctaaacagccggcgcacctcgacatggtccaaaaacttcagcaatcatctgtgccagtcaccctcgtaatgactggtccattgactgatttagcacgtgctttagcagttgatcccaccatcaccgccaaaattgatcggctattctggatgggaggttcaatgaacgggatcggaaacgtagccgaacctgcacacgacggcactgctgaatggaacgctttttgggaccccgaggcagtgcaaactgtattcgatagcgatttaccgattactatcgtcagcctagacagtactaaccaagtccccctcaccactgcgctacgtcaacgttgggcaaaacaacggcggtaccccgctctcgacttgattggtcagggttactcgttagtgcactctttcgaagctaattcaacttactacctttgggacgtgctcaccaccttgattagcaagtatcctgaactagtttctagcaagccgcttaatgtaaaagtgatttctaaggggatttcagccggaaaaacgtatccggatccgacgggtcgtcccgtcacctttgttacccaagttaatgcagacgccttttacgaccgcttcgaccagctcgcccaaagtctgcgcagcaacttctaaaactaaattccattccctaacaaaaaagggtgttccaagtcaaaataacttggaacacccttttaaaattcacaattaattttcaattgtttcgttcatttctttttcaacgtcgcttaacgtttgtggttgttcagtattgccgccaaccacttctggtttaatttgacggtagtctgtcattccagtaccggcaggaataatcttaccgataataacattttccttcaaaccaaccaacggatcgttcttaccgcgaatagctgcgtccgtcaatactcgggtagtttcttggaaggaagccgcggataagaaactattagtttccaaagcagccttagtaataccaagaattactggacgagatgttgccggaattccaccagcgatcaaggtcttatagttatccttcttgaagtcgtcgatgtccatcaacgttcctggaagaatatctgtgtcacctggatccataacccgtactttccgaagcatttgacgaatcatgatttcaacgtgcttgtcactgatttcaataccttgcatacggtaaaccttttggatttcactgagcaagtagttttcagtagaaagtacgtcacgaaccttgataagcttcttcggatcgatagaaccttcgttaagtggtgcaccacggtggatgtagtcaccttcagctaccttcatgcgggcagtgattggtaagctatacgtccgggtatctgtttcacccttaacggtaacttccttagtaccttcagcaggatcttcttcaatggattcaaccaccccagtaacttcggaaatttcagcaggtcccttaggattacgtgcttccacaatttcttggatacgtggaagaccttgggtaatatcggcgttaccagcaaccccaccagtatggaagttacgcatggtaagctgagtacctggttcaccgattgattgagcagcaactgtaccaactgcttcaccaacttcaacccggtccccagtagccatgttccggccgtaacacttttcacaaaccccgtgagccgtgttacatgtaaatgcggaacggatagttacttcttggataccagcatcaatgatttcttgtgcactacgttcgtcgatcatttcgttttgacccacgatcaccttgccagtttctggattgataactgacttcatggtgtaacgaccaaggatccggtcgtaaagtggttcaatcatttcgttaccttctgcaatcgcagtgatcaatagaccgcggtcagtaccacaatccttttcacgaacgataacgtcttgggcaacgtcaaccaaacgacgagtcaagtaacctgagttagcggtcttcaaggccgtatcggtcattcctttacgagcaccgtgagtagaaataaacatttccaaaacactaagtccttcacggaagtttgacaagattggcaattccatgatcttaccgttaggcgcagccatcaaaccacgcattccggcaagctgcgtaaagttagagatgttaccacgagcaccagaatccgacatcatgaagataggattttgtggatcgaaggtatccatcaaccgttgttgaatttcatccttagcatcgttccaaattccaataacccgttcataacgttcgccatccgtaatcaaaccacgacggaattgtttagtaaccgttgcgaccttcttatgcgctgcagcaataatcgtaggcttgtccggcaagttggtaatatccgcaatccccacggttaatccagaaagtgtggaacggtagaaaccaaggtccttcatccggtcaaggagcaaggaagtttcggtaactttgtattgcttgtaaacttccgcaattacatcactcaagaacccagacttgaatggtgaaagtagcggacgttggttcaattgttcatgaatatcttcaccagcttcaaggaagtattcatccggcgtaccgttaactaagttttcgttagttggcgcgtttagataaacaaaatcctttggcaaaatgtcgttgaacaacatcttaccagccgtggtgatcaaaatttgttgccgttgttgatcggtaaatggcttttcaggcattgaacttgcccgcaccccaattcgggtgtgaattgatacgtaaccattttgcaaagcaagtttaacttcgtcgaggtcgttaaagatcattccttccccaacgctttcagcacgttccatggttaaccagtagttaccgataaccatatcttgagaaggcgtaaccactggcttaccatccttaggtgccaaaatgtgatgagcagcaagcattaagagccgtgcttctgcttgagcttcgttagatagcggaacgtggatcgccatttggtccccatcaaagtcggcgttataagcttcacaagctaatgggtgaagccgcattgccttaccactaacaaggactggttcaaaggcttgaataccaagtcgatgcaaagtaggggcccggttcaatagcacgggatgttccttaataacatcttctaaaacgtcataaacttcttcgtctttacgatcgattttccgcttagcgttcttaatgttagaagctaagttccggctaaccaattccttcataatgaatggcttgaataattccattgccattggaactgggagacccatttggttcatctttaatgatggaccaacatcaataaccgaacgtccggagtagtcaacccgcttaccaagtaagttttgacgaaaacgtccttgcttacctttcagcatgtgagagagtgacttcaacggacggttaccaggaccagcaaccggacgaccacgccgaccattatcgatcaacgcatctaccgcttcttggagcatccgtttttcgttttgcacgataattcccggtgcgttcaagtctaataagcgtttcaaccggttattccggttaattacccgccgatacaaatcgttcaagtcggaagtagcaaaacggccaccatccaattgaaccattggacgaagatctggcggaataactgggatagcatccattaccatccaatccggatggttaccagacttgatgaaggcttcaataatgtccaaacgacgtacggcacgcgtccgtttttggccagaggcttccttcaattcttcttttagtaagttagcttctttttctaggtccacgctttgtagcaaggcttggatagcttccccaccaatcttagctacgaaacgatttccgtattcgtctaacttagcccggtattcacgttcagttaacaattgcttcttttcaagtggagtatcaccaggatcaacaactacgtaagaagcaaagtaaataatttcttccaatgaacgagggctcatgtcaagtactaagcccatccgacttggaatacctttaaagtaccagatgtgagttactggggctgcaagttcaatatgtcccatccgttcgcgacgaacttttgacttagtaacttcaacaccacaacgatcacaaacaattcccttataacgaatccgtttgtactttccacaagcacattcgtaatccttagtcggtccaaaaatgcgttcgtcgaataacccatctttttctggttttaaagttcgatagttgatggtttctggtttcttaacttccccatacgaccacatccggatcttatcaggcgaagctaaaccgatttgcatactttcgaatttattaacatcgatcaacggactgacctcctctttcttttataaaaattaattttggttgttttcagtttccacaggagtagattccgttgttgacgagtcagcttcgttagcattagccgccttttgcttttcggcatacttgcttagagcatcaacgttgacaacttcatcatcatcttcgtccatatcacgaagttcaacctcttgcttatcttctccaagaaccttcatgtctagtcctaaagcttgcaattccttaaccaacacgcggaatgattccggtacgccaggacgaggaattgattcacccttcacgattgcttcataagtcttaacccgtcccacaatatcatcagacttgtaagttaagatttcttgcaatgtgtaagctgcaccataagcttcaagggcccaaacttccatttcaccaaaacgctgtccaccaaattgtgctttaccaccaagtggttgttgcgtaactaatgagtaaggtccaatagaacgagcatgaatcttatcgtcaaccatgtgggcgagcttcatgtagtgcatgacaccaaccgcaacccgttgttcaaacggttcacctgttcggccatcgtacaatacagacttcgcatcggagtccataccagcttcggcaacggcttcccaaatatcttcgtcacgagcaccatcaaaaacaggtgtagtcatgtgaattcctaggttccgagctgccattcccaaatgcaattccaaaacttgtccgatattcatacgggaaggcacacccattggactaagcataatgtcgattggagtaccatctggcatgtatggcatatcttcttctggaataactaccgaaacggtacccttgttaccatgacggccggccatcttatccccaacttgaagcttacgtttttgagcaatgtaaactcgaaccatcatgttaacgccaggagaaagttcatcaccattttcccgagtgaagatcttcacgtcttggacgataccgccgccaccatgtggcacacggagggatgtatcgcgaacttcacgagccttttcaccaaagatagcgtgtaacaaccgttcttcagcggaaagttctgtcacccctttaggagtaactttaccaactaagatgtcgccatcttggacttcagcaccaatccgcacaattccgtcttggtcaaggttacgcaatgcatcttcaccaacgtttggaatttcacgggtcatttcttccggtcctaacttcgtgtcacgcgcttctgattcatattcttcaatatgaatagaagtataaacatcgtcacgaaccaagcgttcgttaatcgcaatcgcatcttcgaagttataaccttgccacgtcatgaaggcaatcaatgggttttgaccgagcgctaattcacctaattccattgatggaccatcagccaatacatcgtcggcgtcaaccttgtcgttaacccgaacaattggacgttggttgtagttcttaccgccgttagaacgacggaacttcatcaatttgtaagtgtctagtgcaccgtcatcacgacgaacccgaatttcacgagcatcaacgtattcaacaaccccaggatgttgacataacaaagcaactcctgagtcgtgtgcagctttatattcaataccagtaccaatcaatggtgcgtgagggtcaagcaaaggaaccgcctgacgctgcatgttcgcacccatcaaagcacggttagagtcatcgttttccaagaaaggaatacatgccgtcgcaaccgcaactacttgcttaggtgaaacgtccatgtagtcgacgttttcaatgctggtttcaatgttgtcactttcatgacgagccataactacgtcatccacgaaggaaccatcgtcatttaacggcgagttcgcttgggcgataacgaattggtcttcttcgtcagcagtcaagtaatcgatccggtcggttaccttgtgatctttccaagaaacccggcggtatggtgtttcaataaagccgtaacggttaatctttccgtaagaagccaagttattgatcaatccgatattaggaccttcgggagtttcaattgggcacatccgaccatagtgagtatagtgaacgtcccggacttcgtatccagcacggtcacgagttaaaccacctggtccaagagctgaaagacgacgcttatgcgacaattcgccaagcgggttggtttgatccatgaactgtgacaattgtgaagaaccaaagaattctttagttgctgccactactggacgaatattaattaattgttgtggcgtaacggtttcggcatcttggattgacatccgttcccgaacaacccgttccatccgagctaaaccaattcggaattggttttgtaacaattcaccaactgaacgaatccgacggttacccaagtgatcaatatcatcagtgctaccaattccttgttgtaataggaagaagtagttaattgaagcaataatatcggcaggagtaatgtgcttgagcttcaaatcaatgttcccattaccgatcatctttaattcacgttcaggatcgttagggtcttgaatcttaattacttgaatcgtcattggttctggaactaccgcttcatcagaaggttggtaagtaaccatcttgaaatcttgacgatcaaggtaaggtgccaacttcttcattacgtctttgtcaacaacgtcacccttttgagccaatacttcccctgtatctgggtcagcaagggtttcagcgagggtttgacctagcaagcgggtcttcaagcttaacttcttgttaaccttgtaacgaccaactggtgccatatcgtaacgctttggatcaaagaagcgcgcagtcaataagctccgcgaactgtccgcagttttaggttcaccaggacgaagacgttcataaatgtcctttaaggattccgcaactcgcgaatcttccggatttttatgcacatctttatcaagggtaaagtctaaactgtctgacccaccaaagatatcaatgatttcttcgtcagaaccaaaaccaagtgcccgaactaattccgtcattggaatcttccgagtccggtcgatacgaacgtaagaaacttccttagcatcagtttcatattctaaccaagcaccccggttaggaattaccgttgcgccccaaatattacgattatttttgtcaacgtctaagttgtaataaacccctggtgaacgaaccaattgtgaaacaataacccgttcagcaccattaataatgaaagttccttgttccgtcattaatgggaagtcaccaaagaagacgtcttgagacttgatttcacccgtttcatggttagtcaaccgcaacgtaacgtgcaatggcgcagagtagtttgcttcatgttcacgagcttcatcaacggtatactttggttctaacaactgatagtcaacgaactcaagtgacaatttaccggcaaaatcttcaatcggcataatgtcgttgaacatttcccgaagaccttcgtctaagaaccattggtacgaatccgtttgaatctcgattaagtttggtaaatcgagtacttctttaattcgtgcatagctccggcgcgtacgatgtttaccatacttaactaaatgtcctgccaagttattcacctctccaatttctaagacaagttaaatgttacaatttgattacaaattgatccagcacctgttttttagcaaaaaaaaaccaaaaacagttcctaattcaagaaactatttttgctttttttctaaaacactgcggacaatagatcgcactgtttcatttaacccagctttaacatacagattatattctatgctcttttaaaagctttgtcaaatcatttatttacttgtactgcttaccggtttagcatccttcactttaaaagtgactttgtggttgcgagccccgatcgtcacgtcgtcgcctaccttaacttgcccagcaagcaacatttcactaagttgatcttctacttgtgtttgaagtgctcgacgaattgggcgagcaccgtattcaggatcaaacccggcttcggctaccacgtcaattgcggctggagtgaacttcatgttaattccttgcgcactcatccgccgaataatatccttcgacatcaattttacaatttgatgcaactctggcttggttaaggaatggaagacaatcgtttcgtcaatccggtttaagaattctggtcggaaactttgcttcaagacttccttaacctttgcagccattgcttggtaatcatcagccatgttttgggctccaaaaccgactgatttttcatcccgcaacgccgtcgcccctaaattagaagtcataatgatgatcgtatttctaaagtcgacccggcgacccttcgaatcggtcaagaatccatcatcgaagacttggagcaacaaattaaacacgtccggatgggccttttcgacttcatcaaataagactaccgagtatggcttgcgccgaacttgttcggtcagttggccaccttcgtcatagccaacgtatccaggagccgaacctactaaccggctggtgctaaaacgttccatgtattccgacatgtcaatccggatcatgttatcttctgaaccaaacattacgttagcaagggtcttcgccagctccgtcttccctaccccagttgggccaagaaacataaatgaaccaattggtcgtttaggatttttcaatccggaccgggcccgtcggattgcccgagctactgaagaaacggcctcgtcttgcccaattacgtgttcgtgcaagattttttctaagttaaccaaccgttccgattcagattgcttcatttgagtaaccggcaccccggtccaatcggaaacaatttgagcaacgtcttcaccagtttcttgtaacttatattcaaccggctgttccgcttctgcttgccgggcagctgctcgttcgacctttttccgcagtttcatttcctttttccgaatttcggccgcggtttcaaagtcttggcggtcaatggcggcttccttatctgccttcaaccgagctaacttatcttcgtcagtttctcgtttactctgcttttcggcagcgtcgattcgaatcttagcggctgcttcgtcaattaaatcaatcgccttatcaggaaggaaccgatcggaaatgtaacgagccgacaagtttaccgcctgttgaattgcttcatcagtaatccgaactttatgatgctcttcatattttggccggattccttgtaaaatttggactgcttcttcttgggtaggttcatcaacttctaccttagcaaaccgtcgttctaaagctgcatccgcttcaatatatttttgatattcatttagggttgtcgccccgatggtttgtagttctccacgcgctaacgccggtttcaagatgttggaagcatcaatggcaccttccgcaccaccagccccgattaaggtgtgtaattcgtcaataaataggataactttgccatcttggcgaatttcttcgataaccttcttcaagcggtcttcaaattcgccccggtacttggttcccgcaaccaacgcacccatttcaagcatcatcaagcgtttgtttttcatatcttcaggcacgtcatcggcaatgattcgttgtgcgagaccttccgcaatcgccgttttaccaactccaggttccccaatcaataccgggttgttcttggttcgccgactcaaaatttgaataacccgtcggagttcgttttctcgcccgatcattgggtcaattttgccggcttccgccatggcagttaaatcccgggcaaccgaatccaacgttggagttcccttcgttgtcgtcgcccgttgcttagcacgccgactttgggttgctgggttaacccccagcttacgtaatgttactttacggacgtccgcaacgtcagtatccaacgctaacagaactcgcgaagataagatggtctcatcttgaatcagcgctaatagaatgtgttctgtaccaatcttagcagcttttaattgccgcgcttggtctcccgcattcgctaaaatctctttagcctttggcgaatatggcaagtaatcatttttggttaagcgtaagttgccgtaacccgtaaactgctcaatttcttcaattacatcaatttcggtgacattaaattgttctaacacactgtgggcaacgccgttgttttcaatcgttagtgctaatagtaaatgctccgttcccaccgcgggatgtttaaaccgtttggcttgctcttgagcaataattaacacgttgcgtgcgctaggagtaaataaattttccattgtccacctgtctttctctaaactcgttactcatatcgaaggtgatttaaaactccgataatgatttttgcgcgaatctggtcttctagtttccgatcgccaatgtttaaggtactcttggcaattgttgcagctagtagattagcttcccgcttacttaaaaccgcatcttcatataaactgcttaaaatagaaattgcgtctcgttcattaattgaatcgccaatcacccggatcaacgaatctaatacgtcaatatcatctagcaatttaactttttcaatccggatatagccaccgccgccgcgcttactttcaactaaataaccgttttggatggtaaaccgggttttaattacgtagttaatttgggatggtactacgtcaaactgatccgcaatttcagaacgccgaatctcaacttcctccgaatcagctaaaatttctttcaagtatcgctcgattatatccgaaatattctgtccttgcataacgaccacctctccctactttgactaatattgactattattatacgaaactggtcggcaattgtaaaagatattgttcaaaattatcggtattaaccggtttcacggtatttttccgttcttgggctaagagcacaaaaagaagtggcgtttagaatttaattaaattccgcttccacttcttttctgaaggtttctatcttattttaaatgagtttaaaatgcaagcttagtaaactatttttccacaccaaacttagcaaagtaatccgttagcggcttcaattcagctccatcgtagtcgctaaagaaatcactgactgacttttcaccgtgggttgcttgataagcagctgagatcttttcggtgaagtttaccgcttgattgtcgaattccaattcttcaacaggcaatccccgttggtcggtaattttagcgtcaattactactggttcgccagctttttgatattctaacgccttatcaaaggccgctggtaattcatctaaggttctaattgtaattccctttgcacccatcgcttccgcaattttggcatagtcagcgtcttcaagatcaattccagaatgattcatttgaatatcatcttgttctgacttaataaagttaagggtttggttagaagtgatgatgttaataattggcaagtggtatttcacttcggtcaacaaatcgtgaattaccattgaagctgccccatctcctgaaatactaaacacttgccggtctggatatgcaagttttgctgcgattgcagccggaattccgtagcccatcgtggcaaataatgcagaaatcgtccactgcttatcgcccttcaagtcaaggaagcggaaggagttgatgatgttgtcaccagtatcaatgccaaagaccgcatctttatccgcaatccggttaatttcccgataaatttgttcgtaagatagcggaccgtccgccttcttcattaacttattcaagtatgctttccaatcttgcatgtcggcaaccgttgcttggtagaatggccgattttcaacagcttcggaccgttccaaaactttttccaagaacttgcccgaatccgcccagattcctaagtccaagaagtgatgacgtccgaattgagattcgtcgttgtcaatttgaacaaacttgaaatcatgagtccggtaaactaggttggcaaacgggaagtcagtgccgagcgcaatcactaagtcagcagttgcaaaggcttcgtcagctgccttggatgctgcccggttagtggtacccaagttaccttcccaatcatcgtcaaccttaccttttgctagaccagtaatggttacggggatttgtagtttttcagcaactttcttcaagagatcttgatggtccttaattccggaacccacgtggaagactggccgcttagcttcgcgaaccatcttcaagaattgatctacttcttcgtcagttggtgtttgtttaggagtttgcttttctaataacgcagtcgaagcataatttacgtccggaatctgaacgtaaccgaaatcattaggaattaccactaccgctggtccgcggtttttgtacgctgcccgaatagccttatcaaccacgtatggaagactttccggggtcattacgcagcggtcataaacggccacgtcctggaacattggaacttcaggaaattcctggaagaaatcgtaattcatgttgctatgaggtacttgcccaactagtgccaacacgggggtatggtcttccttagcgtcatataaaccattcaacatgttaaccgcaccgggacctgctgaaccaaaggcaactccaatcttgccggttagctttgcttcagcagcggcagcgagggcgccaacttgttcatggcgaacttgcacatattggattcgatccttttctaggtctaaagcgttcattgttgaattaaacgaaccacctggatatccaaaaacacgtttaatatcccaagcctgaaggactcttaacattgcgacacttgctggtacagtcttttcactcatctaaacttacctcgattttttatttgtaatgatgtaaccgattacaaatattaatttacaactatacttactttatgtcaacatttttgtctgcgctaacgaatatcgtggattttaagcaccctgtttcggattttttccctagataaattcatctcataagtaatcacttaccctaactaattccgcaacaggtactggaaacttccgctcaggctcaaaaataaaaagcattttccaagaacttaaaattcttgcaaaacgctttttatttcggtgacttggatagtgaccaatatggtcaaaaagtcactttattcgcttaatcgataaatcgggaaaacaggatttgaacctgcgacccccacgtcccgaacgtggtgctctaccaagctgagctatttcccgagcaacttcgtattagaagcttaaaaatgaaaaagcactactcagccatgctgaccaatgcttaatcaatgcacccagtaggactcgaacctacaaccttctgattcgtagtcagacactctatccagttgcgctatgggtgcaaataatcaatcgttaagaatactcgcaagagcctttcaacacttaaaaattatatcacaaaacttaattttcgcaattgctgtttttcacaatggcacactttgccaattaggcaatttcaaaataatccgaatctcccgtcacgttggttcaggacacaaaaaaacgccaatccaacgattgacgtttaaaggatgcacccagcaggagtcgaacctgcaaccttctgattcgtagtcagacactctatccagttgcgctatgggtgcataattattaagttaaagcggaagacgggattcgaacccgcgacccccaccatggcaaggtgatgttctaccactgaactacttccgcaaaatgccgactagaggattcgaacctccgaccctctgtttacaagacagatgctctgccaactgagctaagtcggcttaatccctatgcgggcgaagggattcgaacccccacacctttcgatacaagaacctaaatcttgcgcgtctgccaattccgccacgcccgcatgtaacatttaaaaccactgagaataatctcaatggaggatacagggctcgaacctgtgacctcctgcttgtaaggcagatgctctcccaactgagctaatcctccataaacctcgtgaacacatttatatataatacggattaaaccattagttgtcaatcacttttttaaactttttttcgaaactctaaattaaaccgtttgctacgaatgattgcccactacatcggcacgtaaaatggtcaaaaaattggagctgtgacaaaaatctctaaacaaaaaacggttcatgaggaaacttcacctcatgaaccgtttttattttggtgttttgacttcaatagagccaaaacgtgtgccaaaagtcagtttgttccgcttaacccaaaattgaccatcatgccaaaatcaggcataatggtcaattttcagttaatgctcgcaaactaaccgacttttgtcccactctcttatttataagcatcccggataaaacacccaaccatgccgttattttttatcctaaattattacttcttaccaattaccttggttccttgcatatatggtaccaaaacgtctggaacggtaaccgtaccatcttcattttggtagttttccaaaattgcggctaccgtccggccaacagcaagtcccgaaccatttaacgtgtggacatactgtaacttaccattttcatcgcggtaccggatgtgagcacgacgcgcttggaaatcagtagtgttcgagcaacttgaaatttcgcggtacttgttttgcgctggaatccatacttctaagtcgtgagtcattgcagccgtaaaactcatgtctccggtcgtcaacgtaatcacgtggtatggcaatcctagcttttgtaaaagggtttccgcgtggcgcgtaagtttttctaattcttgccaagaatcttctggttttgtgatcttaaccatttctaccttattaaattggtgcatccggattaaaccacgggtgtcccgtccagcgcttcctgcttccgaacgaaaggctggtgaaagtgcagtcacgttaattggcaactggtcttcatccaaaatttcatcccggtagaagttaactaatggcacttccgccgtcggaattagagttagtggttcatctttaatttcataaccagcgtgcgtttccttaaacttaggaaattggccagttccaaacatcgacgcatcattaaccatgtaaggcgtgatttcttcggtaaatccggccgccacgttttgatctaagaagaaattgtaaactgcacgttcgagacgcgcaccatcgccaacgtagtaaacaaaccgactaccagcaaccttagcagcccgttcgaagtctaaaattcccaaatcttcgccaatttcccaatgggctttgggcttgaaatcaaacttccggggggtgccaaatttacgtaattcaacgctgccttcttcggttaagcttaccggtacgtcaggatgtggtaagttaggcaagtgggccgcttggtcttctacttccgcagcaaccttttctaattgctcatcgagttctttaatttcttggctaactttccgcattttttgaattggttcgttagcatcttcgtggttacgtttcatctgggaaatttggtccgaaacgtcattccgaactttctttaagctttcgctctttacaatcaactcccggcgttggttatcctttgccaatagctggtcaatcgtttctggttgaaccccacgggtagctaacttttccttaacttcatcagtatggttacgaatcatctttaaatctaacatgcaaattcctccttactaaaatcaaaataaaaagagcctccctcccaattgggacgaagaggctcttttcgcggtaccacccaagttcaccattactggcgcactttcatgatggtaacggaatcaccgaatggcattacccatttgtttaatcagcgccggagtttcggttagccctttccaccatccgggcctctctaaaaacctacttaaaacgccttgttaacaactgaactatttaattgttaaccgtattatacaaaaaagatgcaacttccgcaattaaatttgcgaaatcttttcttcaactaattggataacttgttgacgagcgctagggtcttccacaaagtcatacttatcgccatcaattctaatcttggcactttggtcgtagttttcaaaccacgatacgtaacgccgatttaattccttatagtaatcgtataaggacggatcgttttcaatctgttcgtacgaacgaccgcgttttttaatccgttttaacatggtatcaaacgaaatatcaatgtgaatcaaaaggtccgggtttttcttgtatgaaagccgtggtaattcttgcatcatgttgctcaacaacgaatcgtaaatcttgacttcggtttcggtcgcccgtcctaaatcagcgtttagatggaagagtaacgaatcctcataaattgagcgatccattacgcttctaaatccgtcgttagcttgcttgatgctatctagccgtttgtttagaaaataaatctgtaataaaaatgcgtaacgttttggatccttatagaagagcggcaaaattttgttgtcatctaccgattcataataagcatcgctaccccaatgctgggttaataattccgtcagtgacgtcttgccggcgccgattggacctgataaagcaatcatttaagatacccctttttcatttaatagcaccacatattgtaccaccaaacgaacgcaaaacaacatcttgaaaaaatcactttttcgtgatattcggccgacttaagtcgatctcctctaatggaattaatttagtcttatacttaattttgtaatatgcaaaaagcactataaatagtggaaccgacatgtaggtaatcccaatcgcctgccagttaaggttgattaaggaattaatgtcctgtcctaagataaccacaatacttaacacgaaggcaaacaacggtccaaatgggaaccactttgctcggtacttcaattcgcttaaatcatggttttgcttgacgaatgcgcgccggaaccgccaatgagatacggcaatccccatccaggcgataaagccggtcaacccgctagccgcaactaaccaagcgtaaatcttagttcccataatgctggtaataaaggttaataacccgaccacggtggttccaattagcgccacgtaaggaatcccccgcttggtcgtccgaccaaagatcttcgctgcgtagccttgctttgccaacgagaacaacatccgtgaagatgcgtacatccccgagttagccgaagaaagcaccgatgtaaggataatggcgttcattacccccgctgcacctgctaaaccagcccgccggaatacaagggtaaacggactaattgaaacgtcgcttgccgaagttcctagcaaatctggactagtatacggtaagagacaggcaattacgaaaatcgctaaaatgtagaataataaaatccgccagaaaacttggttaattgccttaggaacgctgctttccggagtttctgattccccagccgtaatcccgattaactcggttccttggaaagagaatccggcaacgacgaagacgcttaagattgctggaattcccccaacaaacggtgccttccggtatacaaagttttctaagtaagttgcgtggccacccataatcccgaaaatggtaagggttccgactgccaagaaaacaaagacggtaactaccttaattaaggctaaccagtactcggtttccccgaacgctttaacggttaacgcattaatcagaactaccagtgctaacgcaatcaaactccagatccatcccggaacgttaggtaaccagaatttcataatcagcgcaatcgtactaatatccaccgcgaccgtaatcgcccagttgaaccagtagttccaccccattgcaaacccaaaggcaggatccacgtacttagaagcgtacgtagcaaacgatcccgaaactggcatgtaggtcgccatttcgcctaaactagtcatcaagaagtacaccataattcccatcccgacgtatgctagtagggcaccacccgggccggcttgagaaattgctaaaccactagcgacgaacaggccggtcccgatactgccgcctagtgaaatcattgagatgtgacgagtcttcagcgcccgctggacgtgattgccgctcgcctgcttttgtaactgtgccataatagagaacctcctaaaaattaaaagaggcgctgtgattatcccagaacaaaataaaaagcctttttgcgcgcacttacacaaaaagaccgtttaaaatcgttagtcaaatcgtagatagcgctccgcaaccgtaattgcgacagtccttggcttattcaaccaagtcccaaatcgtgcagaattaagtctgcagtcatttcggcctcgttacctttctccctgggtcccagatgcttaatcatcttaccagggttactcatcattgaggcgacctcttctttcgatgtgattcaaattatagcaaacttgattaattatgcaagcttaaggttcaattcgtataaatattctttccggacgcggccgtcatacccggatacattttcaaacaccaccggttggcgaataaaaccattcttttctaaaactcgctgagaggcctggttatccgttaaaacgttggcctgaacttttacggttcgccccgttgctgattgccgattccttaaactcttcaacgcaaaatggactgcccgcgacataattccttggttccaatactcttcagccagtaaatatcctagttcaaaaacggcttcttccgcctgctgaaaaataaagattcccccgctcaaccggttttcctcgttaacaatcgctaggaaattcgggctgcctaccatccctttaaaagctagccactgctctaattccgtttttaaaacttgcattcccgctagtcgcgcgagtttttcgttattcatcagtacttgataatctgcaaagtcactcgttgcaaagtatcgtagtttaaatttcatttatttctcccaaattatttttcgtatgactcaaaaagatttaagatagtctatagataatctatgtgaatatattttactacttaaaaggagtcgatcttatgcaaataattaaaacaccacttaaccaggtaaatcctcaatctcaagcagagttaatttcctacgttgatcccagccttaccgacacgcttaaccctgcgctaatttttgtaccgggaggctcttatactcacattgattttaagcaatccgaaaaagttgcgctacgctttttgtcacttggttttcaagtttccatcttacggtactcttttgtcgacgaagttcaaccgctcttcccggctcccctgttggaaactgcgcaagcaatcgccactactaaacaaaacgccgcacaatggcacgttgatcgccaaaaagtcatgttgatgggcttttccgtcggcgggcacgtagtcgctaattacaataatttatggtcttcagactggttacaagcacaaacccacttatctgcagaagacttaaagcccgccgctactattttaggttacccagtaattaccccatttgatggcttccctgaccaacctactttggcgcagtggactgacaaccccgatgagattgctgctgaccaacacgtaaccgccgataatgctccaactttcatttgggccaccactgacgaccagttagtttcttcaaaaaacgccgtggactacttcttagcgctccaagctcatcaagtgcccaccgaactacacctttaccaccacggtcctcacggaatggcgttagctgacgaaactacggcttacgacgagcgtcaccaagattctcgcattgccgattggattgctaatgcattagcttttttacgcgaactataacgaggcttattttccattagtaaagaaaatggacctttattcttcaaaagcacaaaaactacttttttatacactaaatattaaactttagttaattcaatcaaaccgccaaataaatttggtattatattagtaattgatttttaacattgtggaggaaacttgtatgagtgaagactcacggaattccaatttaagccgatttagcggcaaccagtttaattctgcgccggagggaaatgattccaacgccgaggagcaaaataacccaaccagtggcagccggcaaaaacggcaacgtaatccccgtccgcctaagaagtggcatccttggcgctgggttgtttgtgccgttatcgccctcctgttgatcgttttcggggtcaaaaaatggtataccgctaaaaatgcggtcgattcaatttttgatagtgctcgcattcaaaaagcccgggacgtttccagcgagctaaaacacggcaaaccgatttccatcctattattgggtaccgatactggggcgctaggccggaattatcgtggtcgtaccgacacaatgatcgtcgctacgttaaatcccaaaaagaagaagatgactttgactagcatcccccgggataccgtaatgtcaattccgggatattccagttattcaccatccaaaattaattctgcctatgattttggcggagccggaacggccattcgagcggttcaaaaattgttaaacgttccaattgactactacggattaatcaacatgggtggactagaaaagattgtcgacggtgtaggcgggattgacgtcacccctaagctaacctttaagtatggcaacgccgacgttaagaagggggttaaaatccatcttgatggtaaagctgcccttgattactcccggatgcgttacgacgatcctaaaggagattacggaaggcaaactcggcagcgccaagttttgatggccatcttaagaaagagcgattcaatcaccgcgttgctcaaccaaaacttcttaaattctctgaaaaaacaaactaaaactgatttaacctttaatgagttactagccctttcaagtaactatcgggttgctacccaccatttgaaatcaactcatttacaaggtgaagggatcaccattaacggcggttcttatgaatacgttccgcaaaaagaacggcaacgcgttactaacttcattcgcaatgcgcttgatttaccacacaaaactaccggtacgactggaatcagtagcatgtataccggcgaagttgaggaaagtgatgcaacatctagtgctgataatagcagtacttcttccaactacaatgatcctaacaaccaagcaactcctacccccactacgcctagtacagggacgggagcaactacgggataccaaggttatcaaggctattaagcaataaatacgcaattaaaaagacttcgtttgacttgaacatctgcaaagcagaatttaaaattcgacattgattttgtttaaactgcgaagcttccaaaattaaaacgccccacaagagtatcacaacccttgcgaggcgtttttcaatttcatttattctttgtttaccggtagcccttatttattttcccggacctttttgaaacgtactactaatttacgttgcaaacggtcaatgaactcagccatcaaaaagccgatcccgattgaccccgcaattacccccacttccaacataaaatgggtggcaagccgcgtattggacaacgcaaagttacgaatcatttggtaagcctgtccgccggggaccaggggcacaatcccgggaatactgaaaacaatcattggcattttcaaccgccgggccgcaaataaacttagtaaggcaatcaccgtcgtggccgttaaggagcttaatgcgagccctaagtgaaattgcaacatttcccagtagattccccaagagattccaccaattattccagcggttaacaacgcccggtgcgggatgttaataataatcccaaacccaaccgtagcaatccccgccatcacaaattccaataataactgcatcaatcttcctccatcatatgaaccgaaatacgaacgcaatcccaaagccaattgcgcatgcggataacagggcctccactccgcgcgctggcccgctaactaaatggccgtttaaaatatcccggaccgcgttagtcaagggcactccgggaacaaggggcatgactgaaccaatgataatctcatctaacgattgcccccagcccattcgaacgattaagaccgctaaaataccgattacgatcgaggcaaaaaattcgcttatgtacttaacgtttaaaagacggttactcaggtaaaagacggtgtacccgagagcccccaccaacatggtgacccctaaatccaccaaatttcctgaaaaagctaccatgaagggcccacttaccagtgcagctcccaatacctgcagccaaaacgggaaaaacggcgttgcttcatccaacgtgcttaacttttcgtaaaactcgtctaaggtgatttgttttgccgcgtattctcgcgaaaaagaattgaccgcagaaaccttctctagatcaaaggctcgccgcgtaatttgttccacctgggaagttaacgagtccggaactgaaacaatcaagccggtaattgtaccgaataattgtaaatcatcaatccctgaattaatcgcaatccgtttcatggtatcctcggctcgcgacatttcggagccattttcaatcattattcgtccagcaagcagacaagttttgattactttttttaaatcacgcatccaccgcacctccgctttaacttcttcattataccgaataagccagcgattcgttaatgattttatttttataacgtaatttcttcgccaaaccacacaaaaaaagcagagcgccgaagcaccctgctttttcagtaattttttaaattagtttttttcaacgtttacggcttgaggtccgcggtcgctttcttcaacatcgaagctaactgattggccttcttcaagagtcttgaagccgtcgctttggatagctgagaagtgaacgaatacgtcactaccatcttcgcgagtaataaaaccaaaacctttgtctgcgttaaaccatttaactgtaccttgttccattatgaacatcctcctgtaaaaccatgatgcatggctgttttaaaatttgtagcttgagccggtagtaatggggatagttcacaataaaacaatctgaccaaaagcacctaaccaaaagcacatctatagtatagcatgcccttctcaaaaaaaacagcaatatccttaatttctttcaaaaaaattaaaacgctatcaaatatcactcgctaaacgtcgtctttattagttgtaaagatctgatattccttgccccgatcgacttcggcttgcaaagttgcgtgttcgatattgtacttatcctttagcaattttctaatcttttggtaaattggttcaacttcgctgagttcttgatcctctaaagcaatgtgggcggttagcataatccggtgttcatcaatcatccaagtgtgtacgtgatgaatattaaccactcctggaacgcttagtaccgttgctttgaccgcgcgataatccaaccgtggtcccgcctccattaaaatattagtcgcttcgatgataattggaattgtcttgtaagcaatgtaaacagaaaccacaatggtcatcaacgggtccgcccaaaccacgtggaatattttgatgattaacgcacctaaaataactcccccagaggcaaatgcatcacttaaaatgtgcaaataggtcgcctttaggtttaagttattgtgcgaaccgctatgtagcaaccacgctgaaaaaccattggctaacaaaccaactaccgctacaactaacattaatccgccgttaaccgggtgcggatgagcgaaccgccgaattgcttcccaaattaacagggctgacattactaacaaaaaaattgcgttaaagtacgacgataaaatttctgcccgccggtaaccataagtcttagactgattagaatttcgctgactaatccgactagccacgtaggccattacgattgaggcactgtcgcccaagttgtgaatcgcgtcggacaaaagcgctaaactgccggagagcaatccgcccccgaattcaaccgccgtgattgctaaatttaaaaccgtcgcttccaaaaatctcaaaccgtgttgagctttgtcatctttaaattccataaaaactcacccccactgcaactaaccttattatccttcatttagaaagcaccttcaatacttctcgaaataacaattaatttcgttctaaaattaaaaaacttcccaagaatctaaaaattcttgagaagctctttgtaatataagtacgattaacgcttaccgtgtggagaactccctttactccacccaagtaagctttaactatgctcttagggatcctaattactaccgctggtggtgccgacccacgctaggttctatgtagctagcgatcgtatcgtacaagctgtgatataacatgatggccacccatagccaaacggttcctaagccaaccgccactagggtatcggtaaggtaatgggcccccataaaaatccgggaccaaattaccaaaatctgccaaattaccaacccggcggtgcaagcttttttcaacgatgattctgccattggccgtacgaagaataggtaaagaaacgctaaaactaagaacgcttcaaaagtgtggccactcggcatactgtatcccgtttcagggacaatttgtgcaatcgtgggccgcggacgtttgacaaattcctttaaaaggtacgccacaactgctccgccaaacatcgtgcaaatcacccaaattgcgtcaacccgttgcccttgccgcaaccacaagtatgctgcaattagtactgcgtaaatcagccccagtttagtgtcggcaatcatcgtgattagtcgcatcacgggttctaaaaacatcataaattcactttgtacggcgctgctaaacagttggtccacaaaaagcataaacatgctttgcatcttgacccctgctaccaaaacgattaccactaacgccgctagtatcacaaatcgttttggcacattaggcatatctcgtaacatccctaactcctcctagttttcttgattccattcggcaataaattccgttaaaaacgactccatccgctgggtgcgtttttcagcaatttgttgggctaatggagtgttcatttcgtcctttagcttaagtagcttttcatagaaatggttaattaccgactgattttgccgatactcggcatgcgtcattacttcacgtggcgcaatctcgggatcatacattatgtgcccgtgcgcgcccccataataaaaagtgcgcgcaattccaatggccccaattgcatccaaccggtcggcatcctgcacaatctgcccttctaaagaaagcttatacttatgttctaaattatccgaaaatgacatgtgcgtaatgatatcgaaaatatgcgcaatgtcatagtcactaaccgccaattcccgcaaaaaacgggtcacttcgtcttcagcagttttagtttgttcaacaaccttttcgtcaatcacgtcgtgcaacgtggcagccgcaatgaccacaaaacggttgattttctcatcacgatcatccatcaacttttgggccatctttaccacccgttgaatatgggcgtaatcatgtccggtcaagtcgttttgcaatttcttcatcacaaaatggttgatttggtttaattgttcgacattatcttgactcatgcttgctttttctccgcgtattctacaatttccaattttctaaccaccgtaaccttgacctgtcctggataagtaacctcatcttcaatgcggtccttaacgttagtagccacgttcttaatactgcgatcgttagtttccttaggcaaaacgattacccgtagctcgcgccccgcttgaattgcgtaactttcctgcacttccggctggtcattagcaatcccttctaagcttttaatccgttgcaaataatctgctgctgattcgcttcgagcgccttgccgagcaccagaaatcgcgtctgctgcttcaacaaggtcagcaattacgtacttagattcaacgtctccatggtgcgaagcaatcgtgttaatcaccactgggttttcccggaatttcgtggttagctccactcccagttcaacgtgcgtagcttcaatatcccggtcaatagatttcccaatatcatgcaaaagtcccgcacgccgagctaatgcagcattttcgcccaattcagtagcaaaaattcctgctagtttagccgtttcgatagaatgctccaaaatattttgtccgtaactggttcgataatgcatccgcccaataattttaatcaaatccggtgccacgtgcttcagcttcaattcccgaaccgcattttcaccgtaatgtcgaatgcgttcgtcaatcgtccggttagcttggttcaccagccgttcaatcgtgtcgggaagcacccgtttttcacccttaatagatttaattacttccatagccgtagcccgccgcaccgggtcatatccgttgatgattacttctttcgtttggtcatcaatgatcacgtctaccccggttaaggcttcaatcgctcggacattttgtccggagttaccaataattttccccaagtattcttggttatcggcaaccaagccgcggtgattttcatactgcacgctgaccacgttactatgttccattgccaacgcaatcaaatcttctgcttcccgttcctttgaactttctaattcggttgccgcattgttaacaaactcttcttgggattgttccgcatcttccttagtggcttgtaaaaccacgtcacgtgcctgctcttcaggtaaatcggccacattttgcaacgtttgccagcgttcggtaatcaactggtccgcctgcttcaaagtttccttaaccgtatttttccggtcctgcaactcgtggcgtttctgtgataacaggtttgctcggttggcaagtgcattgcgcttttgctccaacaatttcattcgttgctcaatccaagcacccttgcgttggttatcacgttgatcatcgtcgagttcttgactaatggtcatccggtactgttccgtttcttggtgacttttttgttgatattcttgaactgcttggcgggtcgcttcttgttgctgggcagtcagctttttagctgcttgccgagcttctcgtaaaacttcctggtgcttttgcgcccgacgccaaaatccgccgcctagtgccagcaccagcaaaattacgattaaaatcgttaccatcgcgttgcccccttcttcttcataatcggattttattatagcataattccactaggccatttcccggccattccaacgttttaccagatgtttaaacatcgcctagggacctcttaaatgattcttagctaaacttgcgggcttgttttacaattccaccattcgccacacgccttcgccggctttttccaagtcgtttacaaaactcaaaaccatctttgcccggttcggattcttttcgtacaaacggttcaatccctgtccagtggtcaacggcgtgcctaggttaaactgcccgtccgtttgcgttccttccgaaaaggccactacccaatcgccagtttcaatcgcggtgtataggaaaaataaggcgtaatcttcacttaagtacgcgggaaccgcccaaacttggtcaccgacttcctgggtcaagttacccataaaattgtattcggacgcgttgctgctgtttacttcgtgatttaactgcattagcatggcgtcaaacgctgggtctcctaacgttacgtttatgttttcaaaattaccttctgttgtcataactacctcttcaatcaattattttctgctcgtttaaagttgtccggaactgcctacatcccgattgcttgtaagtctgcgggcaagggagccgtaaactctaatttctgattcgtgaacggatcaaaaaagcggatggattgcgcgtgcaaagcctgtcgctcaatttcccgatccatggaaccaccatatagttggtcgcccactaacggatggcccgcgttggcaaagtgtacgcggatttggtgagtacgtccagtttttaaatgaacctgtaccaacgtttgatttgcaaaacgttggaccactttaaagctggtcgtggcgctttgtccgccttcttgaacctcccggtggattccatcggcagctaggcctagcggctggttaaaggtccctttttcagcactaaccaccccgtcaactaacgcaaggtacgtttttttaatctttcgatgacgtacttgctcgcttataaggctgttagccacttgatgacgcgctacgagggtgatcccgcttgtaaaccggtccaaccgggtgattaaatggggtaccaagttaactgctccgttagcttgccagtgccccttaatccgattaaccaaggtatccgtacggttacttggtccgggaaccgcagttaggcccgcagatttattaaccactaaccaattatcatcttcataaataatgtcgagcggttgatcactaactggcaccgctgggtcagaatcctcatccggcagttcaatccaaaagggctcaaagggcataatcttgtcttttaacgccaccgtccgttcgttttcgtcaactaaccgcccggcttggcgaattttttgcattaaccgttgactggctcctaaccgttgtaaaactttttgtgcactaataatttcttctaaattattttcaattcgatatcgcatattttctccattcgtttgtgctttcttccttcactcatttccattatagctaatttccgattcgcttaccgaaaacttttttccttgaaattcaagtaaaagggactacaatgaatttagctctatcaatggagtaggaatcggtgcgttaagtgtcgtcgagacggagagttgttcgacgaacgaatgcctagcagcgatatcggttccgcatctcgccgttgaagagggaatttttcatgctatttccttttcgttttgcggccaataaagaaatggagggatttgcatgaaggatttttttagtattaagggagttttttccgtgcgaaacctaaccatgatggctttattggcggccttagatgtagtgttggctcgttacacgaccatccatctaacgccccagtttaccttggttagtttcgagtatattccatcggccatcgttgccgggctgtttggcccctgggctggaattgtgtttgggttggtcagtgacacggtcggttacttttctaacccggttggtccgtaccttcccgtatgggccattagcgccatggtgggcaacgtcattcaatcagttttcctatatcaaggtaagtttgactggtggcgaattttgattgcccgccttctcgttatgctggtggttaccatgggcttaaacttcatctggcagtcgatttactttggcgcggcggcaactgcgtactacaattcggcacggatcattagcaacatcattcagttgccaatccaggtggtattaattcgcgcatttggtcagttggcactgcgaattgtgacccggatgaacgctagccggcaatccgtctaataatttatttgcttttctccattattcatcataaaatagtaattgattatttttttgctgaggaggaagaccatgaagtcaccatataattcattcgcccgtgcacgtaaagtttctggtaaacgcgaacgtcgtcgccgtcaagcacggatcgtagcgattcaaaaatttgctaaaggcaagactgatacaatcgctgaaacaccaaaagttaaataagaactcaaaagaggttggaatttttccaacctctttttctgtattattttttgccttcattaaattaaaaacgacaattatgcccaatccaaacataactgtcgttttttgttaacgtgcgtaggctatttggctgaggattcgcgcgtttcgtctagtcccttagaaccatttaatagaagattcatgatgattgccgtcacgcacccaaccaccattccgttatctaaaatggtttgcacggttgccggtaaaatgcggaacaaggttggttgggtagttacccctaaaccaacgccaattgaaaccgcaattactaataggttatttaccgtcatgtcaaccgccgccagcatcttaattccttgggctccaaccatgccaaacattactagcatcgccccgccaaggactgacgtaggaattaacgttgcaatcgcgctaaacttcggaatcaatcctaaaattaacaacatccccgccgagaaatagatcgggcgcagctttttaattccggataattgcacaattcccacattttgggaaaaggttgaatacgggaaggtgttaaaaattccgcctaggattgctgcaatcccttccgagcggtacccgcgttttaaatcgtccgccgttagtttccgttccgtgatatccgctaaagcaaagtaaactccggtagattcaatcatacaagttaccgcggctaacaacatcgttaggatggaggaccattcaaacttcggagtcgcaaagtaaaacggtagcgggatttttaaccagcttgcttgactgatcggcgttagatcaattaatcccatcaaaaccgcgattaacgacccggctacaatgccaatcaaaactgaaatccgtttaacgaatccgtgagtgaacacttgaattaaaataataattagtgcagttacaaaacctaaaatcaagctgctagcacttccaaaatgcggatccgcaacgttgccgcctccaatattctggaaagcaaccgggattaacgtaaagccaattaaggtaattagtgatccggtcaccactaccggaaagaatttccgtagtcgcgcgaaaagtccgctaattaagaaaacaaaaattccggcggcaatgacgcccccgtacatgtatccccaaccaaaggtgtttccaatgtgctccatcggggccaaatattccacagctgagccgagcaccaccggtaaggcaatcccagttagcggcgtccgcttaatttgtaagaaagttgctaccccgcacataaaaatgtccacggaaattaaataggtcatttgttgggcgttaaattttaaagctgccccaatcaaaagcgggattaaaatatcccccgcgtacattgctagcaagtgctgaaacgccagcagaattgtctttggcgtcgacaaccgttcttcttgtaaaacttgcgactcaaattccttcatctcatcctccactatatcagtaatcattttcagtttataacgaacattttagcataataatcggcttttaaaaagacgaataacgaactttatttcactcaaagggtatttcaaataaatattgttcgcctattgttcctgtgagttttgtgcaaaagttatataatgaacatataaaataataaaggagtgtttatcaatgaacaaacgcattcacggttcttgtaccactatcttagttggtaaaaaggcctccatcgatggttcaacgattatttcacggaacgacgacggccatgaagccctcgatccccaacgttttgtcgttgttaatcccgatgaacaaccccaaaattatcgtgccgtaatcagcggcgtggaagttaagcttcccgataatccattacgttacacttccatgccaaactccattttaacgaacggaatttggccggcagccggcatcaacagcgaaaacgttgcaatgtccgctaccgaaaccatcaccactaattcccgaattcttggaattgatccttacgtagaaaacgggattggcgaagaagacatcgttacgttagttttaccatacattcacagcgcccgggaaggtgttttgcggatgggtgaactattagaagaatacggaacctacgaaccaaacggaattgccttttctgataaggaagaagtttggtggcttgaaaccatcggcggacatcactgggcagcggtacggattcctgacgatgcttacgtagttgctcctaaccggatgaacatcgaccactttgactttaattctgacgacactttgtgctcagcagacttaaaagatttgatcgaaaaatatcaccttaatcccgactacgatgggtacaacttccgccacattttcggtagtgcatcgattaaagacacggtttacaacaacccgcggacttggtacggacaaaaatacttcaatccggaaatcgaacacgacccgatggaccaagacttaccgttcatttgccacgccgacaagaagatttcaattgaagacgttaagtttgttttgagttcgcattttgaaaatacggaatacgacccttacggtaacggtaccgaagaccaaaagaaactcttccggccaatcggcatcaaccggaaccacaacgtgcatatcttgcaaattcgtaacgacgtgcccgctgaaattgccggtatccactggctagcatacggggccaacacatttaacacggtggttccattctatgcaaacgtcaacgataccccggacgtttataaaaatgccaccggcacgttcgaccttaacaacatgtactggttaagctgcacaaccgccctccttggcgataccgattacgatctgtacgttgacttgcggaacacctttgaacttgaagcaatgggtgcttaccggcatatccaaaatgaaaccgaccaaaacttcgctacgcaaagcgatcccgtgaagtatttggaagcagctaacgaaaaattagctcacgaatccttcactcgtcaaactaagctactcggcgaaatggttactttaggttcggctcacatgaagttaagatacaatttaaacgactaattttagttaacgactcaaagaattaaaaaaacgcttcttaagattaatttcttaaggagcgttttaatttagttaactctatatcgatagtaagcgttgcaaaatctaaggctgattgcctactcgcaaacttccaagttttattttctctctttttgcggttaatgacgtttacgttgcatttgtaaactgtgccgcaacgccttaaaaattcccttgttgttataaacaagcacgttgcgctcgtaagcgttcgcgcttaaccaacaaaaagctagcaagaaaatcacgttaataatccaagccaccccggccgcactcagactcgcttggtcaacgccataacgcaccggcattaccatcggactggtaaacggcaggtaacttagcacagtcgtcaccatcccttgactatccggagcctgaattgccgcgaagaagcccaccatcgcgattaaagtggctggtaccgctgcttgcgcaatttgttcctggttggtaaccagtgaaccgcaaagggccgctaaaattgcgtacgtaaagacccccaagatgaaaaagccaattgaaatactgaggaacggcaaatcgatttcgtgccacgggatttgattaattaaatcgtgtagtttgccagattggccgctggttaaccaaaccaccaccccaactaccaggtaaaccagtaggtggattaaagtcaaaatccccacgccaagcaaattgccgtaaaattgggtttttgccttcaccgcggttaaaattgattcttcaattcgagaacctttttctgtaccaatttcttgggcaattacgtttccataactaattaagaaaatgtacattggtaacgcaattaattgggcaacaatcatcctgagttgccggttgccggaattgatcgtggttaaccgtcccttcttaaggctaaccgttttcgtagttagctccggagtccgtaacaattgagctagctgctgttggcttaaaccgagtgctttggccgtattagccgtatttaaaaccgctaaatcttgttgaatgtcggtctcttcaacgtcggccccctctttattgaccgttagttttgaatgttgcatacgcgcatcgatggttaggatcccgtcaaccttagtgttttttagcgctcgttcagcatcctttttagaggagtatccccgatagcgcaaatctgcgtgttgtgtagcagaaagttcctgtacaatttctgacggcgccaccaccgctacggtagctttagagtctttatgtccgctataaataccaattcccaccatgatccccgcgataatcagcggcaataagaccagcgaccaccaagaaaaactagtcacgttcttttttaaaacttgttttgcgataatcattaatttattcatcttagtcaccagccttaattttgaaaatttcgtctaaagtaggcggttgttggctaaattcttttaggtagccatccttagttaccaattcaaaaattcggtggcccaccgcgggcgtttctaattccagaataaactggtctgccctttgacttacccgttgtacccccggaatggccgctaactctggttgggtgaatcggtttgtttgcaagtacacccgcgtatcgccaaactgctggcgaatttcattgaccttcccatttaaaactactttgccgtcctttagcatcaccagctgatccgacaaatcttcaatgtttgtcatatcgtgactagaaaaaataatcgcggtaccattctgccgcaagaaccgaattccttcctttaatagccccgcgttcaccggatccaatcctgaaaaaggttcatctagaatcgctagcttaggcatgaatatcaatgccgcaatcagctggaccttttgctgatttcctttggataagttcttaattttttctttgcgtttccccttaacttggaaacgatccatccattcatctaactgagctaaaatatcgtgcttcttcatcccgtgtaactggccaaaaaacagtacttgctgttcaatagtcatcttcgggtatagcccccgttcttcaggaaggtacccaatccagtcgcgtttcaactggttaattggttttccatcccacctaatttgcccttcatcaggcgttaaaaaatctaaaatcatccgaaaagtagtcgtctttcccgcaccgttttgaccaatcaaacctaaaatttcacctggatgaaccacaaaagactcctcactgacggcacaatatgtaccaaagtatttactaacctggtcaatttctaacattaatgactccctctttctaatacatccccatcattgaatatgggtattatagcaaagtatataaactatgtatgcgctttatcgataaaagtattaaaaagaccgcaaaaccttgtgcaggttttgcggtctaatcaataaataatttttattttaattactaaggcacgagtaacttctccgacgctacattgctaaccgttatttttttcgttgtagtaattcaataatatcaatgatgttcttagacaactcttcagcttccaattcattcatatcttctaaaatccgcattagcttagttaaatataatccccgatgctgttgccgattttcattgacctgtaatagttcaattgtactcaaccctaatgcttcagcaattgcttcgatattcttccagctaatgttttggttatcagttctttcaattcgcgaaatgaagttaactgataaatcacttttctcagctaactcttcttgggtcaacccgctctccttacgaacttgtttaattaattttccaatatttatatttgcactcatattgcacctcgcgtcttgttataagtcgacaataaaggtttttggttctgttgataacaaaatatagtcaactagacaatatatatatattattataatcaaaaaaggttcgcgattttaccgcctcaaaaccccgaaccttaccaaaaaattaaccttttaccattcgattccgaacaatctttgtctaccaaagttaatgtatcgtttattatacttttaaccattttaccgctgttaaaaaataatttctagtagcgattatactatgaaaagaataaaccgttttacccggcctcgtttgttagtagctactccttaagtatacgtcagcgttactaaatagagtctttcgctcctttctagaatttaaaaaatgcgctaaagaccgttattaattttagattaagtggtttctagtccaccattaatttcctaaaacagtagtaattgcatatcggtgacttaccgcaccttttccttattctttaaacctggttactttattttttagcactaaaagttttatttttgatacttaaaatgcttttttgacggcattttccgacctttaattatttttcttaagcttctttatcgtttattatacgtgcatatgttaataccgatcgaaacactttgtagtgctttaacaaagctaattactttgttaaccccgcggtgagctacctgtctttaaagattggctaatcatggcaaagctaggataactcgctaacctcttgcctacggatttattcgcaagatcgatgcaaaaaaggacgaattcagaaatcctgaattcgccctttaatacgttcgtaattatagaaattcgattatctagtttttgcgttgtttcttaactaagccaactactgccaatagacttaacattgctaagccaattacgctaagtaacgttgtagattgtttcttttcattcgtttgtggcaaagtcttagcagttgcttggttagattgtttagaacgggtttggccgtttgcacgatcttgtgacgcaaacaccgcatttgattgtgcgccagcatgatcagtggcactaccgttgttaataccaccatttgaatcaacaattaccccaccattttgttggtcgttagtgtcggttgcttgcgcattatttgcagcagtgtcgtctccattagcgtgctttccattatttgcatttgatgcattgctgccagcattgttcttaccatcattttgtgcaggttggtcactgtcagcgttgtttttgccgttgttttggtctggcttattaccgtcagcatcgtctttgccatcattctggtctggcttattgttgttggtatcgttcttgccatcattttgatccggcttattgttgttggtatcattcttgccatcattctgacctgaattattgctatgagagtcgtctttatcgttgtttggttgattatcgtcgtttgtaactaacgtatacgtctctgctttgtcactaccgtttttattgaggaagtcttcaatttcatcagaagtataggttttacccgtactttcaattttccattttttatcatccccagctctcaacacaaagtgcacattcgaggtaactggaccaaccgtaacactctttagataatttgaatcagtaaaatctaaattactatcaatataaagcccacctaagtttaaatgctcaatacctgaaccagtaaacatggacctataatcatgcccttcactagtcgccgaatttttccaactacttaagtctaaatcacttaaactagttgtcatactaaacatactgttaaaggagtgtactttagatacatcccatcccttaacatttaaattactcaatgatctgcattgggcaaacataacccccatattttcaacttgacttgtatcccattttgacaaatctaaattatttagactactatctccttgaaaaacagatgctaaccttgttagatgacttgtatcccatttttcaattccctcaatcgtctttaattgtgggttatcagcaaatgaaattgtttccgagcttccaaagcttaatttgtctgcattaatgattttagttaaattttcatattcactaaaaaagtagtctccaaaagtttcaaaattccatgtgacttccccatcaaattgaatgacctttacatcatttttattccaatttttatcatatcttccatgctctaaatccccactatttagatgtaaagttccttggttatcaagggtccaatttaccgtacctactgtaccggaatcttttttattatcttgcgtaacttttgcggattccttagttacatcgttattctttacatccttttggctatcttcagaattgtgagctgtagattcatttatatctttcttatcatctgcaactgcatttttttcagtttgactatctttggccttgttgaccactggtgttgaagccacgctacttgaggctgtcgcactagttggggctgctgaactatttactttattggaagccgcactaaccgaatttgcagcactactgtcggctttaacagtcgcactagttacggccgccgtgctttcttgaacttgttcagtttgggatgtttgtgcgggagcgttagctgttgcgacttcgtcggcattcgcacttaccacgctaccagccgttgccattcctccggcgacaattgccgctacgagccattttttgccactcttatacatcttaaaatgctttttagtttccataatcctactccttaatatgtattaatactcttcctcatacctttaaagtgtaactcttacgcaataccatttcaacattatattaatatataaaaagtgtataaaatagcacaaaaaaacaacagtcatcatccttaaaatctaggcatccttcccctaaaagtcaatacaccatcccttctaactggctttagtagctatttcataaatttagtctaccatttagaacaaaccccaaaataatacatattttttcatttcatctatatgaatataaaaacattagtgataacattttataatgtctacggtactaatacctaaaatttttatagggagggaatatcaagttagtaacgtaaataattatgtctttcattgaattgtttgcgtattaagaaattaatcactagtcattgtcaccttttgagaaatcaatcaccttatccaaatccattttttagtatttattttttcggttactaggaaatgaatttttttatgtgtttattaaagcccttatatctacttaggattaattgcttaaaaggtacgatctggactagtagttaaagtatcgaggacggtcgccaaaatacttatattaaccaaaatactatggaggagttaaggaatgaattttattaaacaacataagtggatcgccatcattgttgtaatcttaatcgccattgccggcggttatcgttatgccaatcgcggtcaatacgccgtgcaaaacaaagtcatgacggttggaatgcgtgctgatgatgacgtaacctacgataaatccgcaaaagcggttttcaaacctgaccatgaagtaaagttttcaggtaaccaagacagcatggatggttttggcaaagttaagtggtctgctaagggaagcaaggttttcttgaagagctggggagtacgcttagctaccatcgatacagctcataaagtaacttttaaagggcatcctgcatatcgggcgaatattgacttgaagaaagtccttgcgggagctggatacgatgacgctagtgaattagtcgatgacgattatagtgtgacgctctactttgtcttgaaataattaaaggagattacaatggataaattcaaaacatttattacccaaaataaaaaattagtgtacggcgtgattgcaatcattatcattgctgcaggtgcaaaaataggatacgactaccacagcaacaacatcatttcccggattgaagtaaaattctatggttataacggacatggagatgcggtaataagtaacgccgaatccgtaaataagtacatgacccggcgcgtattgcaaaaggatcacataaaaaaagacgtaattaataaaattgtgtctcatcctgacgcatttgattacagtatgctttcttcagaagatcaatataaaattcaatcatcaatagaggacctttcttcgactagattagaattcaaagggaaatcaaccgaacttaaaaatggcgataaggttaccgtaacgtttaaaaacagcaattcggaacttcctttccgtgacggcaaaaaaacgttcacagttaagggattgaaaaaaactaccaaagtttcttccaataagatttttaaccagcttaaaatcaaagccctcggaattaatggcaagggacaaattgcactttcaagtaaaaattctgacttaatcaacagcaacattaaggttaaaaacaatggtcaccttagcaacggagatgttatttcacttacgcttccaaaagcagcctttaaagatagtagtggtaagcaccaatacactggttcaagaacgttcaagtataagatttccggactaattgatagtaaatcaattactaacgttgacgacattacggatgccaccgacactgtcatgtctgattacacagatgacaaacaattcgctgatgaaaaatacacatccaagtttgttaacttgtacgtaactccatataacgaaaatgaagaagaatactacgatgacgacgtcaacgaagtttcaagcaaagtagaagtcgcagatgcatccgaaaatagtacttcatctagcaacaaattatcaattgttgcaatttatagcgtcaactcttcggacgcagatgacgatgacgaacctgaaaatgttgccgttgaagtaaacaacctatcgttaaacgatggtaaattaaacatcaaagataaaaagattacttctgatgacaacgtttctacccttagtgattccattaagacctacgaacgtaacttggaagtttctggtttgaaactaaaataagttaatgctaattaagaagactaggaaagttagataaatttcctagttttttattgatgcagcagggcaggcttgtttctcctgctaatactttgtaaaagaggtttacaaaaccttaatcgtgaatatataatggttatatctgttaatttaggaggaataataatggtacaatctgcagttgttgaaaacgatagcgatgcgttttccgttagtttattagcgttttgggtaaagggaagtattacactagatgacgccttcttacgggtaaatatgccaaatacagttttctttggtttggttcctgccggtaagcaaaaagattcatctcccctttcaggaattactaacgtatacacatcgaaatcatataagctgagctcaatctttttaggattattaattgcaattattggagtagcgctaatgggctcatcattcttttcggcactaatcgcaattatcgttggggtgcttttaattggtagtggaatcagaaccacgtttaactatgaacgttccggaattagtaaaacaattgacttacctttcttcgaagcacatcatagtgaagaattagaagaaaaactcacccaaaaattagctacatatcaagcggatcgcaacgtgcgagcacaaacggaccgcacaattcaacaaggagctcaaaacacacaacaaattgttaacgccgtaagcggagatgcaaataatgctgcatcatcagcgagcgcattttgtagtagttgtggcgcaccgcttgctcaaggtgctaagttctgcaacaagtgtggcgctcaagctaactaatcgagttataaatttgattaattacaaaataaaaagagaccagaatttttcacaaattctggtctttttttgagtcaacgagcacgaaactcaaccaaattaaagttcactagcaagatgccaactttttctaaaaagccatccctttcttagcaaacctaagatttttccactatcttagtattttatatacttatgcacctatcttttaaattaaaaaccacgtatccataatccattcttaagctaataaaaaaacttaccgcaatatataaacagtaagccttcaatacatttattctaattcttcaatttcccgccggttaattccgtaaattagcgattgtagttccacagaaaggtccacgtcttgcacaatcactttttctggcacggtcagtggaaccgtagtaaagttcaaaattccttgaataccaacttctagcagctggtcagtaagttcttgagctttttctgcaggaaccgctaaaattgccacggtaatttgttgttctttaatttgttcctttaggtttttaatgtcataaactggaatttggttttgcaccgtattcaccaatttaggatcaacgtcaaaagccgcggtaatccgtgcatttccaacccggtggaacttgaagtttagtaacgcccgtccgaggttccctacccctactaaagcaacgtttgcgttaatatcttgtcttaacgcgtcatcaaaaagttccaaaagcttttgaacatcgtagccgtacccacgccggcccatttgtccaaaataagaaaaatcccgtcgaatggttgctgcatcaatttgtaaatattcagccaacattgcggaggaaactttttctactttttggtctgataaacgccgcaaatagcggtaatacaaaggtaaccgacgggtggtcggaattgaaagtttaaaattagccattttttccacatcctctattgaacaacttttaatatttcgtcacgcattgccacgtggactttttcatcctcgatataatcgtgtagcaaaacgagaccatgtttattttggttattaaaggcaattaacccggttgggctgctgccataaaagacatcgcggttttccttgaaacggcaccagccgagcgattggccgtccacatccaccttcttgattccatcaaacaactgcggatcaagaatttctttaccttggtaacttccccgattaatcatcatttcggtgaaaaccgttagatcatttaacgttgaaaatagacctgcatgcccgctttctccatttaacaacaatcctaactgatcttcaacctgaccttgaatttgtccccgtttaggatcgtttctcgttggcacaaaacgcatcttagggcggttaaggttaaacccactgttagtcattgccaacggatacaaaatcttgtcctgtaccgcccggtcaatggaaccgtccaccgtccgaatgataattcccagaagggcaaaatttaacggagaaacttgcacgtggtcgccaggctcaaaatccgtatcaaccatgtaaagcgcattgataaattcaatcccggtcaaccggtacattcccggaatttccaccggaatcccactagtgtgcgttaacaaatgcaacactaggacatccgggttggaaaaccctggcaggtactttttaatcggatctttcagccggatttcttgaatcgctaaaagctgaaaaatccgggtcgtggtcgcaattacttcagtcattgaaccgacgtcgtaaatcatcgaaggatcaaggcacacgttgccttccttaccgccctgcacgccttcgtaacggctttcaatttcgtttggtaaaatgaagctgtacgaagctccattaatatagtgttgttgaattcccttttcaatcacctgatgaatctggtgcatttgctcagtcatctttgccacctctttttatttagtcgcgcccggttcccaatcaaactctaggctcggatcggcattaagcgtcaaatcggcaaacactccgtgacgcatcagcatttcgccggctgccccaatcattgcgccattatcgccgcaaagttttaagggcgccttcacgaaatctaaatcattaaattgggcgctgagttgttggtctaaggcatcccgtaaaccccggttcgcagcaacgccgcccgctaaaatcaactgtttgatttctaacgctttgcaagcgcggatcgtcttggccacaatcacgtcaaccacgctttgctgaaaactagccgctaagtccgctttatccaattcttcgtgaacttggtccgcgtggtgcaccgtgttgataaacgcgctctttaacccgctaaaactaaagtcaaagttgtcatcgtgctccatggcccgtggaaaatggaacgtatcttgtccttggtgcgccaattcatcaattgctttgccggcaggatactttaatcccattaccctacctactttatcataagcttctccggccgcgtcgtcacgtgtttcgccaataatcttaaattcattttccgctgccatatatactagttcggtatgtcctccggaaactagcaacgctaaagcagggaatttaattggtttgacgaaccgagctgcgtagatatgtcccatcatatggttaaccggaatcaatggcaaatgatttgcaaacgcaaaggccttcgccgcagaaacccctactaagagggcacccactagtccggggccgtaagtaaccgccactgcacttagatccgttggctggacttgtgcttgtttcattgcttggtcaatgcacagggtgatttgttcaatgtggtgtctgctagccacttctggaaccaccccgccaaaccgttggtgactgtcaatttgggtggcaatgatgtttgataaaatagtgtcaccatttttaataaccgctacgctagtttcatcgcagctggattcgattgctaatattaaactatcttgttccacgatatcctccccgccatttcgataaatctagttgcatatcgatggcgtcctcatggtcaccaaagtaatagccctttttcaaaccgacgttttcaaaaccaatcttcaaatataacgcctgggcattaatattactcttccgcacctctaaggtaaccttcttatactcaataaactgggccttccgcacaattgcttcaattaaaaacgaaccaatcccttgattttggtattcgggaagaatggccacgttggtaatgtgggcagtcttcgcccggtcgttaaatgaagccccgataaagcccatcaactggtcattatggcgaatcaccaagtataaccggtcgacctttcttcttagctcgtttgcaaatgccgtccggtcccagggagtctgtccatcatacacggcccgttccaccattaaaatctcggggatgtccgtattagttgcctgagccacaaagtagctttgtccttcaatcaccacgttatgatgtgcaatttcgaaggcttcttcccttagccggcgcgttcgattaaataaggttccttgtgcccaattaattaatttgtcgaacatatgattctttactctcatcgtttggatgtttttccttccaatttctttccgcttcagttactcgtaaatatgctggtacaaaagtatagtaattttctaacgcttgtttttgcaagcctagcaaacctagcgcgtaggcgttcggcaagctattcaacgtggtcgaatgctcagcaattactcgcaaagtgtcttctaccatcggttgaaatttttcaaaatggttattaataaagtaaaccgatcgtcccagttcattgatttttgccagcaaagattcaaaactcaggtgctggtcggcaaccaccggcgtaacttccataccatgcttttcgtaaattcccgcaaaaacattttggttgcgtgcatcaaagaacggaactaccaatccgtcgttaggtgcgtttggcactaacattgctaaactagaaatgccgaccaattcaatttccaacgtcattgctaaagtttttgccgtggtgaccgcaatgcgtaatccggtgtatgaaccggggcctttggctaccacgatgcggtctaaatctgctaacgaaacttctgccgtttttagcgtctgtgaaataattggcatcagctgtttactgtgatttcttttaatgttagtagtttggatcgccagtaattgatcattttcaagtactgctacactgagtgcaacgttagacgtatccaatgctaaaattttcatttagttcgctcctcttttagtcccttctcacattatcctacagaaaccggcttccgacaactataggaacgcatagaggctgagaaaaaatttttctcagcctctattgtaaaatgttttatcaattgttttctataatcatcataaaaacgtatttaaaatttaacgatcttcataaccgcggggatgttgttgcttccaattccacgctgtttgaataatttccttaacatcgtcatattgcggttgccatttcaaaacgtcccgcgctttttggctagccgcaattagtgaatcaggatccccgggacggcgttcggcaatttcagctggaattggttcgccagtaacttctcgtgcagcttcaaccatttgcttaaccgaaaaaccggttgaagaaccgagattgaatacgtcactatcgttgccggctttgagatagttaatcgctaaaatgtgggcgtcaaccaggtctaaaacgtgtacgtagtctcgaacattggttccgtcaggcgtattgtagtcgtcgccaaaaatcttcaattggtctcgttgaccggctgccacttgtaaaataatgggggtcaagtgggtttctggaccatgatcttcaccgattgaaccatctgggtaagcccccgcaacgttgaagtaccgtagcgccacgaatttaattccgtaagcttggtcagcccaacgaatgattttttccatcattaacttgctttccccgtaaggattgatcggtgcttggcgatcgttttccgcaattggtgatttttcaggaaccccatacgttgccgccgtggaagagaaaataattcgtttaacgtcgtgatcgcgcatttcttcaagcaacgccaccattccggcggtgttgttgtcaaaatacttcaacggtttttccatggattcgggcacgattgaaaaggccgcaaaatgaaccacggtatcaatattttcccggtcaaaaactccctttagaaacacatggttgcggatgtcgccttcgtaaaagcgagctttttcgtcaaccgcttttcggtgaccagtcgataaattgtccaccacgactacttcttggccttgttcaattagtcgtttcaccatgtgagagccgatgtaaccggcgccccctactacaagtatactcattaacttctcctccattccaaactataaacaagttaattgtacccttaacgccgtgcccattcaacattggcttcacagcataaggtgtcgcctaccgaaatttgatgactgctttgcaaactgtcccggtcaaactcaacgacgctatgcaccatttggtgaggttgaatttcgacgtgatagcgaatgttaaccattttagggaagtagttatctaaaatatcgtcatccacggtattaaaaatccattcaaaataacgtgcgttgttaacgtggtggttcatatcaatatcgaagtaacgaacggcgtagtcctgctggttcgtttccccggtaatttcttgtaacttaggcaatcggacaattcgttttatgtaatccgattcgtacgggtcgatgatttctggcaacaatttgcgcatccgtcgcatagtgcggtccatcaaaacaaacatcgcggtagtttccacaatcttttccccatccagggtcttaatccaaaaatcccgttggcagaagtagtcgttgtggttcaccgcttgggtccccaccacgatccgttcgcccacgttaggcaatctccgtagctgcattacgtactgggtgatgacccaacctagcccggtctgatccaccacctcgggaccgatgcctaaggcttggctttggttatccgatactaacagcattacgtttaccatcatggaaaccgtcatcgttcccgtttggtcgccttcatagtaggttaccaagtgttcttcttcatgtatctttccagccatttttctctcctaaatactgctttgcattataagttaaagttgatgataaatgtcatagacctcttgtttggcgagtccgcgtaatttagcgacctgcttaattgcaatggtcggtttgactttttcttcatcaataatcttttgcacatgttcattaatggttaacgattcccagtcttggttttccacagcctggggatgggggttccccgccaccattaccacgaattcaccgcggatttccgtggacgcaatccactcctgaacttctgctacgctaccccgaataaattcttcgtaacgcttggttaattctcgtgctaaaaccatttgtcgttccgttcccattacggtggcgatgttcttcaccgtttttgccaaccggtgcggagcttcatagaagatcaacgtgtcgggatggttctttaacttttctagttccgcctgttgttctttaggtttccgcgccaaaaacccgtaaaaagtgaacggctggggcgctaatcccgaagcaatcaaagccgtagttccagcattggctcccggtaacggaatcacttttaagcccgcttttacggccgcctgcaccagttcctttccagggtcgctaatcgagggcatccctgcgtccgaaacctgggcaatcgtgcgtccatccgctaacatttctaaaatcgctggaattcgctcctgggtgttgtgctcgtgaaaactcatttgcttggtgtcaactgcaaaatggttgagcaatttttgggtattgcgggtgtcttccgcaaggatcaggtccgcttcctttaagatctggaccgcccgaaacgtcatatcatctaaatttccgatgggggtgggcactaaatataaagaccccgccgatgacggggtaaaactcttttgggttaacatattaacgatctccataaataacggttaagcaaaaagcacattcttcatcgtcttgccggtgcttgccaaagaattcgttgcaaatatggtagccgctagcataaagcttttccaaattttgcaatgattttgataaaccgtgcttcgtattcttggttccttcattttcgtgttccgcggcagtggcctgtttaagccgctcccttaagtgttggttttcaatcttaagttcggcattttcctccatgatttctaccatggcactttgggtttcgtgtagtttatttaacaaatcctcagcgttgtgcgtaacttctgttatttgatcaaataaatctttcttctccacactatcaccctctcattttaaaaatatcacataattcaattgtcactttttccacaattccctgaaaattcaaattctgctttagcttcccgcgtaacggcaatagtaaatcgctaaccttaagcaactggctgaccgttgtttgctccgcgacttggcgtagcgctgcttgatctgtaaggtacgtaaggtcggcttgaccaaacttaagtgccaacaaatccatcgcgtacaacatcatcatgtctaaaacaattgcttggtgttcccggtccttagctagtccaataatccgagtttggacgtccacaaatgcactcatatcgcccttggtaacggcaccaaaccatttttcaagagccttatgcgcgtcttctatccaattattttctaacaagctctgcatttcttcacggtcgctagtcaaccgaactaacagatgggcggtgctctccgttacctcaccgtccgcagttagttcagcaactagctgacttttctgaagcggtttcagctcgataatttccgtccgcgacatgatggttggcaaaattaaatttttgctttccgtgagtaagaaggcggtcacgttccccgccggctcctcaataaatttcagcaaactatttgccgcactggtagtcattacgtgcgcctggtcgataatgaaaaccttccgatttccttcgaccccgcttttggaaaattcggcctttaaaaatcgaacctgatcgaccttgatcgactggccgtcgggttcgatttctactacgtcgggatgctgcccagtactaattcgatgacattcttcacattttccacagggcatcccgtcttgtaagttttgacaaaatagccgctcggcaacccaccgggccacctcttttttgccagttccgcttgcgccggttagcaagtaggcgtgtgcgaggtggcggttttcaatcatttgttggaaacgttcgatgaccgcgggttgtttagttacggccggattctttactgctgctgtcaaggccgtttagaaccgttcgaattggtcaaccggcaagacaaataccgtagctccaccgacttggaccttaattgggtacccggttgccccttccatattcacgtccatgtttaccgatggggtcatgaactcttcccgagaatgactagcctttttaatggtatctagaaccattggaacccgttcttcttccaccccgattaaaaaggtggtgttcccagattgtaaaaatcctccggtagtcgataatttagttgcccggatgttttggtcaataaattgatcgctaagatggttagcgtccttatcttgaacaattgcaataactaatttagttgccataatgtgtttcccccactattttaaaatttggtctaaaacattgataactgctttttttacgtcgccaattgattgactagcatcaatcaccacgattcgttccggataccgtttagctaatgctaaataggcgtcacgaacccgttcgtgaaaatcaagctgctctaaatcaagtcgatcaacatcgtcggtgcggtgagtcatgatccgttttaagcccacttcagcgctcacgtctaaataaatagttttttccggtaaacacccctccgtagcaaacaagttcatttggtagactgcttccgggccaatttcacgtccggctccttggtacgcaatcgagctatccacgtaacggtcacagaaaactacctgaccgcgtgctaacgccggtaaaattgtttccgtcaaatgttgtcgccgggctgctgcatatagcaaagcttccgttcgagcatccatttccgtgttattcctatccaaaataattgcgcgaatcgcctctgaaatcggattgcctccgggttcgcgggtcaccgtcaaccgatctgcaagtcgagtgcggtaatgctccaccatcgcctccaaaatcgttgttttgccagccccgtcaggcccttcaaatgaaataaaatgcccattcaccagttattccctaccttatgatttttttatattgattatttttattctactttagattttctagactgtctattaactactctaaaaactcgtcctagtttagcctttggtacgccggtcagcaacgatattttaaattttttaaaatagttggcgcaatgcatttctccggtcagttatttaatcccacagtttttgtatttgccaccaaatggttaagttttgcacagccttactgggaggagtgcagttgttcgtaaactaaaaagttttccacagctcccacttcattctaacaaccctggtcaaaagaaccaacgttaaatcaaaaagagccccatgaccaatttcgtagtcatgaagctctttgatacgaccggaactttagaagttcccatttaaattagcttaccgtgctcggatcattacatctctgtccgaccttcgaccgctttatacaaagtcatctggtcagcatactcaatgtcactccccacggaaagtccgtgcgccagtctggttaccttaattcccgaaggcttaatcaatcgagagatatacattgcggtcgcttctccctcgggagtggcgttagtcgcaatgattacttccttgattgcttcgtttttctggagccgggtcagcaagctcgcgatgttaatatcttcgggccccttcccgtccattggcgacaacacgccgtgcaacacgtggtaaagcccgtgatattccttcatttgttccattgacattacgtccttggaatcttcaacgactaggaccgttttttggtcccggcttgcatcttggcaaatatcacaagggtcgtcttccgtgatgttgccacaaatgctacaaaaacgtaagtcacgttgtgcagaaattaacgccttggcgaagtccgtcacatcatctttttgcatatcaagcgtaaagaaggccaaccgggtcgcggttttatagccaatccctggtaacttcataaaactatcaattaacttagcaattggttctggatattgcatccggacactcacctacgattcttttatagtccgggaattcccttagtgtatttccccatggtcttgttggtttcactgtcgattttgctcattgcgtcgttaaccgcggcaactactaaatcttgcaacatgtcggggtcgtcttcgtcaatggcttctggattaataacgatgtccttcatcttatggtttccggtaaaggttaccttcaccatgtcatcgggcgcaacgccgatgaattcagtttcgtttagtcgttcttgttcttccgtcacttgcttttgcatcttttgtacttgacgcatcatattttgcatgtttcccattccaccacgcatagtcattaccatcctttaatcattttttacattaacgttttcggatccgaatagttccacagccttttccactacggcgctatcttcaggggccaccgtcgttggttgggacggtgcttcctctttagatgcactttcggtttccttacttaaatggtgcgttttaataaattctgcccgcaccgttggccactcttcaactgtaacatagacaacttgataatctgaaccagttagcttagccaaattttgttgtaattcgttacgcaagctttcgttatccacagccttttcaaacaaaaagtcgtaatcgaaagccaccacgacgccctcttcgctggcagccactggtttagaaacgtgcatcaaggctcgtttcgtgaccgatagcatatccatcaagtcgcgccaaaggttttgcatttccaccaagctatctttagtggcgttctccaaaatcgggtaaattttagtcaggttggccggcgtcttcacgttgcgacttcccgaagcccgttttttcggcgctgcggaggctggtttagcaggcgcggaggcggcagaagttgttcgctctttgaggcggttaacctccccctgcaaacggtcaacttcatttttaagctgttgcacctcttcgttatctgctgtcgcactcgtcggcgttgcggaccgttgagagagcttaatcgtcaacacttccaggtaaacgtcagggtgcgttgtaaaccgcatttgttgttgaatctggtttaacgtgtcgatcatttcgtacaactcgctgccgctaaccatgtccgcttctttgacaaagtcttcactaaggtcgctcaaactctgttccttaactagttggggatcttcttggtataaaagcaggttgcgttctaccgcaatcagatcttcaatcagccgctgaccgtccttaccttcgtccaaaatttggtgcaacgtttctaacgctgcgggagtatccttttcgaaaatctgggttaggtattgatccagtaactgctggttaacgctcccggttaccagcaacgcgttgtccatcgttaccgtttcgtttccaaacgagatgacctggtcaagaatactgagtgcatcccgcattccgccttccgcagccttggcaatgattgataacgccttaggatcgtattcaatccccttttgttccaaaatataaaccatccggtcgtaactctgggtcggggtgatgcgtttaaaatcaaaccgctgggtccgcgaaataattgttagcgggattttttggggctcggtcgtcgctaaaatgaagattacgttagtcggcggctcttcgagagttttcaacagggcgttaaaggctcccgtggatagcatgtgcacctcgtcgatgatgtaaaccttatagtctgcttccgtgggcgcatacttggccttatctcggatatcacggatttcttcgaccccgttgttcgaggccgcgtcaatttcaatcacgtcatttaaattaccgtccgtgattgcccgacaagtcgcacattcattacacggttcgccatcttttaagtaatgacagttaaccgccttagcaaaaatcttagctgccgaggtcttccccgtcccccggggacccgtaaacagatacgcatgactagtctgcttagttattaacgcatttttcaaagttctggtaaccacttcttgaccaaccatgtcggcaaacttctgcggccgccaaacgcggtacaatgcttgataactcattaaatttccttccccgatttctgtttttaaagaaagaacccttagccccgatggactaagagttccgttgatttgctcaataacttaaggcacaagccagagcatacttagtgctgcttccttccggacctgacacaattcgtaagtccaaccttgcctcaaggccttacggcaataactatgatactcgaattttaataaaatttccactattttaccgatttttttttcgacgttcgcgaattgccttgaagaaacttttcattaacccggccgcttggtctgcagccaccccttcgcggacttccacctggtgatttaaacgttgatcttctaagaccgtatacaaacttcggactgcgcccgccttcggatcccgtgcgccaaagtacacttccgggatttgagaattgatgattgtcccgctacacatcaagcacggttcaatcgtgacaaataattggcaatcccacaaacgccagcttcgtaaatacgcgcaagcttccgtaatggccaacacctcggcatgcgtggtcgcgtcttgggagtgttcccggaggttatgtccccggccaataattttgccatcgtgcactactacggctccgatcggcacttcatcaatcattttggcaaactgggcttcctttaaagcctctcccatataaaattgcacttctgcttcacttaatttactcatgttcacttcttaaaatgtaatatcctttatttttctttaataccgttacgttgccaaaagtttccgccattaatttctttgcggatggcgccccctgcttcttttgtaaaacgatgatcagctggccgcccttcgttaagtgctccttagcaccggtaatgatggcgtttaccaccgtttttccggcccgaaccggcggattagaaacgaccgttgtaaaatcagttttagctaccgcttcgtaagcatccgaatggtaaactcgtgtacgtgcagctacgccattggcttctgcattccgctcggcaagtgctaacgcccgctcgttaacgtcggtcatctccactcgtgcttcagggaattgcttagctagcgcaattcccattggaccatatccgcagcccacgtctaaaattgaactttggggaacatccagtggcaaagcttctaataatgtccgggtaccaaagtcaacggtgttctttgaaaaaactccgttgtccgacacaaaatttaattcgtgccccaaaagtgtgtaacgccaatgcttttcatcgtgttccacgttaggattctccgtgaaataataatctgtcattgaaaagtcctccaatctctattagtatgataacgtattgtaaatttggataccaacttaattaaaataatttttattgctcggcgaatgccgatgtagcacaacatctggtggttttgacccgttaaagccacaagatgatgtgcttttttgttgaaatcggtccgaaatgttgtatacttaaatgcagacagaaagaataaataagagggggagtcaccatgaaaaaagtcgttgtttacactaaaaacaattgcatgcaatgcaaaatgaccaagcgttttctaagtgaaaacggagttgaatttgaagaacgcaacatcaacttacatccagaatatattgacgaattaaaaggccgcggtttccaagccgttcccgtagttcaattttctgaagatgatgcaattgctggttttcgtccagacttgttaaaaaaattagcgatttaatttaaattgttagtttgttgatttagtgtccacgttcctttgttacagatggagcgtttttttatttcgaaatttaaggagtacacccaaatatgagcttaaaagatctaaccgacgttacctattacgacttaaacaatgaaatcaacatccccgttgacaaccaaattccgctacataaggatcaagaagcccttgcagcctttctaaaggaaaacgtgcaagctaacaccaagcaatttgcaagcctgcgtgaacgctttgactacctccttaaggaagactacattgaagccgaacttatggaaaaatattcctttgacttcattgaaaagctttacgattatttgcgtgcacaaaatttccatttccgctctttcatggcggcttataaattctatgcccaatacgctttaaagactaacgataacgaatattacttagaaaacttcgttgaccgcgttgccatgaacgccctttactttggtgatggcgacgaagagttagcaatgcaaattgctgacgaaattattcaccaacgttatcaaccagctacccctagctttttaaatgctggtagaaaacatcgtggtgaactagtctcttgctttttaattcaggctaacgacgacatgaactcgattggccggacgattaactctgccctgcaactttccaaattaggcggcggggtcggaattaacctcactaacctgcgggaagctggcgcaccgattaagggaatcgaaggcgctgcaagtggcgtagttcccgtaatgaaattgcttgaagacagtttttcttacgctaaccaacttggtcaacggcaaggagccggtgtagtttacctaaacgttttccatccggacatcgtttccttcctttcagctaagaaggaaaacgccgacgaaaagattcgggttaagaccctttcattgggtgtcgtagttcccgataaattctacgaattgattaagcatgacgaagacatgtacttattcagcccttacagcgttgaaaaagtttatggtaaaccttacgcttacgtagatattacgaaggaatacgacaacttagttaacaacccggaaatcaagaaatacaaagttaaagcgcggaatatcgaaaatgaaatttcgaagctccaacaagaatctggctacccttacgtggtgaacgtggatacagccaatcgggaaaacccaatttacggtaagatcgtaatgagtaacctctgttcagagattatgcaggttcaaactccttccgtaattgacaacaaacaaaactacacggagttaggaaccgacattagttgtaacttaggctccacaaacattgttaatatgatggcaactccgcactttggtaaatcggtagaaaccatggttcgggcgttgaccttcgtaaccgaccattccgatattgacgtagtgccgtcaatccaacacggaaacgcccttgcccacacgattgggcttggcgcaatgggcttacacggttacttagcaaagaaccacctctactatggcgaacctgattccgttgaattcaccagtgtttacttcatgttgcttaactactggacgctccgggcttccaacaagattgctaaagaacgcggacaagttttccacaactttgaaaagagcaagtacgcggatggttcatacttcgacaaatacctagctcaagactttggacctaagtcagcgcgggtaaaggaactcttccaaggaatcgacattccgactaccgcagactgggcagacctaaagcaagccgttatgcaagatggcctttaccatcaaaatcgaatggcggttgccccaaccggttcaatttcttacattaacgacgcaacagctagtttacagccgatcgttaaccgggtcgaagaacgtcaagaaaagaaaattggaaaaatttactatccagccccatatttgtccaatgatacgttaaaatattatcagtcggcctatgatattgacatgcgcaaagttgttgatatttacgccgctgcgcaacaacacgtggatcaaggaatgagcatgaccttcttcatgcgctcaaccattccagacgggatttacgactggaagaatggtcgaacaaacaaaatgacgactcgcgatttaaatatcctgcgcaattacgcacaccacgaagggatcaagtcgatttactacattcggaccttcacggataatgatggcgaagtcggcgttaaccaatgtgaaagctgctcaatttaacgatggaggatttgtataatggcaaattatgaagcaatcaactggaacgcaatttcggatcagattgataaagcaacttgggaaaagctaaccgaacaattttggttagacacccgaattccaatttctaacgatcttagtgattggcgtgaacttgatgaggaccatcaatgggtggttggacacgtttttgggggcttgactctcctcgataccttacaatcacaagacggaatggcagccttacgtaaggacgttcggacaccgcacgaaacggccgttttgaataacattcaattcatggaatctgtccatgctaaaagttattcatcaatctttgaaacgttgaatactcctacagaaattgatgaaatttttgaatggagtgactctgaagagttcctccaaaacaaaactaagtttatttatgacttatatcatgatgatggtcacccattgaaaaagaagatttccagcgtgttcctcgaaacgttcttattctactctggcttcttcaccccactctattacctgggtcataacaagctaaacaacgttgctgaaatcattaaattaatccttcgtgacgaatctgtgcacggaacttacattggttacaagttccaattaggaatgaaagaccttggcgaaaacgaacaacaagaacttaaggattggatgtataacttcttatacgacctttacgctaacgaagaaaaatacgttcataaagtttacgatcaagttggttggacggaagaagtgttaaccttcacccgttataatgctaacaaagcgttaatgaacttgggtcaagacccgctcttccccgatacggaagctgacgttaacccaatcgtcatgaacggaatttctaccggaacatctaatcacgacttcttctctcaagttggtaatggctaccgtctaggtaacgtagaaccaatgagtgacgaagactacgaaatttaatcaactaatttactaacattcgaataatccctaaaaattaacagcgctcaggatgaaaattctgggcgctgtttttgttctataaaatccattgtctttctctctacctaacctcccttttaacatcgctaacaagtccttaccacagtacgtttggaagtttacttatataatgctccaattgctcttacgtcctttaaagtacataggtgggtacactgatttccatgtacccacaaaagtaccacattaatatccaccatatcccgtttatgaaagcacaaaaaaaccacctatattccggtataaccgggataaggtggtttttgtagaaattaaacttatttaacttctactgtagcaccagcttcttcaagcttagccttcatgtcgtttgcttcgtcttcggaaaggtcttccttgataactgtaggagcgttatcaaccatgtccttagcgtccttcaagccagcgcctgtgatttcacgaactgccttgataaccttgatcttagctgagccagcgccagtaagttcaacgttgaatgatgtcttagcttctgcagcaccgccagcagcacctgcagcagcaactggagcagcagctgaaacaccgaattcgtcttcgattgctttaacaagatcgtttaagtcagaaattgaagcaccttttaagtcttcaataaattggtctttatctaatgccatttttgtttcctccaatattaattgtaattaaatgtaatgtaatgattatgcagcgtcttcttcagacttcttatcagcaacagccttaagagcgtatgcaacgtcacgtactggtgacatgaattcattagcaagcattgcaagcaagtcttcacgactaggcatcgtagcgaaggtattgattgtatcaatatcagccactttaccttcgataaccccacccttgatggaaaggttgtcgttgctgtcagcaaattgcttcaaaattttagcaggggcaacggcatcttcagcagaaaatgcaacggctgaaggaccaacgaaaatatcatccataccttcaaaacctgcttgttcagcagcgcgagtcaaaatcttgtttttgatcacgcggaacttgattccagaatcacgaagttgtttacgtaagtcagttacttcagcaactgttaaaccacgtgaatcaacaacgattgcggaaacagcgttcttcatttcttctgcaacttcatcaacaattgcagctttctttgcgatagcttctttactcaatgtgtttcacctcctggagatttgtttgaactataaaaaaatccgtgactcaaagactctgagacacgaattaattcatacgttcctcggcaggcaatatattaaggccaaagcaaggccacctgagtcttaggtaaattattcagttataattcactcttgataatatatcacagaccgaagaactaatcaagagaatttagaattgagtaaagtcaaccttaactcctggtccaaacgttgatgcaactgaaacgttttggatgtaagcacccttaacagatgctggacgtaaacgaacaattgtatcgttgattgtttgtaagttaccaagtaattggtcagcttcaaatgaaaccttcccaattggcatatgaacgttaccgtcgcggtcggtacggtatgtaaccttaccagacttagaatcagcaactgctttttcaacgtccattgtaactgtaccagtcttagggttaggcattaagttcttaggtcctaagatccgtcctaaacgacctacttggcccatcatgtctggagttgcaatggcaacgtcaaagtctaaccaaccgtcttggatgcgttgaactaagtcatcgtcaccaacgacgtctgcaccagctgccttagctgcgtcagccttagcacccttagcaaatacaactacggtttgttctttaccagtaccgtttggtaaaacaacggcaccacgtaattgttggtcagcttgctttgtgtcaacgttcaacttgtaaactacttcaacagtagcgtcgaactttgcaaaatcaattttcttaactaattcaagagcttcttttggtgcgtatgctttaagcgaatctacttgctttgcagcttcttgaaactttttaccttttttagccatctgtgtgttttcctcctagcaaatgtggttatagcggattttcctcccactttgatacatctactttagtagagtatccgacagtttcgtattagccttcgacttcgaagcccatgctacgagctgtaccttcgatcatgcgcatagcagcttcaacgtctgcagcgtttagatcttgcatttttgtttcagcgatttccttaacttgtgcagaagtaaccttagctactttctttgtgttaggttcgccggaaccatgttctacaccagcagccttctttaatagaactgaagcaggtggtgtctttgtaatgaagtcgaatgaacggtcttcataaacggtaatcacaactggaattaacataccagcttggtcagctgtacgtgcgttaaagtcctttgtgaatcccatgatgttaatacctgcttgtccaagagctggtccaactggtggagctggagttgcttttcctgcaggaatttgcaatttaacaatatttgctactttctttgccacgagacgtacctccttaaaataagtccgtgtgtggtcacgatgaagatttatatttcttctcccacattaagtatgcaaggcatactacgatatattaccatagaccaaaaaaattatcaaactagaaattaatcaattttgtcgatttggtcgatatctaattcggtgctggtttcccgaccaaacatgtcaatgttaaccttcagtttcatgttattgtggtcgatttcggtaattttaccagtcaaaccttcgaatgctccgtcaacgatggtaactagttcgccgacttctacgttaatatccgcgtgacgagccgtcattcctaaacgacgaagcacccggtcaacttcttcaggtaacagcggcgttggcttacttccggaaccatgagaaccgatgaacccggttacgcccggtgtattccggaccacgtaccaggaatcatcagtcatcaccatttccaccaatacgtagcccggaaattcgtttttcttaaccgttttttccttaccgttcttggtttcaatctcttcttcttccggtacgactacccgaaaaatgtagtcttccattcccatggactttgcccgagaatctaagttatttttaactttattttcgtaaccagagtaagtatgtaaaacgtaccatttcttttcttcagattccaaaattagcgctccttttccaaaataaaaaaactccgtagacacgaagtttttaccaacaatcaaattataacaaaattatccccataaagccatttagataaacaactttaagaataattgaatcaaccagtctaccagtgccaagaaggccacaaagaacaatgacgtggaaactaccgttgccgaatcatgtcttaactgccgaaaattaggccagtcaacttccttcatttcttgtccaatgctttttaaaaaccgaaacatatgtcccgcctcctatctggtttcactgtgaagggtgtgcttattgcaacgtttgcaatattttttaacttctaaacgttccgtacgttgtggattcgcaacaattgtgtaatttcgcgatccgcaaaccgtacatgctaaagcaatctttttctgggacataaaacccctccttatcgtcactcaactttagcatgctcttttctgaatgtcaattagcggtgttcgtataattggcggcttaacttttgtttacacctaagtaacgcgttttgaattttagcaacgtcgtatcccagccgttctgcaatctgatccggccgtagcccttgaaaaagcaagaccgaaacttccttttcaaatggcgacaacaacgtttcatactccgcatacgtttctttaaccatcaactggttctgtggagtaatccgggaaacctgttgtcccaagacctcggcttcttcttccaactcttctaacgactgcgcggcaaagcccgcctttcgtttatatgccatttcaaaacgtaaaatgctaaaaatgcggttgcggaaattatttttgaaaaaagctcctaacgtaatttttaaatccgcatcgtaattaaccaccgagttaaaaaagacgatccgaccttcttgcatccaatcatcccaatcgaaacttcggatggtgtacttttggcgcatctttttgataatcgggtggtacttgttaaacaatcgttcaaaattgtgcgtgtcatctgccttgacctccgcaataattttggcttcgtctaaatcaacttgttgcactttaacctctcctttttgtaatcgcttacttttacggaaagttatgctaccaagccttttttgaacaaccaaccgggttttttggattaaaaaaaagaataaccgacttttcagtcaattattcgttaattagttttataacggatgacgggaactgtatccttgataaatcaataaaccagcggcaacgctcgcgtttaaactttgaatgtcacccaccataggaatggttaacatctcgtcaacattttctttggtaagtcgcgccattcccttaccttcgttaccgatgattaagccaactgggccagtagcatcccaacgccgatagtcggtgcctgccatatcagtgccaaagatccataaaccacgatcctttaattccttcaaagtgttcactaagttattaacttgtactacgggcacccgttcgatggccccggccgaagttttggcaaccgtgctggtcaaacctaccgcccgccgtttcgggataattaccccatgaactccggcagcatctgccgtccgtaaaatcgaaccgaggttatgcggatcttcgattccatctaaaatcaccacaaacggcgcttcgttacgagactctgctaattcaaaaacttgctctaaggaagcatattcaaaggatgctaccgccaaaactactccttgatgattttgcccgttagctagcgtatccaatttagatttagcaacccgttgaatcaccagcccctgcttcttagcctttgcaataatttggccgatactttccgattttaagccttcttgaatgaaaaccttattgatcgaatgaccgctttttaagctagccatcgccggatgccggccgattacgaagtccggttgttgtttgttttcgttattcaatacgtaattttccttcctctactttatcaatgcaccactgtgcaaattcgtctaggcgttcagtttggttggttaaggataaataaccaacgattgcttcaaatcctgtcgaaatccgatacgttaaaacggaagtgtttttagccgaagtgtggcttttagcgttacggcccttcttaaaggcttcccattccgcttccgtgagaaaatcattttcttgcattgcgtcaattaacgccgcttgggcctttgctgacacgtagcgggttgccacgtggtgtaaccggttcggtttggtcatgccctcttcaatcaaatgtcttctaatgtaaacttcatattccgcatcccctaaataagcaagggcgattccgttaattgcttgataattaatctctttactcatctttttttctccaacgcgttccttgaggggtatcttctagaataatccccatttcttttaattgatcccgcaaacggtcgctagtttcaaaatcgcgcgcagcccgggctgcgtcacgctgcttaacgagcgcttcaattttttcgtcagctggggcttccgttgcggttgctaattcaataccgaaaattgctgccatttccgcaaattgttttgctaagcgggcaatttgttcatgatttaccgttgtttgttcgctataaacgttaattaagcgggcaaattcgtaaactaccgtaattccgttttgggcgttaaaatcgtcgtccatggccgtcacaaagtcagcttgcaacgctgtggcttgttgatcaactgctggatcagcagctccatcagcggtttggaggcgataatttaaattaacgtaggcgttttgcaacttttccaagttgtttttcgcgtcttgcaggctggtttcagtgtattgaattggcttgcgatattgggtagtcgacattaagaaccgcaaaacttgcgggttaacttgcttaattaagtcgtgcaccgtgacaaagttgccgagggacttactcatcttttcgttatcgtcgcccacggtcacaaacccgttatgcatccagtaccgggcaaattgcacgccggtccgggcttcactttgagcaatttcattttcgtggtgcgggaattgtaaatcttcgccgcccccgtggatatcaaaggtgtcgcctaaatacttcgttgacatgaccgaacattcaatatgccacccgggacggcccttcccccatggagcttcccaagcaatttcaccaggtttagcagccttccacaacgcaaagtcgatcggatcttctttttgcgccgtttcttcgtcgttaatgtgttggctggcaccctgttctagctcatcgatattttggtgggaaagtgcgccgtaatttttaaaacgacgggctcggtaatacacgttgccctccacaacgtaggcgtaatctttttcaatgaggtccgccacaaaggcaatgatgtccgtaatgttttcagttgcccgtggatttacggttgctggttccacgttcaatgcctgaacgtcttccttaaaagccgcaatgtagcgttccgctagttccggaaccgtgatgttttcggcttgggccgccttaatcattttatcgtcgacgtcggtaaagttagacacaaatcgaacttgataaccgcggtattctaggtaacggcgaatggtatcaaacgcaattacgctgcgggcatttccaatgtgaatgtagttgtacacggttggtccacatacgtacatggagacctgctgatcaactaaaggtttaaaaacttcctttgaacgagtcatcgtgttatatagtttaatcattttttcactccctcaggggatttttatctctcctaatgataattgaaaacaaaagctaacgcaaagaagaaaagaggcccaaaaagcattctccctcaggaaattacttttccagcccctttttaatcattcattaaatgaactaattatttttatttagcttaattcttcaatcattgcccgcaaatgcttcatcgataattcgtggcccaataattccaagctttctggcaattctggtccgtgcatttcgtgagtaattgcaatccgaatcggcatccacaatttacgacccttaacgccggtttccttttgaaccgccttaatagccgccaagatgtttaccgtatcaaagacttctaagtcagcaaacttcttttccaaagccttaagcactggtaaagcatcgtccttagccatttctgccttagcttcttcgtcaatgtcttccggaccgttaaagaatagttcagcaaaatcaacaatttgcgcggtgtaactcatttgccgcttgaacaagttaattaacttacgagcccattcaatcttcattggagcaggatcagtttcaatcttgcccgccttgatcaattggtgcaatgcggaatgcataatgcgatcctcatcagcagccttcacgtattggttgttaatccattctaacttcttcgcgtcaaacgccgctggagacttgcttaaccgtttttcatcgtacatcttgatgaattcacgttgggtaaagatttcgctttcgcccaccggagaccaaccgagtaatacgatgaagtttagcattgcttctggtaggtaacctaagctccggtattgttcaataaattgaaggattgtttcatcccgcttactgagcttcttaccagtctcactattgatgatcaagctcatgtgaccgaattttggtgcttcccagcccaaagcttcgtaaatcatcaattgttttggtgtgttggcaacgtgatcgtccccacggaaaacgtggctgatcttcatcatgtggtcgtcaactactaccgcgaagttataggtcggcatgccatcccgtttttggataacaaagtcgcccccgatggtttcagaatcaaaggcaacgtggcctttaacaatgtcgtcccattcgtacttcttgtgttcgggtaccttaaaccgaattacgggttgaattcccgcagcttttgcgtcagcaatcttttgggctttttcttcaggtgataatccagcgtattcgtcaacgtaatgcggcatttcaccgtttgcccgttgttcttcgcgttgagcagctaactcttcttccgtcatgtatgactcgtaagctttgccttccgctaccaactggtcgatcaggggttggtaaatctcttttcgttcagattgccggtaaggaccgtaatcgccgggtttgtcgggaccttcatcccaatccatgcctaaccacttcaagttatcgatttggctttgttcaccatcggcgatattccgactttggtcggtatcttcaattcttaagataaactttcccttgtagtgacgagcaaataaataattaaataaagctgtccgggcgtttccgatatgcaaatgtcccgttggacttggcgcataccgcacgcgtatttcttgctttgccaaaattaacacctctcccaaaattatgtcacaatgtcacaatgtctctattctacatttatctactacagaaataaagtgagccacggaaaaacttttcttccggacccctaaatctttaagcctgaacaattctttacttagattctggctttttgccttccttttcgtctggcttatcgtgggtaatttccttcgtggaatgcatcggcttagcgaaaatcatccgtcccgcatcagtttgaattgcactcgtaacgataacttcgatcgtctttccaatgtagaacttcccgtcttcgaccacgaccatcgttccatcatctaggtaagcaaccccttgttgccgttccgtaccattcttaaccacgtgaacgctcattgattcacccggaattacccgcggcttcaaggcgttagccaattcattaatgttgagcacctgaacgttttggaattggctcaccttgtttaagttgtagtcgttagtaacgattaccgcgtccttgtccttggccagctgaatcagcttgctgtcgacttcttcaatctcttcgtaatcgccttcgtacatctcaatgggcatgattttttcgctctgtaacttgtttaagaaatccagcccgcgccggccgcgcacccgtttaatactgtctgcagaatcggcaatgtactgtaattcatacaatacgaagttaggaaccagcagggtaccttctagcaatcccgtcttcaccaaatcgtaaatccggccatcaatcaaaatgttggtgtccaaaattttatagtggtggtaattttcaccagcccggcggtcaagcacttggttatttccatcgcgcttccgggtctggaacaacttcttccactcgttaaaccgggtcgttcctaatcggtaacccaaataacccaacattaacattaaaatcagcggaattaccgtattcacaaagaaaacgtgggaccgatagaataaggtcgaaattaaaattgcaattactagccccaataccgttccaatgcttccggtaattaaatatagcggcgacgtatcaattaacgccttttcgattcgtttcatcattttcaagacgtaactcgtcaagaaaatggaaagaatccaaaaaataaccgccccaattaaaaagttagtcacccggttatttaataaaacaatcgtgttgatcttaaagatcaaccagatcaacggtaggtacgccattcctagcgccccaccggccaaagcgaagaccgcttggacgatccgtttcttgatgtctttcattctctttccccctcgtgttaaataaattcaagtcgaaaagttacctttccaactacactcgtacgtcaaacaatcaattatctttttaatgcccttgctctagttaccggcaccgttaattaaatgcccgccgaatcgcgtcggcaatcgtagctacccctacaacttcaattccttcggggggctgccaccccttcaaattattcttcggaatcaaaatccgcttaaaaccaagcttttgtgcttcagcgacccgttgttcaattcggttaacccgccgaatttcaccagttaagccgatttcaccaacaaaactatcggtcggccgggttccctgatttttaaaacttgaaacaatactaatcgccaacgctaagtcaattgcgggttcgtcaagcttaacgccgcccgccgcctttaaataggcgtcttggttttgcaaagtaagctttgcccgtttttcgagcaccgccatgatcagcgaaacccggttgcggtccaacccgctcgccgtgcgctgcgcattgccgaagatggtgggcgtaatcaaggcttgtatttcaactaaaatcggccgagttccttccattgaaactacaattgccgatcccgaagcatcttttaaacgctcttctaagaaaatttctgacgggttagccacctcgcgtaacccttcttcgcgcatctcaaagattcctaattcgttcgtggaaccaaaccggttcttcaccgctcgcaggatccggtaagtgtggtgcagatcaccttcaaagtaaagcaccgtatccaccatgtgttccaaaatcttcggccccgcaattgcgccgcccttggtcacgtgaccaacgatgaagatggtaatgttattggttttcgcgatttgcattaattctgcggtaatttctcgaatttgagaaacgctccccaccgccgattcaatatccggttcctgcatggtctgaaccgaatcaatgatcacgtattcggggtgtaactcctcaatcaccgcccgcacgctagacatatcggtctctggatacaaatagaagcgttcactattgactttcaatcgttcggcacgcatcttaatctgggaagcactttcttcaccagaaacgtaaagtaccttgcgttgcgtctctgccaactgtcctgatagctgtaacaacagggttgattttccgattccaggatccccaccaattaagactagggagccgtcaaccaccccgccaccaagcacgcggttaagttcttccatcccggtttttacccggggttcctcgtgcatcgcgacgtccgaaatcagctgtggttgcgtatgtttgccgtcaaagctcacccgactttttcgttcagcctttggatcgctcatccgttcttcaactaaagtgttccacttaccacaattgggacagcgtcctaaaaatttaggggaggcgtatccgcaattattgcatacaaactgggtcttaacttttgccattctcccgtcctctcaatccgtgtgatcaccttatagaatagcatggatcacctagatttattagtgatttgtttgacctttattgatttttaattatcgtttggttgaaccaaagccccccgtccgcgtttggaggttacccgtttcaacatccgcagtcaggtagttcatgaaaattccttgaccaatccgttcacccttcttaatggtgatgtccgtaattccgtagttaattaattggaagaaaatttctccttcattaccggaattattgtagtaatcagcgtcaacaattcccaccccattaggtaaaattaatcctcgttttagcgggttgctggaacggttggctaacattaaatattcatcatctgccatgtaagccttaattcccgttggcactaagtaaggttttaaagccgcttgggccaattgttgctgcgcgggagaaacttcttcttggtggcgaactgcccacaaaactttaatgaagtccatcttccaaatacttggcaacgtaaaatcacgggctgcttcaaaatcataccccgcggctgccttagtctgccgttgtggcaaatgcaatccttgtccttcgtaactgcttacaatctcaaatcctcgtttcatatcgttcctcccaatgatgtttatttcattatccgttgtatccaaaaatttgtaaacgtaaatctcggtaatcaattgactttatccgctttctttacgacaattagtagggtaaggaggcttggaaaatgaagcgtaaccttgatgaaaatcgcctattttggacaaacgacgctaacgaccaggtcggacaaattttatattccccaatgccggatcatgcaaccttgatctgtgaagaagttctggtgaatcctcagtttcgcggccgcggaatcggtggcaaaatcatggctgattttgtggaatttgctaaggaacgggagcaaaaaatttatccgctttgcccgtttgccctcaagtactttcaaaaccatcccgaacttgccggcatgaatatgcacgagcaaatcactgctgaaaaagttaaaaatctaaccaaccgaaagtgagtagataattatggatcaaaatgaactaaaaaaactggtaggtaacgaagccgttaaatttattgaagacggcatgaccgttggcttaggaaccggctcgacggttaaatttatggttgacgccttgggtaagcgcgtcaaggaagaaaatttaaacatcgtgggggttccgacctccgaccgtactgctaaacaagctcgcgatttagggattaccgttaagtcggttgacgaagttgaccacatcgacttgaccattgacggtgccgacgaaatcagtagcgatttccaaggcattaagggtggcggagcagcccacctcttcgaaaaaattgtggcaaccaattccagcaagaacatgtggattgttgatgaatctaaaatggtcgacaagttgggcgctttcccactcccgcttgaagtaattccttatggtagcaagcaagtcttcaagaaattagaagcgaagggattcaaccctgagttccgcatggatgaaaacggtaatcacgttttaaccgactctaaaaattacgtaatcgacttgcatttacacgaaattgacgacccgcatgcattggcagattacctaatcaaacaggttggaattgtcgaacaaggcctctttttagacacggttaacacggtaatcgtcggccggcaagatggtcccgaagttcttcaagcacgtccttaattattattaataaacaaagttttttaaaaagaattggagctgatttatttgagtaaagaaatttctaacgaattgattaaccaatttaatcaagaataccacgaccgcaaagaagccaaggtactggaacggacggttacgaagaatggaatcttgaacgccagtcgtaacttagctgccgatatccaaagtaccccggttttctccattgatttggacaccggtgacgtggccaaccaaaaacaaagcgggcgctgctggatgtttgccgctttaaacaccatgcgtcatgacatgaaaaatcagtttaaggtgccaggaaacttcgaactttcccaaaattacaccttcttctgggataagtttgaaaaatcaaactggttctacgaaaacatcattaaaaccgccgatcttgaaccagacgaccgcaaagtggccttcctacttaacgagccccaaggtgacggtggccaatgggatatgttgtgcgccctaattgaaaaatatggcgtggtaccacaatctgtttacccggaaacgtataatagttctaaatctcgtgaattcgacaccctattaaacgaaaaacttcgtaaagatgcgatcaccctccgtaagatggtccgagaccaagctagtgaagatgaaatccaaagccggaaggaaaagatgcttagcgaagtttaccggatggcagcttatagctttggtgaaccgccagttaaatttgattgggaattccgggatagcgatcaagtttaccatcgggaagccggaatcactcctaaagaattttatgacaagtacgtgggctggaaccttgatgactacgtttcaatcattaacgcaccaactgcggacaagccatttaacaagacgtacacaattgaaatgttaggtaacgtggtcaatggtcggcctgttaaacacttgaacctaaccatgaaggacttcaagcaagcagcgattaaccaattaaaagctggtaaatcagtttggtttggttgcgacgttaaccaacattcggaagctcgtgaaaagggactgctcgaccttgacgcctttgcggaagatgaactatttgatattgacctttccatgaccaaggctgaacgcctagattacaaggaaagtttgatgacccacgcaatggtattaaccggggtcgacctcgtcgatggtcaaccaacgaagtggaaagtcgaaaatagttggggaaagaaagtcggcgaaaagggctacttggtaatgtcagacgcgtggatggacgaatactgctaccaagttgttgttgaaaaacaatacttaacggaagcccaacgcaaggcccaagcagaagacccaacggtgctgaagccatgggatccgatgggatcgttggcgtacaaggattagagagcaaagcccctgggtagcttatgagaactaacagaatttaagggttagccggaaaaacttggcggctggagctcatttcgactacgttgcagtgaaacgtcgttctaccaccatctaaaaaggcgctgtgacaaaagtctttaaacaaaaaaacggttcatgaggtgaaatttcctcatgaatcgtttttattttggcgttttgccttcaacagaaccaaaagccagttggttccgcttaaataaaaattgaccatcatgccaaaatcaggcatcagtcaattttcagttaatgctcgcaaactacccgacttttgtcccactctctttttagcattaaaatttacattttagtcttttgcacaatgtttaaatggtgatccatttcataaacgatcggctcgccattttccacttcgaccccgtcaatcccctgatccgaaatctgttcaagatacttgattagggctcgtaaagaactgccgtgggcaaccaccaactgattttctccttgaatcagccgtggcgcaatctggtcaacccagtaaggcagtaaccggtcgtacgccatatgcaaactttctcctaacggttcgtgaaggatcccgtacatccgatagcgacggtcgtggtcggcctggtttagtaaaggaggaaccgcatcaaaacttcgccgccacaaggctacctgatgtttaccataaatttggcgggtcacgtccttattctgtcctcgcagcgcaccgtaatgtcgctcgtttaaccgccacgttttggtaattggtaaccaactttgaccaagttcgtcaaccacaatattggccgtgacgattgcccgttgcaacatcgaggtgtgcaccgcggtaaaattaattcccgcctttgacaacaattttcctgcttcatgggcctgttggatgccgcgttccgtcaacgggacgtcagaccatcccgtataaacgttatcccggttagccgtactttcaccatgtcgaatcaaaactaatttagccattactttctcccctatttcagcaattaatcggcaaaccaatcccgtaaaacttgctgaaatttttgctcacgttgcatcactaattcattttcatccattttccggctcgttgcaagccattgccgcaaagctttccttaaattttcagttaattggggaccttccttgaaaacttggtccgcaattccaatttgttgtaattggctagcagtcattggcacgcgagccaatgcacggtcatcacgtaatattgccgccatggcctccggagccgcgacggaaaacagaccgttttctaacatccataattggttagcgttggcaaaggctagcgctcctccgctatggccttcgccaacgatgaccgctaagttaggaacccggagcgcacccatggtttccatcaggttggcaatcattaagctttgaccttcattttcggagtcaacgctagcatcggcgcccggcatgtttaggaaactgaccacggggcggtcaaaccgttgggctaactccacgttccgtaacgccttgcgataaccgcccgcccggactgcgccaccatttttcgctaaccgctcggtaaggtcctgcccccgatccacgcttaaaaaagtcaccggttgttcttcaaaaaggccgattcccgcccataccgccggatcatcgctattcacccggtcaccatgcatttccacaatttccgtaaatagccgttgaataatttgctggcccgtaatccgttgcgcggaacgaaccttatttaaccgcgcgcttaattccttatccatgttaaccaccgtacccatgtaatcttagtaaccgttgcaagtaaccgcgcaactcttctcgctgcactacggaatctaattgcccatgctgcaataagtattcggccgtttgaaaaccagcgggcaagtcttctccagtggcttgctgaattacccgttttcctgaaaagccaatctgcgcatgatcttccgcaattacgtaatcacttttgaaggcaaaactagctgacaccccgcccatcgtcgggtcggtcaacacgttaatgcttaatccgccagcttcccgcaaccggcgttgttcagctaaaatcgtattcatttgaagcagcgcataaattccttcttgcatccgcgcgccacccgaagccgtaaacaaaatcaacgggtaaccttggtgccgcgcccaacgcataatttgccgcaacgccatcccagttaccgtgctcaaagttcccatcataaaccggttatccataattcccgcagctaccggatttcccgcgatggtcccccagccaatggtgactgcttcgccgtgtccgctttgttgcctactcttggctaacttttggtcgtaattgggaaaatttaattgattttgcgtttccaccggcacggtaagctggttaaacttaccttcgtcaaaagtaatcgcaattcgttcttccaccgttaaacgttgtggacaacgacaaaaagggcaacgccgaaacgttccccattgtaattcatgtacgtgtttgccacattttgggcattttgaccaacgattttgcttttgcatcactaacacccatccaaaagattttgataagttcgaatgtcataagttccttgaataaacgcgggacttgcgactaattgctctaccgcggccaagttcgttggcactccggtaattttagtttgttttaaagcttgtcgtaatttttgtactgcttgtgctcgtgtagaagccgtaacaataattttgcctaccaacgcatcgtaatacggtgcaatttggttgcccgcagcatacccagtttcaattcgagtagcgggccattccaattcaacaagttgccctggagcggtggcattaatccgcgcctcaattgcgtgaacttgggcgtcccccacctttaccagctctggttgaccggccgctactacaatttgggtctgcacaatgtcaattccggttgtttcttcggtcaccccgtgttcaacctgtaagcgggtgttcatttccaaaaaataaaattcttcccccacttgcaaaaattccacggtgcccaagctttcatagccactttgatccaacaaacggtgaaccgcttgatacagccgctcgcgttgttcaatcgtcaagttagcaggactttcttccactactttttggcgatgcaactgaatactacaattccggtcgcctaaaataatgatttgttcgttaagccccagcacctgaacttcaatatggcgagcattttggaggtcccgttccagatacaatggtgaacttccaaaggacgcaccagattcttggcgaactaccgcaatgatttgggataattcctgttcatcgtgggcaacccggatccctttgcctccgcccccaaaactagcctttaataaaacggggaagcctagctcttcagctgcgggtttaatttgtcggtcgtcagtaatcagcccgctaccagggatggtgggcacccctcgtttttgcgctagttcacgagaacgttctttatccgcgtagcgttgaatttggtcgggactgggcccaatccaggtcaacccacactcggcaaccatggtcgcaaatagcggatcttccgataaaaaaccataccccggatgaattgcatcactaccggtgatctgggccgccattaaaattgcttctcgattcaagtaggattcctgtgcactcgccggccccacgcaaattgcttcgtcggccatttgaacgaattgggcctgttcatcagcggttgaatacaccacgaccgttgaaattgctagctggcgacaagctgcaataattcggacggcaatttcgccgcggttagcaaccaaaacctttttaaacattttatttccccaccaattccacgaggggttggtcgtaagcaactccttcgccatcttccactaaaagtcgttgtaccgtccccgcttggggggccttgatgtcgttaaataatttcatactttcaatttgtgcgatcacctgacccttttccaccagttgtcccggggtaaggtcctggttaaagtgcacaatgcccaccatgggacttttcactaccatccccgctggttgcggatccgtaacttgcgccggagttgggggagctgtcggagcggaatccgcctttttgacgtgtagctttaagccttccatttcaatgctgatttcttggtacggataatcttttaggcgatttaaaatatcatagactttgtcaattttcattttttctacctacaatttaataattaaactaccataatctaaaccggcgccaaaaccagtcaacaagactgttttagcactgggatcccgactttgcaactgatccagcgccatcggaattccggcagaagacgtgttgccgtaatcttggacgttggtaacaaatttttcaaacggaatttgcgtttcttccgcaattttttcaataattcgtaaattagcctggtgacaaattacgtaatcgatggtgtcatgcaggtcgttacgttgcaaaattgtttgcatttgcggaggaaccgcccccgtcgcaaaactaaacacgtcccgcccgctttggtaaaatgcgtcgatttgcggataattacttgcttttacatcggtaatagccggaatccgtccactgtgaatgtactcatttttttcagctaacgtagccaattcttcatccacaaaaaagtcgtcggccttcgtcgattgacttaagatagctcctccggctccgtcaccaaaaaagacggccgaggtacgatcttggaagtccatcatcttggagttagtttccgcactaatcaccatggcattttggtaacgcccagcccgaagaaacttctcggcggtgcttagcccaaacacaaatcccgcacaagcggctgaaatgtcaaaagcaaaggcattatgggcaccgattttatcctgtactaaagctgcggtcgccggagttaaggagtccggcgtaatcgttgataaaatgattaaatcaatttgatccgccgctaaaccactttttttcaacagctgtcggcccaccttcgccgctaggtccgacgtgttctcggcacctaacgcatagtggcgagttttaatacccgtatgagattgaatccattcgtcgctcgtatccataatttgtgctaattcatcattatccaccacccgttttggaacataatgggcggtcgctaaaatttctaaactcatttcgccaactcttccttacttttatttatcattttattttatcagtaaacgattggttgtgaaaaccatctcactagtccatctaaccactttaatcgatttattcgccaaaagcttcttaaaggttaattcttatttttctcttaagaaatcgactacttgccttttgttggattaatatttatccttaaagttaacaagcaccatattttaatggaggtatgctgaatgtttaatttttcaattagttggttaatcttttggacgaagggccgcgtggaagtcgataatcaatccgtgcggagccggatcccgcggttattaatttggatttttccatatgggatggttgctaaagacgttaacctagccgatattaaggctaccgaggtcaaaagcaaaaaccaaatcttccccttgctactagggatcgttttaattgtgttaggaattttaagtacgatgaacgacggagttgccttgggaattttggcaatcgtcatcggcatcatccttggtggggcaggtttcaaggcgcgtttagtgcttaccaccacccagggaaccgtcaatctggatgcagtcgcttttcaaaaagacgttcttttacagattgcccaagaaataaaaaatcggcaaactaagccagaaccacaaattaaggataaccaagttctcgaagatctgtaatctctgcggcttgctaatggttatccaccatgcaataaaagaagcatggaacaaactagcttttggtacacgttttgatgctattgaagtcaaaacgccaaaataaaaacgattcatgaggaagtttcacctcatgaaccgttttttatttagaaacttttgtcccacgctcttttttagccataattcatttccaatttacaaaccatttttatccaacattttaatcaaatccttgcggctatcgttcggaattttttgggcgtacaccgttaacccgtgggcggccagtgctctaatcgccgcgacctcttccttaccgactgcgatagcatccgtcaacatggtcatgtctaccgcgtaggccaggctacccacgtcaactcctaaattactgatgtcaatgccgccctcgactaatttcaacatgtcttgaattgtttccgttagcagcagcactttaaacgaatcaaattggggatcgtgataaattttgatcatcttgtcgaccgtaatcacgttcacaaacactcccggaggagcagcctgggtaatcagtgttttacgcaatgtatcttctgccacactgtcagaaaccaccaaaatccgattaggcttcactttcttagcccacgcggtggcaacttgcccatgcaaaagccgactgtctacccgtgcgagcaatatttccattgtcatattctaatttcctccaaaaactattgattcttctccatctcatttaggattgtatcatttttttcctgccaggtttctaacaatttgtaaatataaaattcttcacctagggtcattttaatttgaatccgttgaaggaattggtcatcagcttcctgaaccgccttaaaccaaggctgttcttgaacttccgcaagttcagctgcgttgacttgcatgggattattcgttagttgacgttctaccgcgcccgctacgtgcattatcaaattaatccggaaggactcgctaaattcgacctgccggctttgcgcaaggtaatcaacgtaattccatagaatatcggcaaatttgtcagcattcaaaaacacaaagtacttcgacaagtattgtcgacaaacactccgggtcagtttagcgtccttttcatcaaagacccaggaaagctcgcttcgttctgccagttgacgaacgaacttttcgccgcccccctgcaataaggattgtaaaggcatgaagggaactcccacttccggatccattaccccggttgtggcaacgatggtgtatttttggttaatttcctcaattgcttggtgcatgtttacgattgaaattgggaacaccttaatatcttcaattaaattttgcaatagcaactggtcaagaattcccttgattttttgggcggtgccctcacccgttgaacaaaccgcaattaccgcctttggttttcccgaaagcattgctaccgcctggtcgtcttccatagactggccttcgtcagtaattgccacccgggagtagccgtgaaattcgcgaagttcggcgtaaatttcgtctaaattactatcaatgaaggacgcctttcgggtagcttccaaaaccatcgcggtggttaccatgtcaatcaccttgaccggaatttgagtttcttcggtaattttaggaccaaaagtgcttagagagcccatatctacaaggagtagcaccccttccccctgatctgccgcgcgaacccggtcgacaattcccttataagctacctgcggattcatatctaatggcatgtcaaaggcttggatcgaattatccgacagcaattgtgataccacttgtgccattgaactagccgtgttactaccgtgcgcggccaccacgattccaaccttaccggtactagtgggcaccgttttaagtgaaattaggagcacggccaggtagtagctttccgattctgggattggcaacccgtaacgttgttctagcgactctttgattgatttagcgacttcgagctcttctggataatccttaaccattgccactaagtcgttgcccattaaccgcatcggctttcccgattggattcgtttgatgaaggaactaatgtgcaaactcatcgcgtaaataaagttgtccttgaaccggtagttaagccggttttccaccttgggctgaatttgcttggtaaagttaataattcccttgtccacgatttccgctagcttactttccgcgttcaccgtatccaggtcgtttttataaaatgactttaaatgaagattaatgtcggtagtgatgaaattattgatattttcttggtcgagcccctcttcgcgaagcatcatcgctttatccccaatgatttcgtacaaattgtagggcagttcgtaactatctttgcgggtaaccggggtggcgtaactagctccgggtttaaccaccatatacggttccaaaagtttggaaatcgccccgagttcctgccggttagacgccaagtttaacaacccgtccttgatattgctaggcaaatcatcggaagtaatcatgatttttccttcgttaccaatgttattaaggaaccctttcgcacacaccagctggatgttggacttcaactgaccgacgtttccgtaagtaacgctaccaagcaaagcttgaaccacgtcttcggttaaagtgatttccttgttcgtccggttggcctcaatcgtaactaacgaacgcaatagttcaattcgttcctccgggctccgtttattgaatggcggaagctggatcgtaattggaatccgccgtacaaaggtttgcaacaaggtactttcgggatcttcggttgtcgcacacactagtcgaacgttggcatggtgggtcttagcagtttctcctaaccggctgtaggtcccgtgatccatgaagtaaaaaatcatttcctgcccttctgggggaaggcgatgaacttcgtcaaggaacagcattccaccatccgcttcttgaattaacccgtcttgttcgtcgtctgcgccagtaaaggcccccttcacgtaaccaaacaaatgggacatcagcaattctgggttgtgggcgtaatccgcacagttaaaggttaccaattgttgatccttactgagtaggttgcgggcctgtgcaaaatcaaacattgcgttggcaaagtacgttttccctgaccccgttggtccgataatcaacgtatttaacccgcgtggcggatacaacatggccgccttggcctgttcaatttggtttttcatactttgatccttaccaatcattcgatcaaagatatctttatgcacactaagctgtttagcagctgtcggcttatcgagcttccctgccagcttctttttccccagttccataccgctaatcccatcttcaatatggtactctgaagggtcctgcgccaacggatcatcttcatttagggctagttgacaataacgaactgggcggccagaaattttaaacaattttcgttgccgaaccaaatcatttaattctttactaacgttgctacgcgcaatttttaacgcgtccgcaatcgttgaagttgttaagccattttgccggttggcttcgtccgccgaagctggctccgtatgttctaaaacgtattgatatattctttcttgtcgtttcatttagcctcaccacgttaactgtattaaacactgtctgtattgatacactacagtttatcacactttcgccaaagcgttttcaaggcggattacctagggcacacgggtttgaattcccgaataactaattaaggcaccaaccgtcagcaaaacgggcagtgccttaacttggttattctgctttagtgcagtgattctggaggctgtcctactgctgccatgtcaaaatgagctccagcccctagcttcttccggttaaccaaatataaggaccaaccgcccaacccgcggttagtccttatattccgttaatcctcacaagctgcccaaggggcttccgctctctattttcggatccttcgccacacttcttttaatccgcgctttactacgtctaccactcctagcgagcggaccattctttcttcatccacgtacttgcgaattcctctcaacaattcgtggggatgccttgccgcaaagctgaaagttccgctatgcttcgttttaattgcaaaccggggaatccatcttcccccaaacattaacgacgcaattaccttgtcaacttccttccacgggatttgaatgtagttttttacgttgcggttatcaaaaaattcaaaaccgcggtcgccaatcattattttgccgtaatcccccatcccaagaaatgaggttgcgtccgtaacctggtcgaccttggtgttaatcgattgtaccattcaatttgctccattctttatatttgctgtttccattataatgcgcggtcgagttaaccgcaaaaactcttaacaaaaaaagcccaggccattgcccagactttattggaatcattgcattacataacgtgtagtaagtgaagtacaacaccaagaatgaatagaccaaagataacgatgattggtgaaacacccttcttaagcaaccacatgcaaagtaatgtaagcagtaatcctgctaaacctggaattaattgatccaagttatcttgcaaagtagtaaccttttcacgagtgagtgacaaaccattcgattgttcgataagggccttttggataccctttgcaccacttggcaagtttgcccagtcaatgtaagcacccttactttgttttacagttgaaacaaccggtgtgaacttaaccacaacccaacggttaatcaatgaacctaagataaacataccgaggattgaagcacccttagtaacgtcttggagtaaaccaccagacatatcttcagtaatctttgaaccagctttgtagccgaattcttgagtataccaagtgaagcccatccgaattgcgttccacaatacgaagtaaaggattggtcctaagatactgccacccattgctagtgaagcagccaaagcacctaaaattggcttaacggtgaaccagaataccgggtcaccaaccccagcgaggggtcccatcataccaactttaacaccttggatagcaacgtcatcaattggtgcaccattagcacgttcttcttcaagtgacattgtaaccccaaggattggagcagctaaatatgggtgagtgttaaagaattccaagtgacgagtcaaagctgcggcacggtcttctttagtcttgtataacttcttgagggctgggatcaatgtgtatgcccaaccaccattttgcatccgttcgtagttccatgaaccttgcaggaatgtggaacgtaaccaaacgtgaatacgatcttttttagttaattgaactttttcttgcattttatgttggcctccttctagtatttgtcgataatgtcgccgagtgggtcaccagtacctgaattaccaccgttgcttgaaccacccatcttagaaagggttaagtaaatcaacgcaagtgagataccgattgtacctaaagcgatcaatgttaaatcttgaacagttgctaaaacaaagccaagtgcgaagaatggccaaacttctttagtagccatcatgttgataaccattgcgtaacctacggcaacaaccattccaccaccgattgatagaccatcagtcaaccaagctggcatagcagaaagtaaaccacgtacaggaccagcaccgattgccaagatcaatgctgcagggatcgcaatccgcaaaccttgcatgatgatcgcaatgtagtgccacatttccaatttagcaaagctaccttccttagcagccgcgtccatgatgtgaacaatcaaggttgccaatgtacgagcaatgatggtaagcaaaagaccagctacagctagcggaattgcaagggcaatcgctgatgaaacacctgctttaccttgaccacctaaaactaaaataatagcagaagctacagaagctaaagcagcgtcaggagcaaccgcagccccaacgttagaccaacctaaagcgatcatttgtagtgaaccacctaaaataaggcaaggtactaaattaccagttactaagccgattaacgtacatgcaattactggttgatggaagtggaattggtccaaaataccttccataccagctaagaatgacacgataacgactaaaatcatttgaattgcattcaatgccatgattattaatcctccgtttttttagttatttttttgtttattaagctcatcttgagccttcttcataattgcgtctaaattatcctttgaatcagaaggaaccttccgtacgtccatttgaacgcccatgtcttccaacttcttgtaagtgtcaatatcattttggtcaaacgccaatacggtatttggttgaacttttccagctgaatgagccatcgaaccaacgttcaaagtcttaattgggacaccgccttcgatggctttcaaagcatcttgaggggtttcaaacaaaagcattgcccgggtaccaccgaagtgtttgtcgtccttagccaacttaatcatttgttcgattggaacaacgtgggctttaacgcctgctggagcagcttgtttaatcattgatgaacgtaacttgtctttagcaacgttatcagaaacaacgatgatccgatccgggttagtagtcttcgtccatgaagtagcaacttgaccatgaagtaaacgagtatcgattcgtgctaacacgtaatcaaagtgacctggtttaccagtattaactggtgcagctgcttcagcagcctttggagcttccttaggttgaagttcttcaggacgaaccttaaccccttcttttgctgtgtcaatgatgtgtgcagcaatttcttgtgctgattccatcgatagacgagaagcatatgcttcaattaacattggcaagttcaaaccagcaacgattgcccatttgtccttatgttcttcaaacaagttgttaacttgattgaatggagtgcctccccataggtcgactaagaataatacttggtcttggttactaaaagaagcaattgcttcttgaagttttgctctgagatcgtcagggccttcgctaggcattaaggttacggccttaacgtcttcttgttcaccgaagatcattgaaccggattgcaaaatgcctttggcgaattcaccatgactagcaatgataattcctaccatttgtctgtatacctcccattttctatttgttacagttgaaaaaaataaaataagttctaaacctgcaactagttaaaataaattcttgacagccttttcaattccaaaacttcttaaccatcccaaaagcgttttcacaacgcccaaaaaagttaaatttgtaataaaattgtggccagctgtcgatctaccgccaccgaatggtaatcagtaggaccaacataccgctaacacagtatgtttagcttccattaactatataagcaaataccgtgccaaaatacactaggcttaacgtaagcgaatacaagcctttttaataatacactattttaatacactattctgtatcacttagtgtatcaagtgtattattaactccctggaaatctggtcattttttgacaaaaaaagagctgtgatccaagttaagttgaatcacagctctttaaccgaagagtaatgcggccaagagggttcgaacctccacccgagtaaattcggacaggatccttaatcctgcgcgtctgccaattccgccatggccgcaaaaaaccttactagataataatagcaaaaccaccattagctagcaagtgttttttataaaaatatttttattagtgttttaaccccaagcgacccccgcaacgtccacaaacgtagcgtcgcacgttgatgcggcgttgacgatggtaaagctgaccacattttttacactggtatactaatcgccccgatgtagtagtccggcgcttagacgtcaccggtgcgtagcgtaaaccaccggtccgctgcagcaactccttaaaatgcgggttgcggtgatctggtttttcatgatgcacgtgcaaccagtagtggactagttcgtgtttaattacgcctactaaggtttcttcgtcaaactcgcttagcataagcgggttgatttcaatgtgatggtcccttaaaaaatagcgaccgcccgtcgttcttaagcggcggttaaaccgcgcttcgtaaggataagtttggttaaagaattgtttagccagtcgacgcgttaactgagttagctctaagtcagtcattgttcctcagccggaatcatggtgagctggatccgatttcgcttggtatccacgctttccacccaaacggtaacgatgtcccccaccgccactacgtcactaggatgtttgacaaagcctttttttagcttagaaatgtgtaccaaaccgtcttgtttaacgccgatatcgacaaacgcgccaaaatcgatgacgttccggacggtgccttgcagttgcattcctggttggaggtcctctaaagttaagacgtcggagcgtaataatggtgcaggcatttcatcccgcaaatcccgccccggtttttgcaattcttcgagaatgtcgtgaagcgtttcttctccgacctgcagctgagctgccaattgtgcgaccttaacctgttgcaacgtttggttaaaagcgggggttcctaagtcatgcaggtttaatcccagctccttcattagggctttaaccaccgggtaactttctggatgaattcccgtattatcaagctcatcgtctccatccacaattcgtaaaaatccaatcgactgttcgtatgctttaggtcctagtcgcggcactgatttaattgcttggcgagttcggtagcttccgttggcttcccgaaacttaacgatgttttgcgccgtcgttttagttagccccgaaatgtgggtcagtagctctggactggcggtatttaaattgacccccacctggttaaccgcggtttccaccacgtggtccaactgttcccgcaaatctttttgggcaacgtcgtgttggtattggccgactcccaccgcttggggatcgattttgatcaactctgctaacggatcttgtaaacgccggccaatgctaattgcgctgcgctcttccacttgtaaatcaggaaacgctgcacgagcagccggactagctgagtatacggaagctccggcctcgttgacgattacgtagtaaactggtcgcgcaattgttttgatgacttgagccacaaattcttcggattcccggctagcggtcccgtttccaatcgcaatcatttccacatggtatttttcaatgaagtcctttaattgcttagcagccgcggctcgcttggcttgaggagccggacggtgcggataaatcaccagtttatctaagaacttcccgttttcatcaattacggctagtttacaaccggtacggtaagcagggtcaaacccgaggaccactttgcctttgagcggtgcttgcatcagcaaatggtataaattttctccaaaaactttaattgcgcgttgctccgccatggaagtcaattccgcacgcatttctcgttcaattgctggcccaataaaccgtttataggcgtcccgataggctgcttgtaccagcgccaccgccgggccccgatgcttttgtaccaaacgaaagtttaaatagcgctcaatgcccgcttcttccaccgcaaccttagcccggaggaccttttccttttctccccggttaattgccaacacttggtgagctgctaactgagcaagtggcacttggaaatcatagtaaatcgcgtaaacgccgtcttcatctagttccttgccctgccgtttaacttcgctaactagcgcgccattatgctgggtgtatttacgaatccacgcccggatttccgcctgttcgccaaaggcttcggccaaaatttcgtgaaccccggactctacgtcttcgatagtatttaacttcgcttcgggattaacggcagccgccaagcgttctcgtagtccttgttgggggaaagttaaaacccacgccgctaacggttctagtcccgcttctttggcaatcgtcgcttttgtgcgccgcttttgcttgtacggcaaatataaatcttccaccgcagttaaggtggttgcctgcttgatttgctgttttaatccagtagttaatttgccttgttcttcaatctgctttaaaacttccgtcttccgcttttctaacgtttccgtttggtggtacgccgcctggatttcgcgaatttgtacttcgtcaagactgtgggtgcgttccttacggtagcgtgcaatgaacggcaccgtatttccctcatcgagcatctccaacgtcgcgcgaatttgttgcggtcggtaagcggtcaattgtttttccactaaagctaaaatctctgcttccaaatttaaaccccactttgttaaaactttttgtacaagataagaggccaggaaatttttcccagcctccttttaaacctcttcgattccactaactaaatggtcagcgtgagaagtaatgatctatcccatcaaactgctcataattttagtcaacgctttggtcatttggcccattgcagcttcctgggcatgttcggactcttgaaaggctacctcatccagctttttggtttggtcatctactgcatcaaccattttttggcattgattagcatattcccttaggtaacgtttcaataactgatgtttaccaattaatttagctggcactttagcattccagaccatcttttctagcgcccggtactggtcggttgccacttgaaattgttttttaatttcttttaaccggctttgatccatttcgtccaccgtacctaattgacccgccttctttaattcttgaaagaacggatccacgctagaaccaatttcttctaatttctcagtcaatcttgaaatggtgttcgcgtacgcttgaatacttaccttcatcttaatttcctcgtgatttctttaaagttcgttgaattaattttaccacttctacgattacaatcatcgataaagatgctccaattacgattaaccactggtgtaagtttaggtggctaacgtggaaaaggtcgttaaagcccggcaccacaatcgtaattgctaataaagcaaacgcgatgaggatcgcccaattaaagaatttatttttccaagtggttgcttggaaaattgatccgtgaatcgacttcgaattaaaggcgtggaaaagctggattaaacctaacgttgcaaaggccatggttaaggcatcggcatgaatctgtgcgctcccggaatggtcagggaaagctaacgccattgcgtaaacaaatagggtgatggccccttccaaaattccctggtagattacgttacccgcgacgcctcccgataagaagctagattttttatcacgtggtggctgttgcatcacgtttttttctgcaggttcaagtcccaaggcaatggcaggcaaagtgtcggtcaccaagtttatccacaggatgtgcaccggtgccaaaatttgccagcccatcatcgtcatcacgaaaagggttaaaacttccccaaggttagctgataagaggtactgaatcgccttttgaatgttggcaaatactttacgtccttcttcaaccgcgtccacgatggtagcaaagttatcgtcggccagcaccatgtcactagcacccttagaaacttcggttccggtaattcccattgccactccaatatccgcttgttttaaggagggggcgtcatttacaccgtccccggtcatcgccaccactttccccttcttttgccaagcgtcgacaatccggaccttatgttcaggagcaacccgggcgtaaactcggtaatttgctacgtgatccgctagttgttcatcagtttgctgatcgagttctgcaccagtcaccaccgccgtgtccacttcggcatcggtaatcatccctagtcgtttagcaattgctcccgcagtatcgcggtggtcaccagtaatcatcagggtttgaatacccgcgtcgtgggcttcttgaatggcttgtgccacttcgggccgttccgggtcaatcatccccactaatcccgcaaaaatcaagtcgttttccactaccgaactagtcagctcttcaggaaccgcatcaacgatccggtacgcaaagcccagcactcggattgcttgcaacgctaaatcatggttcacggcctgaatccgacgctcttcagcctcgtccattggcaattcggcacctggcattacgtacttggtggttcgtttcaaaagttcatctggtgctcccttaacggtaatcaaatacttcccgtccggtaacgcattgaccgtggacattagctttcgttccgaatcaaacggtacttcagcgacccgttggtactggtcaattaccgcagcactagagtatccccgttggtcattaaacgcaatcaaggccgtttcggtaggatcccccaccaactcctcgtcaatttttttcgtgtcgttgtttaaaatcatcaggtcaaataacttggattgaaaatcaggagtgaccgctgcggcatccattagctggttatccacaaaaagtttttcaaccgtcattttattttgggtaagggttcccgttttatccgaagcaatgatttgcgtactccctaaggtttccaccgccgggagttttcgaataattgcatgccgtttaaccatccgctgggttcccaaggctagggtaatcgtaacgattgccggtaaaccttccgggatggccgccaccgcaagcgaaattgcggttaacaacatgtcgattaagctttcttggccccgtaacataccgaccgcaaacaccaccaccgcaatggccaaaattaaccaagttaacgttttacttagcttggttaaattacgttgtaaaggagtaatggtttcatcagcgtcgttaattaaccgggcaattttccctacttcggtcgccattcccgtatgaatgacaattccctttccgcggccaaaagtaacgttactattcataaaggcgaggttggtgcggtcgcctaagggaagctgttcgtcatctagggccgccgtttgtttattcaccggaaccgattcccccgttagcgccgactcctcaatttgcatcgacgctgactctaccagccgtaaatcggccggcaccacgtctccagcttctaaaatgaccacgtctcctggcaccaactcggtactctggatttgctgaatttggccgtcccgttcgaccttggcttgcggagctgccaaactttttaatgcgtcaatagcttcttctgccttagattcctgaaaaacgccaaagattgcgtttaacaccaccaccagcaagataatcaaggcgtcgactccttcgcccacaaacactgagattaaggcggccacgagcagcacaatgatcatcaaatctttaaactgggccaaaaacttttgtaacaaagtcgttttacccttagttgctagttcattatggccatatttttccaaccgtcgttgtgcttcggcagtcgtgagcccagccaaccgggtatcttgcttagcagcggtatcttcaacggtccgctgccaatcctttaacttacttgccttcattctctttcctccatttaatttgggatcttaaaagtttaaaaaaagacccatgtgcgtcgaaaactacttctcgacacacatgagtctcactaatttaaggtaataccagattttttcttgctgatgacattaccacagctaagctgcaagttactccctcatgtttaaacacattataccggaaattaatttccctttacaagtgacgggccttgaacttaacaatttatttatcaaaaacggtatacggcaaagcacgtttatgggcggtccgttggtaccaaccttcaattttttcggccgctgcgtcgctaacttccttgccttctaggtaatcatcaatgtcttggtaagttacgcctaacgcaacctcatccggtaatgctggacgttcatcttctaagtccgccgtgggcaccttttcgtaaagctcaacgggcgcgtttaacgctttaagcattgccttaccctgccgcttgttcaagcgccatagcggaacgatgtccgcaccgccatccccgaattttgtataaaatccggtcaccgattcggccgcgtggtcggttcccaccacgattcccgcggtttcacccgcgatgccgtattgggcaatcattcgttgccgggccttaatgtttcccttgttaaaatcggatacctgaactccggttgcttcaatagcggctaccatggcatccgcggctggtttgatgtcaattcgcaccacccggtccgcttgcataaattcaattgccttcatcgcatccgattcgtcagcttggaccccgtaaggtaggcggaccgcaataaattggtaatcggcattgccagtttcttcccgaagttcccgaattgccatctgtgccaacgctccggctaaggtagaatcttgcccgccggaaatcccaaggactagcgaacgtaaactaggaacactttttaggtagcgtttcataaaatcaacgctgcgtcgaatttctttttctgggtcaattgttggttgaacccgtagagcttcaataatttcttgttgcattttgcgcatttttttacgccccccaatgattaaaatttaagctgatttacgtaatcccggacccgcttaatgatggataccttgtgatcgtaacattcttgtgaaagatccaccggatagtcttgtggatttaaatcacgtttgtattcatcccacaaagaatccaaactttgccgagaaaattctttgatttccgctaaggatgggcgatcataaactaacttgccgtccttaaaaatggtttgtaataacggtcgagcttcaaaatcggtcaccgtcttattgatgtacgtatagttggggtggaacatgtatagcgaatccttttcacgagggtcttcatcccaaagcgtaatgtaatctccttctgatttaccatctgcccgccgagaaattcgccaaacttgctttttgcctggtgtagaaactttttcagcattgttagacaatttgatggtgtcgaccatctttccgtcccgttcaatggaaaccatcttataaacggctcctaacgccggttggtcataagcggtaattaatttggttcccacaccccaaacttcaattttagctccctgcatctttaagttttggatggtcttttcgtccaaatcgttggaagcgtagattttagcgtttggataacccgcttcatccaactgttcgcgaactcgtttagacaggtaagccatgtcaccactatcgatccgtaccccaaggaaattgatccggtcgcccatttctttagccacccgaattgcgttaggcaccccgcttttgagtgtgtcaaaggtgtccaccaaaaagacacaatcgtgatgagtggttgcgtacgccttaaacgcatcgtagtcgttcatgtaatattgcaccattgcgtgagcgtgggttccgctaattggaatcccaaacttcttcccagcccgtacgttactagttgcgtcaaaaccgccgatgtaagccgcccgggttccccaaattgctgcgtcaaattcttgggcacggcgcgtgccgaattctaaaagcttgtctgagccaactacggatttaatccgcgccgccttggttgcaattaaggtttggtaattgaccacgtttaaaattgccgtttccaccagttgacaatcggccagtggtccttcgacttgtaagattggttcgttattaaaaactaggtcgccttccactgccgagcgaatggtcccccggaaatgaaaattctttaaaaattccagaaaatcatccggatagccgcccacttcgcgaagatattcgatatcactcgccgaaaagtgaaggttttcgatatagtcaattacccgttctaatccggcaaaaactgcgtatccattgtcaaaaggcattttacggaagaaaacttcaaaaattgccttttgattgtgaattcccttttgccaataagtttgaatcatgttgatttgataagcgtctgtgtgtaaagttaatgtgtcatctggatattcttgtaccatgatgattatgctcctactctttattttttaaagtataaattttactggtggacataaaatacaattgctttaattttatcatttttgcgccaaaccgcaattttatcgtgaggagaacctttatatatgaagttttcaactgccaacgtcttgggattcaattttttacaaacgaccaaggcccaattcttagaacaattacataccgacttagcggcccaccaaaaccgctttgtggtgaccgctaatccagaaattattatgtacgctaaaaaacatcccgcttacgctgaaattattcgccaagccgattatttagtggccgatgggattggcgtcgtgaaagcaacccagcataccgcccatccgctgcccgaacgcgtaaccggctacgaactttttgaagaacttttgcgttggggagacgcacaccattcgcgaatctactttttgggaagcaaaccggccgtgattgctcaagtgattgccaaagttaaccgccaatatccccacgtggaagtcgctggccatcatgatgggtattttaccgattttgctcccatccaaactgaaattgagcaaacccagccggaaatggtttttgtagccaccggcttccccaaacaagaggagttaatccaaaagtatcggcacctctctcccgcaatttggatgggtattgggggcagttttgacgtctttgctggagaagtcaaacgtgctcccgaattttggcaaaagcataacctagagtggctataccgtttaatcagcgatcctcgccggatcaaacgccaaatcgtgcttccaatctttatgattaaagcatggtgggccaaccacaaatagcgatgaacacaaaaaaacgagggttagcgttcttaaaaagaacctaatcctcgtttttatgactttggaattaagggtaaccctcttctcaattcctcaccaattatttaccgatttaaatagaattcaaaccgttctcctacgtattgcgttcgtacgtattcaaatggcgtgccatcctgggcgtatgaaacctgatgaaggcgtaaaatcgccgcaccccgcttaacgtcaaggtattcggcaaccttttcggaagctaacatcgccgatacggtttgctcagcacgaccaattaccagtcccgcacgctcttccaaagtattgtacaacgacttggttacttcggatttactaaagttagtaactaacttttctgggatggtcgccgtttcgtaacaaatcggtaccccatccgcataccggatccgttccattcggagtactaaatctccatccgctaactttaatttttcaatttcacttaacgatggctcactagtatggtaggaaattgtcttgctcgatggtttcttaccctgggcttccgtcaattccgtaaagctggttactccagaaactttttcttggaccttttgactagcaacgtacgtccccgaacccaccttacgttctaaaatcccttcatcaaccaaagttgaaatcgcttggcgtaaagtcattcggctaactttaaaatggtttgacagttcccgttcggcgggaatccgctcgccaactttccattttcctgcttcaattgcctttttgatttcattatgaatctgaatatataccggtgaattcatgattgtactcctacttgtttttaactattaatcttccttagcaaacttcttgccgtagctgtaagtttctaacttgttaaggtcgccgtcaaagacgtttaaatcagcgtccttgccaacttctaaggttcctttagaatctaagccaaattcacgagcttggtttaccgaactcatttgaacagcttccgcaattccgcaaccaaagaacttcatggcgttccggaaagcatcatcaaaggatagtactgaacctgctagcgttccgtcagctagacgagcttgcttgtcctttacgtaaactttttgtccgccaagttcactttctccttcggcaattcccttggcacgcattgagtcagtaaccaattcaatgcgttctggtcccttaacttcataagccagtttgagcatgtcaggaacgatgtggaaaccgtcgcaaattaattcagcatagatgttgtcttccaacattacgtggccggtaacccctggttcacgatgcttaaattcacgttgggcgttgtataagtgagttgcgtgggtaaccgtgctatttagcaattgtgcacgggtagcgttggaatgtcctactgaaggaacaattccatgatccaagcagtatgcttcaaatgcatcggagcctgcgtgttcaggggcaatcgtaattaattttactcgaccgcctgaaagctcgttccacttgccaagtaatgctgcgtccgggtccttaatatactcttctggttgagcacccttgtacttcgccgaaatgaagggaccttccaaatgaaccccttggataacgggattttcttccgcagccttggccactccgcgcattgatttttcaatgttttcgttggattgagtcattgtggtacaaaagaagctggtaactccttcgttgattaccgcttggtttaccatttcgttgatttgttctggatcgccatccatcgcatcaaaaccgtaaccaccgtgggtatgtacgtcaatgaaccctggaacaataatcttgccccctgcgtaataaacttcgtcgtcaccctgtgccttatattcactcattggcccaactgcttcgatggtcttaccaaaccgaatgtagccgtcttcaatcttttcgaggcccgtataaattgtcgcatgtcgtaaaactgtactcatgaattttcctcctctaagttaatctagcttcattatatatcggtatagaccaaaaaacaagattaccttaaccgttttcttttgccacggttgcgtcgattcccttaactacggatgggctaaatccggcttcttccattgctaataaacctgcgacggttgtcccgcctggagaagaaactttatcaatcaatgcgtaaggcacttcatcactattgagcaccatttgcgcactaccttgtaccatttgcgcagcaatcttagtggcgttagctttagtcaatccgtacttaacgcccgcccgggaaagcgcgtcaataaataggtaagcatatgctggtgcgctccccgcaagtgccgcgaaaatcggaaagtcattttcggcaacttccatggtttttccaatccgagcaaacaactcaactcccgcttggtacggagctgcgttaaggtcgcccgtggctttgaccgctgtcattccttgcgcaatttcaacgtttacgtttggcattactcgcaaaatcggttgagcagtgcctaaaaccgcttgtaagtccgctaaactaacgccagaagcaattgaaaccaccaacttttcttcagttagtaccggttgaatttcttcagcaacccgcttaatcaccgtgggcttaactgccaaaataattacgtctgcctgttgggctaccgccgtattatctgatactgcggttagtccgtgttgttttgcaaaagtttcgtagttttgtgggtgagcgctgtggaccaaaatatccttaccagcgacatctttctttactaatccgctaataattgccttggccatgtttccaacgccaataaatccaagtttcatttgtattcccccgcttttctgttaattattttaattttatcattaaatccccgggaattatgtaatattttatgaaggtttaatacttctcgagcaaatccaacgcccttgccaaagtatcatgatgcagttaaaaacgtgactgaaactgagaaaaaaatcattttaggggtgccggctttaataaagtccaaagccattatgctccgcacaacctaaaaacgaccgttatgccaaattcaggcataatggtcgaatttcagttaatcctcaaaaactagccgactttttcaatcagccttgatttttcatccttacggacccttaaaagctggtcttaccactgcttaatgtctatcaggcatttgggggacactcccgcatttaaagttacgtgtccatcatccttatttatgcatgtccacaaccatccgaccttcgatttgtccagcccgcatttcatcgatgatgtcgttcacttcatccaaacgccgagtttgaacaataggtttaacttggccatccgctgcaaactggaaggcttccgccaagtcattccgggtgccgactaaggaaccaattacttgaataccgtctaatacaactcgcggaattgataaatccatcgtgtctacgggtagcgctacggcaactaaaacgccacctgcttttagacaatcgaccgctgcgttaaaggctgccttagctaccgcggtcactaccgccgcctgtgctccgccgcaccgttcctgaattaccttcgccggatcttctttgctagaattgattaccaaatacgcacccagcttttgggccagcgccaatttatcatcattaatgtctaccaccgctaatttagcgttaaacacattcttagcgtactgaattgccagattacctaatccaccagcgccaaacaccgtcaaccattctccaggacgaattttagattccttgattgctttataagtagttacgccggcacaagtaattgaacttgctgccaccggatccagattgtccggcactttcaccgcgtaatccgccacgacgattgcctgttcagccatcgctccgtcaaccgtgtatccggcatttttagcttcccgacagaaagtctctcgtccagtagtacaatattcgcaatgcccgcagccttcaaagaaccaggcgatggaaacccgatctcccacctttaagctgtgcacgtcagcaccaatttcgcgaacaatgccaattccttcgtgaccaatcacccgtccaggttgttcgccaaagtcaccatttgccacgtggaggtccgtatggcataccccgcagtattctacgtcaactaaggcttcattgtccctaagcggccgtaattgcttttctacaatatcaacgtacccatcactttgattcctaactaccgctgcacgcattttaattgcctccttactacattaaaagactagttgctccaccttcattataatactaacgggtattttgtgaaagcgttttctaagatccgcaaaaaaatcaaatttacgataactacttagtcttctaattaaagaatgcttatcaactagataaccacttttacagacaatttagccataaatgaacgcacaaaaaaactccacgtcatcgacatggagtttaactgattgggctagctgggttcgaaccagcgcatcacgggatcaaaacccgttgccttaccacttggctatagcccaatatggtggaagggagtggattcgaaccaccgaacccgaaggagcggatttacagtccgccgcgtttagccagacttcgctacccttccatataagttgtcgtcttatctatccgacttaattataataactaatcttgaagaattttgcaagctttttttgaaactttttttaaatttattcaagatcaattataagtaatcgctgagtccattcagtaataaaattatccgaattccactcgttgattcgtctcttatgatatccgactgaattattataatatatcccgccagctgttgcaagaggtttatagtgaaaatgtaggtgtccggataaaataatttttggctggtattttgctaataacttttccattcggcggctccccatcatcccgttcgccatgttccaaaagcggtagtcatcagtgtagcgaatgtattcgtggcgcactgcaaaatgggtcataaaaagtactgacttagattgggctgcttgaagttgtcgttccgtttgttgcagtacgcgatccatccgttcaatgtcagagattggctgctcaatcgcagtatctacccaaaaagtttttttccaccgccaaaattgttcaggagttttatctacgttatccgcaaaactataatcataccagccgttatttccaatgatgcgccatttggttcccggaacgtcataaaattggttgtgcaggtactgcgggtgttgcagcttttctaacccagcgtaatcaatatcatttaacatatcatgatttcccgcaataaagaacaccttggtccgtggcaagcggcgctgtaatttttccacgtattccttactacggttgaacttattaaataagtctcccgcaattaaataaattcccacgtgattgtctttaaggtattgtgcttgcgttgccaacgtttgctcaatatcaaccttattaatgtccaaatgattgtcactagtcattgctactctcaaaacgttcgcccctactcgtttgacttatcctaaataaaaaagatgaactaagcataacctagttcatcttgtaaattcaaattttattaacgaatcccttgcatcttcttgctgatccatggtgaaagtaaccataaagcaaccgcaaagataatcgtaatgattccggtccaaatgaagtagctaacttcgtgaccaggataaagtttaaccagctgtgcgttaatcgcttgtccagcggcatctgccaagaaccacatactcatcatttgtgaagcaaacgctgcgggagctaatttggtagttacggataatccaattggtgaaatcaacatttccccaatttcaacgattgcccagctacccactagccaaagggcgttaacttttccatcagtaccaaacatcaagcctggtaacgcgatgaagagatatgaaatcccggtaaatactaacccataggtaaacttcttcggtgacgaaggttgttttttacctaatttagtccatagccaagcaaagatcggggtgtataacatgatgaacaacgggttcaacgattggaagttagctggcgtgatgttaatccatccataatgtaattgggtacgatctgcagcaaataatgccaatacaactgaaccttgttcttcaattgcccagaataaggttgcggcgataaagagtggtacataagcccacaaacgggaacgttcacctttagaaaccttgttgctagtgaacattaaaataaagtaaaccactggcgtaataatagccacaatactaattaataaaacaacgttatcgattgtaagcacgttggcaatgaacattaccaacaagattaaggcgagcactaccacgccgataagtacgcgtaagctaaacttcttaacttcttcgggttgaattggatctgaaggatagaggctatccttatttaagtattttttaccatcaagataatattgcaccagtccgaagaacattccaattgcagccaacgagaagcctgcgtggaagctgatttggaaaccaacccacgaaacaattagcggagccagcaacgcgcccaaattaataccaaaaacgaaaatactaaaacctgcgtcccgtctggtatcctctacagagtaaagcgaaccgaccatttcagaaacgttgggtttcaacatccctgtaccgataacgattagcgcaattgacacaagtaatgccgcgctaccgaatggcaatgaaagagcaatgtgcccaaacatgattaaaaccccgccatagaaaacggtcttccgactacctaaaatacgatcactgataaaaccaccagcgacactagctaaataaactaacgacccataaatggccataactgaagcagcagtagcttggctaaaacctagtccaccttgtgaaactgcgtaatacatgtaataaattaatatcgcacgcatcccgtagtaactgaaccgttcccacatttctgtgaagaacagggtcatcaaaccacgcggttgaccaagaaaagctgtatctttttcttgtgtattcaatttttatttcctccataattctcgcctaatcaaaataacacttaaggctataaacttgggactatatatgaaaaaaacgccttaactttaacattaaagcgtattccataatgccggctaggtgagtcgaacacctgacctacggtttacgataccgccgctctaccaactgagctaagccggcattggcttggctttatagcataaaaggatgctaacaactcggttaacatccttaaagctaaatttggcgttcccagcctctatttttgtaatatgggtgtggatctgttggggtgcgagatagtcgagacgtgttccagccctcagagttctgcggataaccagattaggtccttaaccgcatgacccaaagttagaggagcgtgttctactgtgagatagccgaaacgtgcactaagcccccaactctctgcggttaaccaaattaattcatcaatcgctaaacccacgattaatgaattaattccgttaatcctcaagagctgaccgggggcttggtgcactctgatttaataattcgccacttccaccacatttccgtctgggtcctttatcaacagcgactggacctttccgtgagttccctggcgttgctttggttcatcgacaatttccacaaagtagctctttaagtggttgacaatttcgttcatcggatttttggcaaccagtgacaacgcaatgcttccggaggttggttgcgctggagcaattgccggctgggtctccttagttgtaaaatagattcgctgcttccccgcacgcacgcctggatacggagcgtcggttaggatcggcatatcaaaaacctcgtggtaaaaacgttcactacgagcaacgtctgccacggttagggtaatatgatcaatttctcgaatattcataatctataaatcctccttgtaacctgtacaagtatagcataggtaaattcaattgacgttttgtggtaattcatgctacggtggttactagttattttaaaaagacagggtgaaaaaaatgagtttgctatcagttgaacatctgagccacggttttgcggacaaagaactgtatgaagatgcaagtttcgaactgaataaagaagatcacatgggaattgtcgggcaaaatggtgctggtaaaagtacgctaattaagattttgactggcgaaactttaccagataagggccggattgtttggcaaaataaggtcacttatggttatttagaccagtatgcggatattccgcaaaatgacacgctgtacgaatttttaaccactgcgtacgcagatttgtttaagcaacgtgatttaatggaaaaatactacgccgaatacgccgaaaatttggatgataagttgttggaaaaggcgggccgaatccaagaaaatctggacgctaacaatttttacgaaatcgataccgaaattaaccgggtaatgaccggtttaggacttgatgatatcggtaaggatcacattgtcagcgagatgagtgggggccagcgttccaaaatcattttggcaaagctcctactacaagatcctgacgtattgatcctagacgaaccgaccaactatttggataccgcgcacattaattggttggcagactaccttaacggcttcgagggagctttcatggtagtttctcacgactatgagtttttgcaaaaggttaccaattgtatttgtgacgtttcatttaacaaaattactaagtaccggggcgatttccaatccgcaatgcggcaaaaggaagcgcggcaagaagcacaattaaaggcttacgaaaagcaacaagtagtcattgaaaaggcggaaaactttatccgcaagaataaggctggtcaacgttcaacaatggcgaaatcccgggaaaagatgcttaatcggatggacaagatcgatccgcctagtgaaaacttgaagggacatttcgattttccttacctagatacgggctcacaaaacgccgtggcggttaataagctagccgttggttatggtaaaaagcagcttttggaaccagtgacgttctccatggtggcgggcgaaaaggtggccttttctgggtttaacggagccggaaagtcgacgttaattaagagtatcttaggcttgattccggctttaggtggggaagctcatttctcaccatcggctaaggtgaactattttagccaagaattagtttgggataaccccgacctaacaccattacaaacgattcaagaaaaatatccgaccatgttaccaaaaacgattcggactaagttagccaagtgcgggattaacgcggcggacactcaaaagcccatgcaccaactaagtggtggtgagcagactaaggttaagctagccttgatggaattgattgaatctaacttcttgatcatggacgaacccaccaaccaccttgatgacgaaaccaagcaagccctaagtgaagcgttgcaacgctttaaaggaaacttaatcgtggtatctcacgaaagtagtttttataacggctggattgataaagtaatcaacgtggaaaaattacgtttggatcgctaaaacttaattacaatcaaaagggttgtgtcaaaagactttaaacaaaaaacggttcatgaggtgaaacttcctcatgaatcgtttttattttggcgttttgatttcaatagagccaaaacgtgtgccaaaagtcagtttgttccgcttaaccaaaaattgcccatcatgccaaaatcaggcataatgggcaattttcagttaatgctcgcaaactacccgacttttgtcccactctctttgtttagcgattagtaatattaattagaacgttgctgtatcgggatcggttggggcacctgcttggccgtggaaaccatcaatggttttcatgtcgtcagcagatagttcgaagtcgaatacttcggtattttgttgaattcgatccgcgtggacagactttggtaatggcaagaagccgtgttgcaatgaccaacgaataactacttgggccaccgacttgtggtacttttcagcaatttctttaagttctggaatgctgaagattttaccagttcctagtgggctgtaagcttcggagaggataccatgttctttgttataagcaaccacttcgtcttcagtatcgctaggattgaggaaaatttggttaactgcaggagttaccttagcagtcttcaacaattcgtctaggtgatgaggccggaagttggaaaccccaattgcccgcactttgccggcttctagggcttcttccattgcccgccaagattctgcgttcttttgttgccattcgtcacggaatttaacgggatttggccagtgaattaagtagaggtcgaggtagtctaaaccaagtttttgcaaacttaaatcaagggcttttttcgttgcttcgtaaccgtggtcttcgttccatagcttagaggtgacaaagaggtcttcgcgagctacgccactgtctttaatggcttttcccacgctttcttcgttaccgtaagctgcggcagtatcgatatgacggtatccagcatctagggcagccttaactgcttggtatgcttcttcaccatctttagattgccaagttccaaaaccgattacgggaatcttaaccccgttatttaaagtataggtatcggtgagtttattcatgagaaattcctcctttatttaaccttacttactatatgatagcttttttctttagcaataaccagccataagcccgaaaatttgtcaggcgttttgtaaagaaaagggtggccgagataaaaaaataggggctaggagcaatcctaacctctattttgaaatctattatttattaaaagtgcctgcttctacttcgcgaaggtaatcagcaagatgcttgaagtaaacgggggcgttgtcgatcatgtggtggtgaccgccatctggagtagtaactaacttagcgttagggattacttcagccatccgttgtgccgacttcaacggcatggtttcgtgttcgccgaaggtcaacaaggttgggaccttgatgttatggatttggtcgcgaacgtcccattccttcaacttaccagtaacaacgaattcgttgtcgccttggaaagcattgtaaacgggagttgccatagttggaaccaagtgacggattgccactggttgtttacgatctacgtaaccagcgttaagtacgtcgactagtttttggtaacgttcgttatcccaatctccagacttttcacagtcacgcatgaactgagcatcttcgggagcaagggcttcgtctcgaattgcgtcttgatgttcgaggtattcatcgatattatcaaccatggaagagatgatggcaccctttaagtgttcaccatacttcaatgcgtacatcatggtcaatgcgccaccccaagattgaccgatcaagtagaagtggtcaatgccgagtttttgacgaacttcttccacttcgtcaaggaagtagtcgtagctgaggtacttttcagcaatttcagggtcggagtagtcgggttggtcagaataccacgaacccaattggtcgtagtagtgaacttgaacgtccaaaccttgttttaaaagttcatcgtggaagttttcccagtattcgtgattgcccccgggaccaccatgaagggccaaaaggtggatggagtcgttagtcccatccgtatgtgaccataagtgatatccgttatctagtgttaaaattgttgtaccttgtttcaagatatttcacctagtttcttaaatttaagcctataatagcagatttattagaaagtgaccagattaaatgagaagcgtttaggcgtaaagttccgcggaaatactggtataaccgacttagtgcttaaattaaaaaattagaaaaaattaattattttctgcagttgatcaaggagtaattttaatgcaaattaatgtcgcacgactacaaaatgaatttccggatgaaaaaattgaatattttgaccaagttggctctactaatgacgtagcttttacgcgcgtgcaacaaaatcctggaatagcggggatggtagttgccaatcaacaaacggctggacgagggactaaccagcgccagttttattcaccgaattcggggatttactgttcgatttaccttcctctagccccagccaccgttttacatcccggacgggtaacggcaaacgtgggcgtgattgttgccgaagcggtgcaccgcgtttttggacaaccgcttggtattaaatgggtgaacgatttatatttacatgatcaaaaggtgggcggcattctgtgcgaagccgtgtctaatgatgataatcaactaatcgggctggtgctgggaatggggttgaacattttaaccacgacctttccccaagcgatgttgcggacgggagggccaattgccgaacaagcaaacgcaacgcaagtaaccgacttgttgattaagatcaaccaagctatccaaaaaaagcgccagacgctggcgtctgacgcaattaatccaaagtatttagatttatcgattttacaagaccaatgggtgatcattgatcaggccgcaagtcggcttaccggaaaagtaacggggatcacacccgaaaatgaactacttgtcaacgatggtcatcaagtgcgaaccgttacgaatggtcggatattacgttggcaagccgaacctttaaatgactttgattaagctgcaatgaatattgcaaatcctggttgccccggatggtggtttcaaaatcagttgcgtaaattaccaatcctaattggtgacctgcaggaaggtgatagaacgtcggctgtaactgtaaagttacgtcgtagaattggttaggcacgaccttatcaacgcggtagttgttagtccgattttgcaaattaatgtggcccttactaatcattttccacggggtgatgctcttttgttgcgtaaattcccgtaagtcgtcggtgcgccaatcgtaactgccacttaacgagcgaggttggatgaggcttggggtgacgtttaagcgccgggcatcgccaaagtcaactagttgaaaactaagcattccaaatggtttattaaccgccacgttaaccttaacttccgcagccccatcaatataccaatcgtgatcgagttgggcagacttgaagattaaccggttatcacgcatctggtttttaccattggtggcgtgttccgtgttaagcaggtcggtatgccactgcgtaaggttatttttgtacatttcaaaaactgctggatcgaggacgtctttaaacgaggcggcctcgtttttagttggcaaagcagcatccaccagtgttttggcttggagggtgaattcccgtacttcatcatcagcatcctgccaatcagggtaggtatgccacgtttcgggttctacgttatcttgaatgatgacgtttggtaaaacttctggagcgttattttccacgccgaacaacttgtaacttagccataagttcatcatgtcggtaaagtcaatcgaacggaaattattaatgtaaatgtgctgaccttggtgaagaataatcttcttgttaattggcaagtcacggaccgcgttccacaagttagcgacgttacggggcttgacgttccaatcgttcaaaccgtgcactaaaattagatcggccttaatatttttggcttggttgagatagttgcggctgtcccagtagcgagaatagttgccgctttgccggtcttggtcgtggttaatccggtttaaaacttggtcaaatttactacgaacttttaaagcatccccaaggtctttttgtcgactaaagacttcggcagcgaggacgtccatgtcttcaccctggaaggtgtccggggcggcaactaaaccgccatcccgataataatcgtaccaactggaaatggccgcttccgaaataatggtttcaagaccttcgaccccggtagtagctgctgcagtggctaacgtacctaagtaggaacgtccggtcatggcaattttatggttactccagttggccttgatttcaatgttatcggttttgttagtaaacgcgcgacgattccccgcgagccattcaataattgccgtggtggaaatggtttccgccaccgaaccagtatcccgcaaaccttctgaatcccgggttccgattccggccgcataaactaccgcaaacccacgggttaggaagtagttatttaaggtgtagggttgttcgcgggcaaagtgttcgcaagcgtgttcagcttgacccttaacttgtcgttcgggtggtagttctgggtcatacggtttagccgtcacgtcttcgcgagtaaggtggttaactggtttttcagttaacgggacgtcgacattatgggttacttgttcaccccaatgatcgttagttccttggttataggggctggcagtatacaaaacgggggccttgtatccttgttcagtttgggcaggacgtaaaatttctgcttttaacaggtcgcgtttgccatcgtgatcagtatctaagggagcttctacgtaaacgacttctcgaatgatttgatgcggatcaaagacggcttgggcctttccattgaagaataacggggcggttgtggtcgcgtagaacggggtgaagtagccttgttgagtaaggtgatcaaggtaagtttccccatttttcgtgtgtgccgtcaagattgaataccaagcgtgtgccacgtctgcgctagtttcaagagcgtcaagggcaaggcgcggtaagttgattttagcagttgcagcctgcgggtcaataacggaaaaatcaattcctgattcaaattgtaatagctgtaaggcaattaaataaaaaatatccaaggttagcggctctgtgctcgcaaaaaagtctgctgcagtttggttaggcgtcgcaagtaggttgcctaacttttgttgaaacgtggactcttgattactgattaaaaaagaacgccggagaaaatcctcaaattgtgccttaggatcggcaatcaggtcctggtcaataaaatgaattgctttcaattcggtaatttcttcatcttggtcaacgtcaatgcgaccaaattggttgtttttcataaaaaatcctccacagtggtttatggttcatattatacgcctaaagcatacgaacatttaccgccatggaaggatttttaagtttaattactatttacgtagttgtttaattcgttgagataaatttctttttgttgatcgctgatccaagagctttcaaatgaatttctagctaattggataatttgtggtttagttaatttgaattggctagcaatcgcggtgtagttgtcactgatgtagccaccaaaataggcaggatcgtcagagtgaattgaaactttgacgttttttgataggagttctaaaacctcttgacccttgatttctggagatacgaaagaattagaaagcggacacgaagttagaccgattcctcgtttagcaaccaaatcaaccagatcggggtcttcaacgatgttggtaccgtggtcgatgcgttcaacttccataatttcaagtgcttgacgaatatgctcaatggaatctttttggtcgatgtcgcagtgaacggtgcgatgtaaaccggcagcagctgcatcttcaaactggcgtgcaaattttaatggtggattattgtgttcgtctgaatctaagccgattccaataatcttatcttgatatttcaaagcttccgctaaagtttttcgtgcggattctttagagaaatcacgcaggaaacacataattaatccggcatcgatatttagggcccgcgcgtcaaccgttgcccgatataatccgttgattacggtcgcaaaactaatcccgcgactagtgtgcgcttggggatcaaaaaagatttcaacgtggcggacgttattttgggcggcacgttttaagtaatcaaaagctaagtcataaaagtccgcttccgtttgtaagacgttcattgcggggtagtaaacggctaaaaacgaagccaaatcatcgtattggtaggtcttttgaacctcttcgatcgtattttgtccgatatccacgtggtttcgtttggctaattttaacttcaactgaggttcgagggttccttcgatatgtaagtgtagttcagctttggggagtccctgaataaactccttggttattttatccataatctgtttcctttctggtaggtagttcgtcattatggccttgtgagggttattttagcattttttgagttattattaaagctaaatacgaatattaatgattgtaaatcgaaataaagtatggaataattagtgaagaaagctaaaaaatatttggaggacggtacttaccatgcaaaaggcgaacgatcaaattttggcggatgacaatatgttagaaaaagtatttcatttaagcggtcatggaaccacgattaagagggaaatgttagcaggcttaacaacgtttgtttcaatggcctacattttgtttgttaatcctagtattttgggagcagcaggaatggataagggagcggtctttacggcaactgctttatcagcaattctaggaagtgcgttaatggcatttttagcaaattatccaattgctgtagcgcctgggttaggcgacaacgctttctttactttctcagtagttttgggaatgggaatttcttggcaaaaagcaatggcgggtgtatttgtcgcttcggttctttttaccatcctttcgtttcttaaagttcgggaagtggtaattaatgcaattccaaaagatttgaaactagcaatggcggcgggaatcggtattttcatcgcttttgttggtctccaaggtggcggactagttaccgctagcaaaacttcgttggttgaaattggctctttaaccgttccaaccacttggctaacaatctttggaatctttgtgattgccattttaatggcaaaaagggtgccgggctccatttttatcggtttagtgtcgaccgctttgttaggattgatcactgggctaatcaaaatgccggcgagcatcatctctcttgcaccaagtatgaagccaacttttggggtcggagtttatcatctatcttcaatgatggaccctcaaatgtgggcggtagttttaatcttcctgttagtcgccttctttgataccgcaggaaccttgattgggttagcgcaacaagctggaattatgaaggataataaaatgcctagaattgggcaagcattagtagcggattcggtttcaatgttagctggatcagtaatgggaacgacacctaccgcagcttacgtagagtcttcagcaggaattgcggttggaggaaagacggggttaacttctttaacagttgcggtattgtttgggtttagtatgctattttcgccgctcctaaccgtagttactaaccaagttactgcaccagcactaattgtggtgggggtattaatggcgtcagcattacgtgaaattgaatgggataaatttgaaattgcaatgccagccttcttaaccgtgattggtatgccattaacgtataacatctcgtacggaattgcctttggtttcctaacctatcccatcctcatggtggctgctgggcggcgaaaagaaattaactacattatgtgggcaatgctagtgatctttattgtattgctatacattttaaatattgtacctaaagcctaagcagacgggagcggacatggatactacgacggagttagaaaaatatattgatgcaggggcagctgaaattccagcagacctagttattgaaaatggtacgttaattaatgtggatacggccgaatattatcgtgcagacgtagcaatctacaagggtagaattgtggcagttgataaagacgtctcggactatgtcggaaagcacacccggcacgtagatgcgaccgaccaatatctagcccctggtttgattgacggacatattcacgttgaatgcagcaaaatgtcaatgacgcgctttgctcaagcagtggtgtccaaaggaacgactagcattgtctctggattggatgaatatatttcagtgattggattagccgggctagacgaaatttttgcggaaattgatcagcttcccctaaaagttttctggggggttccttataaaacaccgtacacaatcccgcagtcaacggtagcttataatgtcagcgcgcaagatcaccaaaagtttcaacctcaagagcgtagttacggtgtttgggaaaccgtccgagaagcggtccaaaccaaagataaagataccttgtcagctgttttaacggcacaaaaattgcataagccgatttttggctgttctccgatggccaaggggaaagatctaaatcaattcttaatgactagggtgcgagtcgatcatgaaagttattctcacgaagaatttttagaaaaagcccggaaaggaatccatacgataattcgggaatcttcggttaccaaatttttaaccgaaaacgttaaagccattacggaaggtgctccgggtgtagcccgccacactagtttttgtacggacgacgtaacggcgcgtgatattttggaaaaagggcatgttgatcatctagttcggttagcgattaaggcaggaatttcgcccatgaccgccattcagatggcaactttaaacagtgccgaagcgtaccatattgacgaccaagtgggttcgattgcgcctggcaaggaagcggatattttgctaattgaccagccaggaacctttaagattgaaacggtgatcagtaagggcgtggtggtagttgaacgacaagcggaacagttggaatttgtgccaccaaaaagatctgtagagattacaaattcggttaaatgtgcggaaataacggctgagagttttaaataccaagttgatcagccaacgggaatggcgacggtccgaagcatcaagagcgtggggccgtttgtccgtaaatcgagaaaagttgatttaaaaattaaggacagatgcatccttcccgatgccaaacgggacgtcgcgttagtgtccgtgattgaaagatatgggattaaccaccaacaatctcggggattcatctcgggatggggattgcagtccggagcaatagctacttctgcttcgccagatgataataacattgtcgtggcggggatggatgaagcggatatggcgttagcagtcaacgaattagttaaacatggcggaggacaagtcgtggttaataagggcgaagtgctcgccttgttggaattgccggttgctggaatagtaactgatttgcagccaaacgaattagctcgaaaagaagtagagttaaaaaatgctgctaatcaattaggatgtaaacttccggatccattattttacctgtccttcttgccaatcacggccatcccagatttagcaattacggatggcggaaacgttgattacacgaaattagaatactttgatcctattcttgaccttacaaagtagcaaataaaaattggagcccctagataaatttccagaggctccaatttttttatacgtaaattatttttttagaatcaagcaaaggtaattaaggttcataaattgactggagattggtgaataatttttattcagccagtttactatgccgcatcccatagctaaagtaaatgattaagccgattgcaaaccagattgccgaaccaatccaagtttctaaggaaagggtcgaaatcaagtaaacacaggcgataactgaaatgatcggaatcactggataaccaggtaccttaaagccgttccccgggatgtcggtgcggcgacgaagggggattacccctaacgagattagtccgaaggcaaacagggttcccatgtttactaggttggtaagttgatcaaggggtacgaatccgccaagtaacgcgataaaaatcgtaacgacgatcaaagcgtttttgggtgaacggtgcggcccttctagttggcctaacaagcgcggcaggagtccgtcccgcccggttgcgtaaactaaacgagaactaccgtaaatcatggaaatcatcatggtagtcatccctgctagggcacccacggataacaatcccgcaatccagttctggtgaactaattgtaaagcaaaggatacggggtttgccacgttaagctcgttataaggcaccatcccagttagtaccactgccaccgccacgtaaaagatggtggcaacgatcagcgtaccgataattccaataggcatgttcttagccggattttttacttccgctgcagatgctgaaacggtgtcgaagcctaaataagcaaagaagacggtggatgcgccagctaaggttccatgaatcccaaatggaaagtatggttgccagttgctgggcttaacgtaaaaaatacccacgccgataaaaattaaaataattgcaattttaacgaaaaccattaagttgttaatgcggattgaagacttaaaaccacggtttaatagaaagccaattaaaagcacaatgattaccgcaaacaaattaatataagtcccatgctggggatcaaatggcccggcaattgctgcagggaggtggccgccaaatcccttaactaaggaaccaaagtaagcagaccacccggtggaaaccgccgcgacggccagtacgtactctagaattaacgcccaacctaataaccagccgagcagttccccgtaaataatggttccgtaggagtaggcgctgcccgccacgggaatcgaggcggcaaactctgcgtaacacattcctgctagagcacaaaccaaggcggcaatcacaaatgataaggtgattgagggaccagcttttagcgccgccacggtgccagggagaatgaaaattccggtaccgattactgccccgattccgagggctaagaggtctttagcgcccagcgttttttcaaattgagaatctaccttcagataattagctagtgattctttacgaaaaatattatgttttagttgcatacgccacttcctctctaatgtttttctaataatacgggatgaagttaatactgtcaacgaaaatcaagaaatctacctagattaaatttgctaaactagtgcaattagagactggtataattaaaaaagtaagcaaaaaacggaggaatgacgatggctttagaattggatggcggagcagtagtttaccaaatgcgggcaaaagagccgtattacttattgctaaaaagcgctacgagcgttttttggggattccctaaaggacatttagaaaatacggaatcggctcttgaagccgccgagcgggagattagggaggagaccgggattatcgctacggtcgacgatcgtttttacgacgttttaaattatcgagttggcgaaaacgacaagaaagtgaccctatttacggcaaaggttcctgaagatacggtagttcgattgcagaaggaagaaattagcatggcggcgtggcttgattacgcagctgctagaaagcggctaacctacctaaacttaaagcaggcgttagataacgcggaccaatatattcggaaagcagaacaatagtaataaaaattgggcgcgcgcaaagcaaacaaaaaagaggccatgacatcgcgggtcatggcctccttacttgcatttgataaagctttttaagagttaagttatgctaacttgctgaatgaattttcttcgaggctttgaagattttgaattgcttcttcaatcgttacgcctgtagcttgaaactctggttgggctttatcattagcgataaaaacctgcttttcagtatcaagtgcgatactgtaccaagctgtgctgtactttttaaattgcataatgataaacctcctaaatcatgaattttagaagcgggaaaagcgcttccaattgatacgataccttaatttacaacattttaaacaaaaatgcaaatatttaagcttggagtaagggaaatgaataagattattgtaatagcggggcctacgggttcggggaaaaccacagtagcagactatcttaaccaacgttatggcgttgtgaaggtgatcacgcacaccacccgcccccaaaggactaatgaaaagcaaggggtggactattattttgaaacggcggattcgttcgaccaaaatcattatttggaacaagttcagtacgctcactaccggtacggctcttcctacgaagggctcacccaggcgtggcaaaagaacccgattgcttgcattgtgttagacacggccggggcaattacttaccagcaaaaattgggtgaccaagtggaaattttgtttttgcgggtgcaaaaagaagctacgctaaaacaaaggctgttgaagcgtggggatagtatggattcaatcactaaaagaattaacagccctgagtatcgccgagatatggaattgccaagtgaactacaaggaaaggcaaccgtgattgataacgacgattggcaggctactaagcaaaaacttgacgcattttatttgcaggtcaaaaagcaaactttggacgtttaaatgcgcccctaaatatgttaatgtaaagcgtaataattactatttacgaggtggcaaactgtggataaaagcccaattgcaattgcggttaaaattttaaaagcgaacggctataaaattacgcgtcagcggcagagtttattagagttgcttgcgcaaagcggtgatcggtatttggaattaaccgaattagaccgcttgatgcggctacaatttcctaagatgagtcataacacgatttaccgaaacgttaaggaatttgcggcactaggaattgtggaagaaaatcaaaacgaaaatgacggaaaaacagaagtaaaactggactgtaacgagcagcatgcacatcaccatcactttatttgcaaccagtgtggaaaagtacaggaattaaaaatgtgtccgttgagtttttttagtgaccagttaccgggtgctgagattaccggacaccattttgagttatatgggatctgtgctgagtgtgcaaaaaaagttcacgcatagtatggataagttaaatgttaactttatcagataaaatattaaagttattgcaaacttgggggagttttgcttacctgagcgcgtttttttggtatgctaacgtttggaaatatggagggagatagaatggcatacagaacaccaccttttttaacgccgattgccatcgtgacgatgataattgcgctaagtgcgacaaacgtaattgttaataaagctaccaacacttctgaaggagcgccggtgcgttcttcaaaagtagttgaaagcagtgaaccagaaaagaaaccttcaagcgacgatgaacattctaaagataaatcggaagagtcgtcatcgagttctgaagaaagcagcaagccgagtgaagatacttcaagcagtggggaaacttcacaaccaactgatgatcaaactcaagacaattcttcttcgacaacgactaaggattcgactggcaatgataaggcctctagtggggcaaatgatgaggaccagaccacgacggatagttccggagatgcaagttcaggatcgggagctgctgcatcgcaaggacaagcaagttcgcagcaggatactaaccaacaggctgccgtccaaaaggccacgaccactgatactaatacaggtcaataaggggggataaacgtgatttcatttctaacattagtaagtcattacatgggcatgattagtgttaagagtaagttgaagaaccaaatttacaccatcacagcctttgtagggaattggtatttgttatacattgggattcgctttatccaaaatggcgcatatacaagaggattactgctattagcaattttcttgatcttcttgtatttctcaattatgaacatttattactatttcactaataagcaggctccgtttgatatttctccaattttagaaaaatacattgggggtacgccagaagaagtgcgggaaaaagaagaattccggcgccgcctttcgcgggtagaacgacaaagccgccaagttgctagtccaggcggagttttcgaccagaaggccctgttacccgccacgatcgtttcatctgcgcgccaacaaaaaaatattgaacaaattgcggaaaagatgattcaatcagggatggtcttcatggattatgggggccggactgacgaagaattacgggcagaaatgcctgctcagcaaaccgaaacgtacgcaatcggcgacttgggagtggcgatcccgtatgcggaagtccaactcgttgctggcaaacccactgtgatagctggaatgaaccaaatggaggccgttccagtgggcgaaattaccaaggtgggcttatccagttaccaagccgctaaagctgaaaaccacttgtatttagcaaacgcgtttttaattggtggcgaaaagaaagtacgcggtcgctctggaatgatcgtggaaaatgaaccataccgcttaaaaattaatattgcttataaacggcgccaaacctcactttcgaagtgatttgatgataaattattaagacctgtcaatgtatttactttgacaggtctttttttgtccagtatagtcaatataaccaaaaatttatctaattttaatctttcgttaatgtaatcgggtaaatggaaacggagggatcaagatgtcgatgatcgaatttcataatgtggaaaagtattacggtaagtttcatgccctaaccgacgttaatctaacgatcgaaaagggagagacggtggtattgattggaccgtctggttcaggaaaaagcaccttgattcgaaccattaacggattagaaagtattgacggtggtcaattaattgtcaacggatttgacttggccaaccgccaaactaatatcaacaaaattcgccgagaagtgggaatggttttccaacattttaacttgtatgataacaagtccgttttagagaacattatgctagctccccgggtcgtgcttaaacgacctgaagaacagaatcgccaactagcaatggaactgctggatcgggttggactagctgaaaaggcagacagcatgcctgccatgttatcaggggggcaaaaacaacgcattgcgattgcccgtagtttagcgatgcagcctaaatgtattttatttgatgagccaacgtccgcgctcgatcctgaaatgatcgatgatgttttaaacgttatgaagcaaattgcccgcgattccgccatgaccatggtagtggtgactcacgaaatgggctttgctcgtgaagtgggggaccgggtgattttcatggatggtggccgaattctcgaagatgaccgcaaggaagtgttctttgacggacaaccatctaacgaacgggcacgccaatttctcagcaagattatcaaacactaggaggtggtccccatgcgtagaaggtttaaaatgcttttcttgggactgacagccgtactttttctgggcattctaggtggttgtacaaagcaagaagctaaacaacgtgacgcttggcaaaccgcccagcaaactaaaaccctcacttggggggtaaaggccgataccaagttgtttggattaatggacgtaaaggactcccaaattaaggggtttgatattgacattgctaaagcgctgacgaagcagatgttgggaaaggatgcgcaggccaaatttgttcaagtaactagccaaacacggattccactgctgaagaatggcaatttggatgcagtgattgcgacgatgacgatcactaaggaccggcaaaaagtagttgatttttcagactcctattttgatgccgggcaatccctgttagttcctaaagatagtaagattcacagcgtaaaggatctaaaccatccgggtaccaaggtgattggggtggttggtgctaattcggtcagcaacgttaaaaaagttgcccctaaagcacaggtaattcagttgcaagactatgctcaagcccttacggcactaaaatccgggcagggagcggctttaactacggataacggtattttatttgggatggcggttgataatccccaatttaaagtggtcggaaaggcgttcactaaggaaccttacggaattgccattaaccaaaaccaaccggcgttgaaaaaacaccttaaccaagcgttggaagaaattatcgcaaacggggagtataaccgactcatcaagaaatggtttggcgatattcctggatttaattaccgggaggtggaacgatgattaatattttaactaatcatagtgcggagctctttagcggactcggacagacgctactttgtagtttgattgcgttattttttagtttagtaatcggatcactgtttgccatcatggaagtcttgcctagtcggttagcacggaccattggccgcatttatgtggaagtggttcgaaacattccgctactggtagtgaccatgttcttttacattgtgattccgcggtatgtccccgcggtaaatggttttaccgccggaaccattggattgaccatctacacttcggctttcattgccgaaacggtgcgggcgggaatccaatcggtaagcgggggccaaatggaagcggcccggtcaaacggaatgacgtttagccaagcgatgcgttacattgttttgccccaggcctttaagattgtgattccacctttaggaaaccaatttattaacctagttaagaattcgtcagtgttagctttcgtggctggatttgacctgatgtacgtgggtaacgacattgcctccaccacctttgacacgattaactcttatctagtagtgggagtattgtatctcattattacgatgccgctaagttactacatgcggtacctagaaaaacggacgaatcgaggtgtcgcctaatgcacgcatttatggaagcctattccgcggtaaatttagcgttcttattaaagggactgtggataactattgaagtttcggtgatttcgattatttttagctacgtgctcggtggaatactgggactaatccgttaccttaacgtacgctacttgtcagcgttggtgggtgtggtgattgacgtaatccgaaacttgcccctcttgttaatgttcttcttcgtttactttggattgcctaacttaggaattcggttgggaatcttgccatcttcaattttggcgctaacggtatttgaatcagccatgattgcggaaattattcggggcgggattgtttcgatcgataaaggccaaatggaaggcgcccgggcgaacgggttatcgtattggcaagcaatgcgctacattattttgccccaggcgcaggtccggatgattcccgctttggttagccaattcatttcgttgattaaggatacttctttagcgacgattatcatgcttccggaaatgatgtaccacgcgcaaatcatttacgggcaaaacacaaattatattattccaatgtttgtggctctagcaggaatgtacttcgtggtctgctataccttgtcgatcatctcgcgaaaactagagaaaaaattagcgtaagattgtaaatctaataaaaaatggcattcaaccccattcgttaccgaatcagagttgaatgccatttttgcgttagtagctaacaaaattttaaattcgatcttcaggttggacaacgtactgggcgagccgctgataatcactgtcctttagttcggcggtgattttagttccttgatcggtgtaggaagttttctttacgtcggcattgccgtttaagaagttgactacttgaccttcatcaaaaggaatcaggaaatcagcacgtacgtagtttttaaatacttgctttttaattaacgaagttagcatttcgagtgattgaagctgctttgccgagtaggtgagttcggtaccatccaacgtcgggtaagcgatgcctgcccggtcggccttgttaaaggcgtagatcatgggaacgtcggtgaccccaatttcttggagggtgtccgcagtagtttgcatcatttcccggtaatgcgggtcggatacgtccacaacttgtacaaggaggtccgctttagcagcttccgacagggtggaacgaaaggcttttaccaactggtgtggcaaattgctgacaaatccaaccgtatcgctaagaatcagttctttttggtctgggaaggttagtttgcgcacactagtgtccaaggtggcaaacagcatgtctttttcgaaaacttgcttgtcttcattgcgaccgtacatactgattaaaccattcatcgtggtcgactttccagtattggtgtacccaaccaaggctacgctaggaatgtcctttttatcccgacgctggcgttgcacgttggccgaagtggacatttccttaagttcctggttgatgtggttgattcgattgcggatcgtccgccggtttaattctagcttagtttcaccagcaccccggttagtaaatccaccgccggtatttccggcagtttgttggtcaagtcgctgggtagcgctagtccgcaaacggggaagctgatattgcaacttggcaagttcaacttggagacgggcctcttttgaacgagcccggttagcaaagatttctaaaatcaaaccggtgcggtcgatgactcgtaactgggtttccttttctaagttactaagctgactaggggttaattcgtcattaaccaccagggtttcgacttcgcgagccgcagctacttgggtcagttcttcaatctttccttttccaaaataggttgcggcattaggccgttctaatttttgggtaagctggtccatcaccctcatgtggttagcagatgctaacgacttaagttctgccatggcgtaatccaggttaacgccaggaagttctagaccggcaataataattggttcttcattgatttcttcgttcatataagaatggcctccaaattattgaaaacgtttatataattatatcatggattaggcgggggtagaaaaataagcattttacggggtgagccgcgtaaatttctctgccgtaataagaaaatgagagtgggacaaaagttgggtatgcaacctattcgaaatgtgtttccagccccaaccctttccggttaactaaaaaaagacctaattgtctcgacaattaggtctactttttagttgagcgtgtggttctatatgttgcagtcgaaacgtgttccagtcctcagagtcttccggttaatcaaaaaataggcataattgtttggacaattatgcctattcctcgattaatcctcaaactctccccgaggacttccacactctgccaaaatattccaccattccatcttggtccctcaattttaatttggtaacactcccgttgcgggggctatgggacacgtcaatttccgggttgaacatggacgtcaaaattcgaatcaaagttccgtgcgatactattaacacgttatcaccatcgttagcttggtcaaaggtgtaatccaagccttgttgcaaacgggtggtgatttccgtatagctttcggcatcgtggaacggatccacgtttttccacacgtcgatggctgccttaatgccatgtaaagcggtcatggcgttaagggttggttcaattgtggaatgttgttgataaagtttaaattcagtttctaccgaattagcaccttcgaaataaccaaaaaattgttcccgaaaagctgcgattggttcgatggttttttcgggtagcgggtgatgatttcgttggttgatgaaccgggccgttttaattgcccgggtagtatccgaacagtaagcgtgggcaaaatccacgtccgctaagaagtcgcctgcttgttgggcgtcgtgcactcctttttcggtaagcggcgaatcagaccaaccttgtaaatggcggtaccgattgaagagggtttgcccgtgccgtacaaagtaatagttaacagttttcatgaatctatgctttcttaaatgattttctaaaaatgttaaagaagaggaagtaaaccgctaaggtagcgaccacgataattccccaagcaatcacgccagaccaaacgtcagcactgtagtggcccttaattactagataagcgcccacaatgaaggttaagattgcaaatgggtaggaagcccgggaagtcttcttcaaatggttacgttctacccacgccatgtaaggaagcaacgcggatagggcaatgaaaattaccggaatgatgatgttcaacgctaattccttgtcgtataaagcagttcctggcgtcgcgtcggttggacgaacccctaacagtgaaaatacgatggtgattacaaaacaccatgctcccaccaaccaagcaagaacgtcgtttttaatgaagacgtaatcactgtggaattctttactcttttgccgaatgcgcatgaaggcaaagaagacaaaactagttacgaacggcgaaacaatcccgttgatgttcaaaagccagttgaacatatcgttaatacttggtagccagttactgaggaagagtaccagcgaaacgattccagtggttaaccagtacccgttgattggcaaaccgtcgctatttagtttacctagtgatttaggcaagtacttcattgcgacgtcagacaagaagatccgggtgctggcgtctaaaataaccgccaattgggcaaacatgtaaagggcttgactcaccgcaaagatgtacatgagggtatccccaattccaaattcctttcctagcgcttggaaggcgtagtaggaaccgttcatctttaaatcgtaaggaaggtggtgagcgttaaagaacactgctaacgagaacgaaccaaagacggtgaggaaaatcgtcattaataggagcatcatcatggctttcggaaagtcccgtttaccgtctttcatttccttaacgtatggtgcggcaagttcggcaccgttaatcgcgaaaattaataacccaaaggtagataggaagtgtccatcaattttagggatgaaggccctcgcgttaaagggctgggtagcaatgtgacggccatgcattagggcggcaaccgtcattaccacgaaaagaatcgtcattacaaacatggccccgccgcctaaagtactgagaatctccaacgagcggttgcggaaaaagtgctggaaccaaatgaaaactaaaaagaccaccgcggtgaagagagcaaaggcaattgtgggcatgtaggattgtaagtccccgttacccttaactaaccaactaattgaaactaccacggagttagcaacgtcgactacgtatggtaatcccgcaatccagtagaagaaggccacgatgtatccggcaaggtccccgttagttgcgcgaacccaggaagctagtccgccaccgtcttcgttgaaagttccgcctagttggccaaccatcatttcatatggccaaacaaaaagcaggatcatcaaaacccaggtagaaacaattgctaaaccttggttatgaaaattgtaaattaaatcgtcaaagccaattacggtaacaaagtccatcagagcaacgaccggccagctaatgtaccttttttttgcatctaaaggtgaattttccattcttacgtctctcctatgtaaattttaaatctcaattctactatcttaattgttatattcgattaaatgaattccatcttcatcaagggtaaaacgggtaatgctgccatttttaggtccccaagtgatgtctagttcaggatctgctttagctgcgatggaacggattgtcgttccgtggctgacgatgaggatttgatcgccatcgttagcggtcgctagcaaatcattaaatccacggttgattctttcccaaaattcggcgttgttttccgcatcgtggaaaggatctgccgctttaatagcatctttagtttctgcaatcgggcgttcttcgagaaattcgtggaacgaacgttttccagaaatcggcatcaaaacttcaaaccaagtttgggcggaatcgttgccttcgaaatagccgtaaaattcttcccgaaattcggttttcggtaggatttcagcggtagtatgcttgttttcagctaaaatggcgcgggcggtgttcattgctcgggtggtatccgaagcgtacaccgcgtcaaaattggtgtcacttaagcggacgccagcttggtgggcgtctgcgtaccctttttcagttaagggcgagtcggaccagccttgcatccgattgtacttattaaaaatggtttgtccatgacggacaaagtacagctttagttgtttcatcagcttctgtccttccttattttttgtaaaacctcaaccattctatcataaattaaatttccaaaatgacttaaatctttgtgaaaacgcataaaaaggagtaaaatttatgtctaacaaaaccgagaggtgaaacatattggcagacgaaatttttaaatatgaagaaaaacatttagcagaggtcttagataaggtagacattgctatggataaggcccaaaaagatgctaagaatgccgaaaatgatcgcggagcaatccaagataatttttataacgatgtccggatcaacacttccagttattcaggaatgatggacacggcaatttcgattcgccaacaacaacagttgctcgaagagcgcgagaatagttggcaacacgcaaccaaacgaattaaaacacttaaacaaatgcaaaaacggccttacttcgcccggattgacttccacgaagagggcgagaaaaatgacgagaccatctacatcggactgggctcgttttcggatactccggaccactttttgatttacgattggcgtgcgccaatttcaagtgtttactatgatggcaaaatgggccacgtggagtacgcaaccccagatgggcaacaatccgtagatttaaagttaaagcgccagtttacgattgaagacggtaagttgatttcggtttacgatactgacgaaacgattggcgatcaaatgttattgaacgctttaggctcacagtcggacgtagagatgaagagcatcgtttccaccattcaacgcgaacaaaatcaaattatccggaacacgtccgcggaccttttatttgtgcaaggggcggctggttcaggaaaaacggcggcaattttacaacgagttgcgttcttgttataccgttatcggggaaaactgactgcaggccaagtgattatgttctcgccaaaccagttgtttaacgactatgtggaccaagtgttacctgaattaggggaacaaaacatggtgcagatgacctattaccaatttgcccggcggcggattcctaacttagatgtggaaaacttacaacaacggtttgataagcagcttactgacgcagaacgaaaaatcgaccaatttaaaggtagtttacaattctttaaagccctaacccgttatgcacagcaccttgggaagggcggcatgcggtttagaaatatcatgttcaaggaaaaaccgttcgctagcagggaaaagattaaggaaatttactattcgtttaacgacacttatagcttaagtaaccggatcgacggaactcgagagaccttaattcgcatgcttaaccaaaaggttgggagcgaactacggacgaaatgggtagaagaagcggtgcaaaacttaagccaagaagaaattcacgagttgtttaagaataaacctcgcgaattcaaggacaatgacgaagaatttaagtttttagctcggcaaattgtggttaaagagttaaaaccggttcggaacgcaattatgcggaaccgcttcttgagtattaacgcgcagtacgtccacatgctccggactttgccaaagtggtataagttagaaaaaatcggggttaccgaagcacagtggcaggcccatgtggaaaaactagtggaaaatcttaaaaatcggcaattaacgatggtggatacgtcagcgtacttgtacctctatgatttaattactggtaaacggggtgaccgttcgatgcgctacgtgtttatcgatgaaatccaagattacaatgcctttcaactggcttatctgcggtataacttcccgaaggctaagttcactttgctaggggatttgaaccaatcaatttacgcaaacgaaaccagtaaaacccttttggcagaactttcgaccatgtttgatccagaaaaaactaaggtagttcagttggcgaagtcgtaccgctcgacgcaaccaattacggacttcacgaaggagattttagaagagggcgaagcaatcgaagcgttcaaccgccaaggcgagttaccccgggttgccgttactcaagatcaagctaccatgcttaagacggtccaagcccagttagaacgggatcgccaagaccacgaaactaccgcaattattggtcgtagtttagcagaatgtgagcaaatcacggagcagttacaggccgctggagaaaaggtaactttaattcgcacggaaaatcaacgacttgtggaaggaactttagtagtcccatccttcctagctaagggactggaatttgattccgtgattgtttgggatgccaacgcggaaaattatcaaagtcaccgcgacgaacagttgttatacaccatttgttcacgggcaatgcatcgtttattagtagtagccaagggacaacttagtccgttaattgctaaaatccccgagtcgttataccaaacaattaattaaattatgcacagcaaacgatggataatggggatcaagttgcaaggagtgcaaaaagcaatatttacccgatccatggtagtgaaattctgatatagtagttatgtaaacactttcaagaccccctaaggaggaaaaagatgattcaaagcagttacacgggagcggattcgattctggacagtctcattaaccatgatgtggaatatatttttgggattccaggtgccaaaattgacttgttattcgaacagttagagcattctaatcgggctcgtaagccccggttaattattacccggcacgaacaaaatgcggcctttatggcggcagcggttggccggattaccggaaaaccgggggtggttttaaccacctccggccccggagtgggtaatttagctaccggattagttaccgcgacggcggaaggggatccggtattagctatcggtggacaagttccccgtaacgaccttttgagactaacgcaccaaagcatgcgcaacgcggatttgtttgaaccaattaccaagtacagtgtggaagtgcaggaaccagaaaacatttcagaagttttggcaaatgcctaccgggctgcggaatcttctaaacaaggggcaagttttgtgagttttccacaagacgtggtaaacgcaccggttagcacccggccaattcaacccttgaagaagccaattttaggaccagcaagccctgatgaaattaagaaactggcggaagccattaaaaacgcccaacttcccgtactattgctagggatgcgggcgtcatcgccagaagttacccaagcggtacggcagttagttaaggaatctgatttgccagttgtggaaactttccaaggcgcgggaatcatttcccatgatttagaagaccatttctacgggcgggtcggacttttccgcaaccaacctggggataagttgttgaaacacagtgatttggttattacggtcggatacgatgccatcgaatacgaaccgcggaactggaatgcggaaggggatggcaagattctcgtaattgatgattcaccatccgaaatcgatcacaactttgaacctgaaaaggaactagtgggcgacattgcccaaaccattaacctcttaacaccgcacctcgcgggttaccaaattagtaacgacggagagcagtacttagagcagttacgcgaacaacaaaatcaacaggacttaccgcccgaagcggaatcggatacccaacgaatccatccgttatcactaatttcagcgctacagtaccgggtcgacgatgaaatgaccgtttcagttgacgtgggaagcttctatatttggatggcgcggcactttagaagttatcaaccacggcacctcttatttagtaacggaatgcaaacccttggagttgccttgccatgggcaatttcagcggcgttgttacgtccggctcacaaatcagtttccgtttctggggacggaggcttcctgttctccgcgcaagaattggaaacggccgttcgggaaaatctagatattgtgcacattatctggaacgatgggcactatgacatggttaagttccaagaagaattgaaatacggcaaagctgcgggagtaaactttggtccggttgactttgttaaactggctgaaagttatggtgctaagggtttacgagttgatggaccagcagatctaggaaagaaactggacgaagcgtttcaaacgaagggaccggtagtggtcgacattccggttgattatcgcgataacgttaagttgggtcaatccttgctaccagatcaactataaaatatttgtaaaaaaggggggattgcagatggcaaaattatttcaacacggcacgttagcaatgttagtagacggacttttcggcggaactttgactgccgaagcattattagaacacggcgattttgggattgggactgcggaaggtcttgatggcgaagtcattattttagatggggttgcttaccaagccctagctgacgggagtgttcgcattttggaacccgaagccatgttaccctttgccgacgttaaccaagcggattttgagggacacgtggttttaccagaaatcgaaatggccgaagtagatgcgacattagctaaagaattgtcataccaaaatacatttgtggcaattaaaattagcggactcttctcccgagtgcaaacccgggtggttaaaggccaacagcgcccttacccaacgttgagcgagaccgctgcaaagcaacagatctttgatgcacaaaacattaagggaaccgttgtgggatactatagtccgaaactattccacggagcgagcgtggccggaatgcatttgcatttcatcgacgatcagcaccaattcggcggtcatttattagattttaaggccgatcaagtgaaactttcctggcagattctggacgggattgacttgagtttaccgattaaggactccgaatttatgaagcatcaagctagtgacgtgcgagatattcaacagtccatcgctgaatcggaatagttaaggaattaatcgaagacgaggatttagtaatcatgcaggcacaaggatatttcacgtttgaccgcaccgcgtggcaaaatttatcaaatcgagcagaattaccgctgactcagcaacaattagccgacattaaggcgcttaacgaccggatttccttagaggacgtccaggacgtttacgttccgctggtacggttattgcagaagaagtacgctgattttgaaaaatggaaccgcgataaactggactttttacagattccggttaaaaaaacgccgtttattgtaggaatttcgggaagcgtagcggtaggtaaaagcaccactgcgcgcctattgcaagtgctgttaagcaactggtttagcgatttaaagacccagttgattactacggatggctttttataccctaatgctgaattaaagcggcgccatttaatgagtcggaaaggatttcctgaaagttacaacatgaaggaactaatccactttttaaacgcggtgaaaacggggcaaaaacagattaaggtgccgaaatattcacaccaagtttatgacgtcatcaaggatgaatacgacgtaattgatcagccagatattttaattgtggaaggcattaacgtactccaattaccggctaacgaaacgatttacgttagcgactttttcgattggtcgatttacgtggatgcggaagcggacttgattgaaaaatggttcttggaacggttcggcgtgttattggatacggcattccacgatccgagcaattattactaccagtacgctcagatgccacgggaagaagcctttgcctacgctaaaaaaatttggcgcgatatcgatttgaaaaacttaaaagaatacattttgccaacccgttttagagccgatatgattctacacaaaacggaggggcacgtgatggacaacatcttagtgcgcgtgtaggcgccgttctatgtaagaaacgaaggaaaaagtcgttttaaaaaattaggaggctaacttgttgcgattggctttaatagagcccaaacgtgcgctaaaaagttagttttacttaaccccaatcgatcagtgtgcctgaatttggcatactggtcgatttttagttaaggcacataaattgagttgtctaaaagtacggaagaacaagaggatggcttggactaagaaaggctgattagcctagttgctaatgccttaatgcgaccaatggataaggcttatgttagcgaatgagaaagctaattaagtacggatagtaaataaggcagtactaaatgcttttctttttggaatgatggtgatacacttactaaaaataccacgaggagttaactattatgaagatgtgttgttgtttgatatcagtctaatgaataagtgatcaaattatggattcccttatttgttagcgaaccagcttatttggatcttaagggcaattcatattgatcatcaacacaccttctatacaatttttttgacgtgcaaaaggggttggggtctatttgaatagatcccaactctttttagttaggaagaaaaattatggtgaatgaaagattagttaaactactaggtaaacatcgtggtggtcaatcttgttaatgatggttagtgataaaaatgcatgtaataccataattaataagagggaatgaagatttatgaatgatttgatgatttgggtaaccgtggggattgctggcgtgatcctgcttgttttagctttattacaacgaaagaacgtgagcttcaataagttagttttgattggcttggttttaggattaagttttggagcaatcactcaagcaatttttggatcaacaagtaaagttgttgctaccgcagttgattggattggaattgtggggaatggctacatttcgttattacaaatgctggtaattccgctaatcgtaatatcgttaatcagcgcgttcaccaagctaggagacactaagaatctggggaagattgcgagaaacgtgctaacggtgttattaacaactacggcaattgcggcatttattggggtaattaccgtgatcgcttttaacttgcaaggagcgtcgtttgtaaaggggaccgcctctaaagacaatctggcctttttacaacaacaccaacacgcattatcggaattaacggttccgcaaaaaattgtaagtttcttaccacaaaacatttttgaagaccttgccggaacgcgggcaaccagcacgattgcggtagtgattttttcactgattgttgggttagcgtatatatggttaaaagaacactatcctaacgacgcacttgccttcgaacggggcaccgatattctagataaattaatatccagaatggttcgcctcgtcatcaatttaactccgtacggaatcttttctttgatggcaaagacaattgcggtgaatagcattaaaactatcgtaagtttggcgtactttattgtagcggtctacgtggcattgttgttggtgttggtagtccataccgtaattttattattaacgcataccaacccgattgagtactacaaaaaagtgtggccaaccctgatctttgcgtttacttcgcgtaacagcgcgggaacgttgccaatgaacgtcgaagtacaaactaagcaactggggattaataaggccatcgcagatttttctgctagtttaggactcagtattggacaaaacggatgtgcaggaatttacccagccatgattgcgtcgatcacggctccggtggtgggaatcaacatcgtatcggttaaatttattttaacgttgattattatcgtcaccatttcatcctttggggtggctggctcaggtggcggcgcgacctttgctgccctaattgtcttagggacgttgaatttaccggttggcatcatgggaattgttttggcaattgatccgattatcgatatgggtcggacgttagtgaacgttaacgatagtatcctagccggattggtaactgccaaacgaagtgacatgttcaatgaagatgtttttaacgggaaagaaaaaattgaacaagcttgatcgagtgagatgaattagtttttagtgttttaaattaaaggaccgtttcaggaatttttagattctgaaatggtccttttttattttaattaaaaacgtcatctctgaagcgttagtttgatgaattggtgattggataactaaaaacaacttattcaattagcgttaagccggcggcatcgagaatttgtaactggtgtccaggaagctttttaatcaaatggtggctttcccaacgttttagataacggctaatggtttccggcgtggttcctaacaaggtggctaggtccttatttttgagcggcagggtgaaaggattggcttgcaaactagcagaagtttcgacgaggtaatcggcaagtcgttcagcaaccgattctgtattagtcttggtggcttgagcttcgagtgacaatagccggttgcccagggtgttcatcacgttcacggcaatttgaggattgcgggttagaagctgttgaaaatccgcccgcgcaatcgtgcacacggtggtcggggttaaagttgtcgccgtggaatggtgctcaagttggttgaaaagggctgcttccccgttgatgtcaccgctttggagcaggtaaagcagatgttccttaccgttttctgcgggtcgaaccaccttaacttgccccttggcaacgatggtcaaggcgtcaactgcgtccccggcttgataaagaatttgttgggccgggacgtgacgatggcgaacgattgcctcaatttgctggctttgaacgggggttaagtttttaaaaatcggtactaagggcacgcaatggtgcgcatcaacgagggtggccattatatttctcctttgtttcattagcgaagtgcaaatttttttgtcaaaacttgaccaaggtcaatttcaaaaaggtcgggtacttctatgcttaatatatcaaagcaaggaggaaatataaaatgactaaggttattctgcaattagatacgttaacttgcccaagttgcatgacgaaaattcagggtgccctcactaaattggcgggggtccaaaacgttaaagtactttttaacgctagcaaagttaaggcgctcgttaatgatcggttagatagtgcggatttaaaacggaccgttgaagaactaggatatcaggtaaaaagcgtgaaaaccaaggaggttactgaataatggcaaaatcaattgaagaacgttatttagcagagcaaaagcaagctgaaatcgaccaccaccaaccaaccgcgggggcgatggcggaccatgttttggcaaatttacgcgtgttgaccaataaactggtgcaagctgcttggtacgttaaggggccaagctactttgccgaccgggaatatttgctacagttacaggcaacgttaaaccatgatttcgtgcaattaggcgaccagcttcgtgcggtaggggaaaagcccgcttccgtcaccgcagaatttagcgaatacagtatgcttactgaagatccgcggattaagtattactcgacggaagctatattggcggggttagtagcagattgccaaactagtttgatgtttattcagcgcgccattgcgttggctaaccaagaaagtaagtttcccttagcaagctacttaattgagcttaacggacaatttgaccgggcttcacaaaaattacaggcccgtttgggaaaagaaccgcgcgaaggtttggaagaagacgatgatgatgattaaaatgcaacgctggttcacaaggtttgctaacccgttgctcggggtggctgcgttattaaccgccacgggatggctgctgcaacatggcgggggttccccagaagtggctgggatggcgtatggtatagcaacgttggtagcggggatgccgatcctgttgaaagcaatcgctgcgttacgcgcccgggtggccagcattgaattgttagtaagcattgccgtgctaggagctttaatcattggggaactagaagaagcggcgatggtcacttttttgtttggcctaggtaattacttagagcgccgcactttaaagcagactcaccgggcgttggctaacctaacggaaatgcaaccgacacaagcactcttagtgagcgaaggacaaacccgcacggtagcaattgacgacgttgaggtaggcgaccagttattagtgcggattggtgaccaagttccggttgacgggcgggtggttaccgggacggctgccgtcaacgaagcggccattactggtgaagcacgggtggttaataaaactcccacggatcaagtatacacaggtacaattgtggaaaacggacaaatggtggttgaagcccaaaaagttggggaagaaaccacgtttggcaaaataattgagctcgtggaggaagcccaagacaatcaggcgccagtaagccgttttattgaccagtttgcccggttctacacgccactggttttagtgttagcactcttaacacagttagttacgcaagacttccggttggcgattacaattttggtgctggcgtgtccgggagcgttagtaattgggacaccggtatccaacgtcgcggggattggccggggagcgcaaagcggcatcttgattaagggcggtcaggtcattgatcaactggccaaggtgcgtaccatcctcatggataaaaccgggacgattaccactggtaaaccgaccgtccagagcttctatcagtattcacaacaagattggctagcggtggcggcccaattagaaaaacaaactaaccaccctttggcagcagccgttgtggaattttatgaacaacgaacgggccagcctgtgcaaaaccatgatatcgcaatcaccaccgttaaaggaatcggggttaccgccacttggcatggtcatcaggtgaaattgggaagcccgcggattttagaaccaagtgcccaaaaactttctaataaacagactgctgatttacaaaaactgcgggaaaatgggcaatcggtaattttaatgatcgtagatggtgctttagtgttggcaatgggcttatccgaccaagtccggcccggcgtagctagcgcacttaaacgacttcgccaaaccggagtgacgaatcagtggatggtgactggtgatcaactaaacgttgcccagtccgttgcacatatcgtgggaatcacccaggttaaagcaggtcagttgcctaacgaaaaggcccagtttttgaaagaactccaagcaagcggtcaaccagtgctattcgttggcgacggaattaacgacagtcccgccattgcccaagcggcggtgggaatcgcgatggggagcggcaccgacgtcgcgattgaaacttcggacgtggtactgattaatcccgattttaaaaatgtcgtttttgcgcggcagattgctcaaacaacgctgcgtaacatgatggaaaacgtgggaattgcggttggtacggtggcgttgttgatgttaggagttagtttaggttgggtaaatatggcaagcgggatgtttttccacgaagttagtatcctagtggtgatttttaacgccatgcgattactgaaactaaaacggcccgcctgggagaatttttccacaaaaactggcggtgagagcccttccagtgaaactatctaagtgatagggctatggtttttcacaattttcctgtatgatagaggataagaatgaaaagatgaggtgaaggacttggcaaacacagatttatcaaattttgataaaatcattgttttggattttggtagtcaatacaaccaattgattacgcgcagaatccgtgaatttggggtttactcagagcttctttctcataaaatcactgcggaagaaattaagcagattaatcctaagggaattattttctccgggggaccgaacagtgtttatgatgacgatgcttttcgagttgatcctgaaatttatcaactaggaattccaattttgggaatttgttacggaatgcaattgatggcctacaatttgggcggtcgggttgaatctgcggataaccgggaatacggccacgcagacattaacgtaactgatgaccaagcggcattgtttaaaggcttgccagctacccaaacggtttggatgagccacggtgacttggttcgcgaagttccagccggctttaagacggtagctactagcgcaaattgcccaatcgcttccatggcggatgacgaacggaaattttacggcgttcaattccacgcggaagtgcggaatacgcaatatggtaacgatattttaaggcactttgcctttgatgtttgtcaagctcaagcaaattggtcaatgaacgacttcattgacatgcaagtggaaaagattcgcgaagaagttggcgaccgtaaagtactcttaggactttctggcggggttgactcaagcgttgtcggcgtattgttgaacaaagcaattggcgatcaattagtatgtatctttgtggatcacggtttgttacgtaaaggtgaagcaaagcaagttatggatagcctagaaggcaaatttggcttgaacattattaaggttgacgcacaagaccgcttcttgagcaaattagccggagttactgatcctgaacaaaaacggaagatcatcggtaacgaatttatcgaagtcttcaatgacgaagctcaaaaacttaagggaattgatttcttagctcaaggtaccctttacactgacgtaatcgaaagtggaacggatactgcgcaaaccatcaaatcccatcataacgtgggtggattgccagaagacatgcactttgaactaatcgaaccgcttcggaccttgttcaaggatgaagcgcgtgacttaggtgaaaagttgggaatgccagaagatttagtttggcgtcaacctttccctggccctggtctaggaattcgggtgctaggtgaaatcaccgaagataaattgcaaatcgttcgcgatagtgacttgattttacgtgaagaaatcaagaacgctggcttagatcgtgacatttggcaatacttcaccgtcttgccaggaattcggagcgttggagtaatgggtgacggccggacttacgactacacagtcggaattcgtgcagttaactcgattgacggaatgaccgccgacttcgcgcggatcccatgggacgtactccaaaagatttcggtacgaatcgtaaacgaagttgaccatgttaaccgcgtagtgtacgacattacgtccaagccgccggcaaccgtggaatgggaataaactgaatataaacaaaaaccaccttatcccggttaatccgaatgataggtggtttttttgtgttttttaaaatgggataaggcggatattaaagtggtacaaatgtggtacgtgtaccaccgaaataatgtttctacgtcagttcgataataatttccacaatatttaccgtgtaaaaatattacaaaggaaattaatagataagtggtaactcttgaatgcttacaaaaagttagctatcatagagatatagattaagaccaattaataggaggaacggagaatggcaaagatatttattgcgggcggctctggacgggttgctaccgccttaattaagaatttagttgcggatggtaatgaagtggttgctggagcgcggcatcctgaaaacgttgttgagatggaccacgtgaacgcggtaaagcttgatttgcatgacggggtagacgcgatcgccgacttaatgaaggggagcgacgccgtttacttcactgctggttcgcgaggcgccgacttgttgcaaactgatgcgatgggcgcggttaaaactatgcaagcggccgaaaaattaggcattaagcgttacgtcatgctaagttcactatacacattggaatcggaacgtaagtggcacgaaggcggtttggcagacctcttggattacacaactgccaagttctttgcggacaactacctcgttcatgacaccgatttggattacaccattgttcaaccaactagtttgactgaagaagcgggaactggtcaaatttacatcggaaaagagctcccacaaaagactaacccaattccagacgtggcaaaagttctagcagacgttttgaaacatccgaatactgttaaaaaagtatttatgatgagcagcggtagtcaagcaatcgaccaagcgttggctaacgtataaattttaaccaactagaatgtcccccagtacgccaagaattcattaacgtgattcttggcgctttatattttatgagtaaaatattttatttgtgaaaacgaactggatttttcattacggatttgacattttcctgaattattttcattatggtagaagcacgtttgatgaaaatgagagaggaagaaaaatatggaaacacaaaatacgcggcacaccaacccgatgattgtggtggcggtagtggcgttgatgtcctttatgggaattttgacggaaacctcaatgaacgtaactttcccagctttaatgaaggagtttcacgtccccctcaacacggttcagtgggtgaccgccggatacttattgatggctgccttagtaatgttaacgtcggcttacatgaaacgtcggtttaccaaccggcagttgtttaccgccgcggcaatcttatttagcagcggtgacttgatttgtggattagcgactaacttttgggttttgttagccggtcggttaattcaggcaggatgtgtgggactatgcacgcccctgatggtcaacattattctagacgtagtgccccagcataaattggggacttacattggaatggcaaacttgattattttaattgcaccggcacttgggcccacgtttggcggggcggtagttgcttttaatagttggcgaatgattttttggtcaactttacccgttgcgttagtgctgatgctgcttggcatgaaagtcatcaagcagtacgcgcctactgaccagcactacgcgtttgactggacccggtttcttttgttggggatggcgttagttagtttaattgttggattgaacgccctcggagaaatgcaattgggtacttttgtagggttgctgatcgtcagcattggcttaactatactatttgttaaacgctcgcacaccgcaacgaaagctttattttcactgcaagtttttaagcaaccagcctttttatacagttttctaccatatataatgctgcaatttgcaaacgtagggattaacttcctgttacctaattacgtgcaggatgtttttcaagcgacttcgttagttggtgggctaatcttactgccgggaagtttgtttaacgggtttggacaaccattgtacggctggctgttggatcggtttggcggaaaagtgcccttgtataccggagatattttgtttacgttggcgttggttggcttaatgtgctggggacctcaattaggagtggttggaatcacgattgcttacttaattttcgcgattggccgctcgatggcgtttggaaattcggtcgcgtacggtctaaaacatattgacaaagaatttcaaaacgatgctaacgcgttgtataatacgggacaacaggttaccggagcaatcggaacgactgtcttagcgctattgatgggatcggttaaacgcccaggctacacccacgcgcaaaacgtaagtgcggggagtcagttagcatttattttgctagtaattttcggttgcgtaatctttgtgtttttccaccatttggttaatttaaagaatttgccagaagataagggcgttgatttataagcgctgggcaaaataggaggagcagcatggcgaatattgaacgattttacactaaatttcacccaactaattaccaaattaaattagcaattagtcgggaaacaaaggaaattaagggaacgaccaccattaccggggaggcgttaagctcccaaattgacatccaccaaaaggatttacaaattgaagaactacgggtagatggtacggcaggcgattttaccgttgatcaagccgcggaagcaattcacgttaaattaccgcacaccggaacggtaaccttggaaatcaaatacaccaccaagctaaccgacacgatgatgggaatttatccgtcatattacgaagtgaatggggaaaccaagcagttagtgggcacccagtttgaaaccacctttgcgcggcaagcctttccgtgcgtggacgaaccggaagccaaggccacctttgatttagccattaagttcgatgaacatccgggtgaagtggtattgagcaacatgccagaaactaaggttgaggatggttaccactattttgcacgtacggtaaaaatgtctacgtacttaatcgcgtttgcctttggtgatttgcaaagtaagcaaactaaaactaagagcggcgtccaagtgggcgttttcgccaccaaggctcatcagccgcaagagttagattttgctttggatattgccaaacgagcgattgaattttacgaagacttctaccaaactccgtatccactaccacattcatggcaactagccttgccagatttttcagccggagcgatggaaaattggggcttggtaacttaccgggaagcttacctcttgctcgatccaaagaacaccactctacgcactaaacaggtggtggccacggtaattgctcacgaattagcgcaccagtggtttggtgacttagtaaccatgcaatggtgggacgacctttggttaaacgaaagttttgccaacatgatggaatacgtggctgttgacgctttggaacccgattggcaaatttgggaattgttccaaaattctgaagcaggcgcagctctacaacgggatgctacggacggagtgcaatccgtgcatgtccaagttaacgatccggccgaaattgacgccctctttgacggagccatcgtttatgcaaagggagcccggatgctggtaatggtccgcgctttgattggcgacgacgctctccgtcaaggcttgcaaaagtactttgcaagccaccagtacggaaatgctaccggaaacgatttgtggcaagccctcggggaagctgcgaacatgccaattggtgacatcatgcatacgtggctagatcaaccgggatacccagtggtgaccgcccaagttgaaaatggtgacctagtgcttgaacaacaacaattcttcattggtgaaggacaagctcaacaacgccaatggcagattccgttgaacggaaactatgcagaggttccggccttactacagacgaaaaccttgaacttaggaaattaccaagacttacgggatcgaaaccaacaaccgttccgtttgaacgtgggcaacagttcgcatttcatcgtgcgctacgaccaacggttattagatgatattttagctgattgggagcaactgtccgcgatcgaccagcttcaactactgcaagacctgcgcttgttggcggaaggcaagcaaatttcctacgcggagattgtgcccttattaccacgatttgcgaaaaccgattctgcgctcgtagcggagatgttataccgggtggcaaatgatttaaagaagttcgttgctccgcaaagctcagcagaaaagcaacttaagaagttctttggtgaattaagtcaagcaccggcccaacggttaggctggcaagcggcggctggtgaaaccaacgacgaccagttgatgcgtccgatggtattgaaggcggctttgtatgctgaaaatccagcagttaccgcacaagcccatcagctatttgaagaaaacgaagcacagctgccaaaactaccggccgcaattcgttccttagtaattcggaatgaagtcgaacattttggtagccctgagctttttgcccggttgcttaaagaatatcaacggacaagcgatgcgagctacaagagtgacctttgccaggcgcttacggccacaccatccttaccattgattcaacaactagttcaacagtttgaaaatgcgcaagtaattaagccgcaagacttgcgagcgtggttccgtggcgtattggctaaccctcaagggcaaggcccggcatggaactggattcgtgacgaatggcaatggctagaagacacggtgggcggtgacatggaatttgccacctacattacggtgattgcgggaattttccaaacaccgacgcgcctagccgaattcaaagcattctttgaaccaaaactagcaactccaggattaactcgggaaattacgatggatattaaggtgattgaaacccgagtcgcactaattgaaacagaaagggatgctgtacaagctgcggtagcccaagcaattaagtaacgtgataaataaagcgagagactgcgaaaaaactgaaagctccttttgcgggttggttctattagagtcaacacacaccaaaagctagtttgtcccgcttaacctaaaagcgaccattattatgctaaatttagacatagtaatggtcgctttttagttagtgtttgcaaactacccgacttttggccaatgcgctcgtttttaatttgcctaaagtgcggtgttagttatttgttaacgatttggtggttggaaaggtccccgtccgcgctttgcacgtcaccatttgcgtaaacgtagtaagaaccgtgtttaggggaggtaatgtggaaataaattggtgaagacttgccaatggaactaaaggccactttccaattttgattaccatatttttcggttagaagggcaactgctgcttgttcgttttgaattttctcgtcagcaaggggccggttgccattcttcttttctgccttcgttaagtcgctgcgggacatttgattatctgcagaactacttgagtcggtagccgaacttgttgaagaagaagcggaattagagctagagctagagttagtcgagtcttttgaagagtttgcgctagctgatgagctagttgctttatcatctgaacttgatttagcttccttgctagcagacgacttacttgatgacttggccaccttttcggtcttgctagaattagaagatgtatcagagttagaagtagaatggttgccacaacttgccaaggttaatggtaagactgctaagatagcgattgacgcaatttttttcatggtaaaatcctcccccggattgatgaatttagtgctaataatttagttaattctagcatactcaagcaaaactgcaaggtacgcaaaagtttaatttaataacgttgaaaccgcttaaaatgcgttgagtaatcgagggaaaaacgatatagtgagattaataacgttgaggaggaattttacatgggtgacagaaagtataaccttggtctcgatatcgggacgtcatcaattggctttgcggcagttgacgaaaataaccaacccattcgagtcaaaggaaagacggcaattggggtacgcctctttgaagagggcaaaacggcggcggatcggcgtggctttcggactacgcggcggagattatcccggcgccggtggcggatcaatttattgaacggaatttttgatgcgcaccttgccgaggtggaccccacctttttggctcggttaaaagaatcgaaccggtcaaatttggatccaaagaagtcttttcaaggctcacttttattcccagaacggaaagattatcaattttataaggaatatcccacgatttaccatttgcgaaaggcattgatggaagaagaccggaagtttgatattcgggaaatttatttagcggtccaccacattattaaatatcggggtaacttcttaaacggaacgccgatgcggtcgtttaaagtagaaaatattgagcttgatacgttatttgaccggttaaaccagctttatgaagagattattcccgacaatgaactggcctttgatttagaacaagtggcggatgttaaggaagttcttagcagcacaaccatctataaaatggataagaaaaaacaactagtgaagatgatgctgcttcccacaagcaacaaggcgttacagagtgaaaacaagaaaatcgttacgcagtttgttaatgcgattttgaactataagtttaagcttgacgtgctcctccaagttgaaacggacacggattggtccttgaagttaaacgacgagggggcggatgataaattagaagaattcacgggtgatttagatgaaaatcgtttggaaattatagatcttttgcaaagactacataactggttttcattaaatgaaattacaaaagatggtaattcgttgtccgcggcgatggttgaaaaatataaagatcaccgtcaccatttagaattattgaaaaaggtgattgaggatcatccagatgctaagaaagcaaaagcactgaaggaaacgtacacggcctacgtcggtaaaacggacgataagacccagaaccaagatgatttctataaggctgtggaaaagaacttagatgattcgccggatgcaaaagaaattaaacgtttaattcagctagaccagttcatgcctaagcaacggactgggcaaaatggggcaatccctcaccaactgcatcaacaggagctcgaccaaattattgaaaagcaatctaaatactatccgtttttggcggagccgaatccgaacgttaagcgccgtaaagatgctccttacaaactagacgaattgattgcctttaagatcccgtactacgtgggcccattggtaacgccggaagaacaagcacaaaacggagaaaacgtgtttgcgtggatgaagcggaaggttgccggtccaattacaccatggaattttgataaaaaagttgaccggatggaatccgcaaaccgatttattcggcggatgactaccaaagatacgtatctttttggcgaagatgtcttacctgcggaaagcatgatttacgaaaaatttgtggtgcttaatgagctaaataatttgaaaattaatgggcggcatttatcgcttaaggataagcaagacatttataatgacttgttcaagcaacaaaaaacggtttccattaaagcgctccaaaattactacgttaccaaaaagaaggctgcaaccgcgcctaccgtgggcggattagccgatccaaagaaatttttatcaagtctgtcaacttatattgatttcaaaaatatgtttggggagcaggtaaatgatccgcaattccaagaggatttggaacaaatcgtggaatggtcgacaatttttgaagatcggggaatcttcaaggcaaaattacaagccctgggttggctatctgaaaagcagattcaacaattggtggctaaacgttacaaaggatggggccggctttccaagaagctcttaactgggctaaagaacgcggaaggatactcaattttagacgaaatgtggcgttcgaccgaaaacttcatgcaaattcaaagtcgtccagaatttgcggcactgattcaacaggccaacgaaaaacaatttgagggcaacgacccgaataatgtttgggagaatattgaaaacattttgggggatgcgtacacttcaccacaaaataagaaggcaatccgtcaagtggtgaaggttgtccaagatattgaaaaagcagtggggaacccacctgaaaaaatcgcgattgagtttacccgtgaagccgcggcgaaccctcaacggacgcaaagtcgtttgcggaccttggaaaaactttatgaaagtgccgaagaagttgtagacgcgaggttaactgccgaactagctgaatttaaggaaaataagcacgttttatcggataagtactacctgtactttacccaattaggccgggatgtttatactggggacactattagtctagataggttgaacgattacgatgttgaccacattttgccacaatcctttattaaggatgatagtttggacaaccgggtattgacgattcgagcggttaacaacggaaaaagtgataacgtaccagctaaaatgtttggcaaaaaaatgggttcgttttggcggtacttgctggataacgggatgatttccaaacgaaaatataataacttaattaccgatccggataatatcagtaaatacgcccaaaagggatttattaaccggcaactcgtggaaaccagtcaagttatcaaactgacggctaacattttaaacgggatttacgataaggacaccgaaattatcgaagttccagcgaaaatgaattctcaaatgcggaaaatgtttgatttggttaaggtgcgggaagttaacgactaccaccatgcctttgacgcttatttaaccatctttattggaaactatctgtataaatgttatccaaaattacggccatactttgtttatggcaagttcaaaaaatttagtgacaatgaagatatcgaagttggagacggacgatttaactttttgaatcggatcgaacggttgaaaaatgttacagatcctgagactggtgaaatcttgtggtcaaacgtggcaccgaatgagactatcaaacggattaagaaggtttacaactataagtttatgattgtttctcgggaaatcaccactcgaagagcagaattatttaaccaaactgtttatccaaagaattatcgtggaaaactaattccgattaaagaagaccggcctacggatttatatggtggttatagtggaaatacggacgcctatcttgcaatcgttgccttagaagataaaaagaagggcaaatatttcaaggtggtcggaattccaactcgggcggctgccaaattagagaagttaaagcaacaagattcgcaacagtatttacaggcgcttcatgaagttatcgcgccacaatttacaaagagcactaaaaaaggaatcaagaaaacggaattccggatcgttctggataaggtgcactaccggcaattagttcaagatggccctgttaaaatgatgctgggcagttcgacgtataaatataatgctaagcaactagttttgtcagaaaaagctctgcaagtaattaaggatgaccgaaaatttgatgagacgcagaaagacgataatttgatcgcagtttacgatgaaattttatcaattgttaatcaatcttttgatttatacgatatcaatggtttccggaagaaattaaatgataatcggaatcaatttattgatttgccagccgaaaccaagtatgagggacgaaaagtagttgcacacggtaagcgtgaaatgattttagagattttgaagggattacatgctaatgcatcctttggaaatttgaaaccaattggatttgcgacaccatttggccagatgcaatccaaaaatggtattgaattatcagaaaatgcgttcttaattcaccaatcgccatcaggattattcgaacataaaattaaattaagcgatctttaatgagagcatcaaaaaagaggagccgtcccattaagggtcggttcctccttcactatgtattgcccagatagctgggacaaatggataaactccgcacaaagtgcattgtttgatttcaaatcaggatgttaaatcaataaggttaaaagttgggagctacccaacaccattaatataaaccagtacactggtaaaatcaagaaggttttaaaaatatgggatggagatcagtaatcatcactcagcacgctaaattgtcgtattcggcacatgcgatgattgtgcagaccaatgacggaattaatcagattccggttgatgacgttagtttgttgttaatttcaacgacgcaagcggtaattacgacggcgttaatcagcgagctatcaaagaaaaacgtcaaaattgtatttaccgatgaagcgcgggaaccgattagcgaaatttacggctattatcccgctaaccggaccgcccagctgctgcgagagcaagttaactgggacttacagttacaacagatattgtggacgaagctagtggctaataaaatcatcaatcggattaacgttttgaatttactagatcattcgactgatgaactagtaacggaattggaaaaattggaattgaatgatttaactaatcgggaagcggtggtagcgcacaaatattttccgttattgtttgaaagcggttttacgaggaggggcggttcggtaattaacgcggcgttaaactatggttactcaattttattgtcggccgtaaaccaagaaatcgtggcgaatggctacgttacatatttagggattcatcatgatagcgaggaaaatcagtttaacttggcttcagacttgatggaaccctttcggccggttgtggattgctgggtggcaaatcaaaaatttaatcaacttacgcctgacattaagtatgggttggtggaacttttgagtttggaacttaagtacaacggcaagaagacgattttacgtaatgcgattaccgatcacgtacggaattgtttgaagtatttagcggggaaagctaatagttttacgattgaaatggagttaagcgatgaggtaccgaataatgcgattaatgataatgtttgatttaccagttgagacggcggtgcaaagaaaacagtaccgacaatttagaaaagcgctaattaacgaaggctttttgatgattcaatattctgtttatgttcgcgtatgcgtgaataaaaaatcggcgacgtttatggaaaaccgcatcaaaacttatttacctgaaaatggcacaattcaggcccttacgttaactgaaaagcagtataatgacatgcactttttggttggtgaacgggtaaaagacgtgcgcaatacctctgatcggacggtgatcctatgaaactaacgtatcgaactcatgaaccggtggaaattaaacctcaagcgattacggttttgggaaccaataattctacggtttataccgatttagtaaatggtatgcagggacgtaacgaattgattttagcttttgatgaaaactacaaagaactcgaaattagtaaagttttcgattggattggcgacgtaggaacccaggacttagttattcaaaaatatttaactaagattgaacgagtttttgccgaagggttggtggatgagcaacgtaaccaaattcatgatcaggtaaaccaactatttaatacggttgctgaacaattatttatgctagatttaccgattagcgtcaattatgattttgatttgaaaaagttattgaagtattgtggagtgcactttgatccgctaagcgtgggtaacccatatggtataattgaagcgattttgaagactcacgaggagtgcgcgattaattcgtgtgtcgtgttaactaatgttgcacattatttgacagcgaccaaaattgaagaacttacccagctagtaagtcaaacgaatcaagcactcttactaattgaattcacagaaataggcaatcaggaggcctatggaaatagcgaattctactacattgacaatgactttgttgattggcatcagtaattgatgaaattttagttagaaaataacggtttcagaaggatgttaaatcaataaggttaagattaatttagagctgtatttgaataagcaccctgtttcagaaggatgttaaatcaataaggttaagattagcatgtcggcactcgtcccgcctacccgtgtttcagaaggatgttaaatcaataaggttaagatcgtctggggttaagattgcgactgtgtcgcagtttcagaaggatgttaaatcaataaggttaagatcgttcccacatgagtgattactggaatgcgcgtttcagaaggatgttaaatcaataaggttaagatcgttcagtgttgagattgtaggaaattgttagtttcagaaggatgttaaatcaataaggttaagatcggtcgtttattgaaattagaaacgcggttagtttcagaaggatgttaaatcaataaggttaagatcacgatttaccgttttaggaatgatttagatgtttcagagaatgttaaatcaataaggttggcaatgaaaaaaaggggagtttaataattaatgctcatagagtttaaatttggtataatgcgaaatggaatttgagaatgatttggtattggcgatttactcacaataaaaataagttgcttttattgtttcagaaggatgttaaatcaataaggttaagcgtagagctaaaaatcttagctcaacgaaaaacgaaaactcctataagttaatgattactttaacttataggagctttttgtagttagagaaggatgttaaataattgaataatgcgtcttattgcgagagacaataaacattatttaaaattgaatacgagagtaacgttaatttttgaacagctctcaaaaaagaagagtagaaagataagtttgtttgtaaaattaaagttaagcttttttctcataatttatgacttcctttgtatttgttttataaatttataataaaagcaaaatttcattttatcaaaatcatcaacaattttcgaaattattataccccataaacttagaaatcacaataaaataagtacagcgaccttatattttatccagtagaacacattaaataactgatataaagaaaaaactacagacaacaaaaacagcccaaccgaatcccaatccagtcagaccgtcttaaatttcctacatcactagcggcaataccaccaggccgttcatcaaaatgtgtgcgatcattgaagtttggatgcgtcccgttttatggtacagccagcaaaatagcagcccaatcgcggcgtataaaaagatgtggctatcgttatgcatgaaggcgaacgctaagctggaaatgatcgccatgatcgtcaaacctaagttcgagcgcatcccgaacaaagtgcttaaattaccaaacaaaactttccgaaaaactaactcttccataatgggcgccccaacggtgattgccaacacaaaaaacgggttgattttcgctagggtaactaacgtagctgtgttcgcggaagcagggttttgccccagaataaaagtgacgtagctaaccacaaactggagcacgatcactaacgcggtcccaatgatcccccacgcaattgcccggaagaaggggattcgccgagtttcaatttgattgatttcactatttttcaggttaataactaccagcagggcagctccgactaggtaatcgatagtttccacccagataaatgatgcacccaaccgaacgaaaaggttgataacgctcggtagcaagaaaattgctaaataagtgattaaagttaataaagaacttttgctaattttcatcgtgacactcctttatttcttgtaagtatagcatatttgaacggttgttatatttgattggttaatattggtcaaaaacacttgcattctattaaaaacatgatatagttatcagtgtagttagcacttaggtataacgagtgctaaataaatcatgcatttaattatcagaaatttggagggattcacgtgttaaaacctttaggagatcgcgttattttagaagctaaagacgaagaagaacaaactgtcggaggcatcgttctggcaagtaatgctaaagaaaagtcccaaaccggtaaagttgtcgctgtaggtaacggtcgcgttttagatgacggaaagacgttaccaatgaacgttaaagtaggcgacacagtagtttacgataaatatgcaggaacagaagtaacatacgaagatcaaaaatatttagttgtccatgaaaaggatttagttgcagttgttgaataattaatttaaaggagtgttgatcatggctaaagaaattaagttttcagaagatgcacgcacaaagatgctaaaaggggtcgacaaattagcagataccgttaagtcgactattggaccaaagggacgtaacgttgttttggaacaatcatacggttcaccaacaatcactaacgatggtgtaacaatcgctaagtcaattgaattagaagatcactttgaaaacatgggtgctaagttagtatccgaagttgcttctaagacaaacgacattgctggtgacggtactacaactgcgacagtacttacccaagcaattgttaacgaaggtatgaagaacgttactgctggtgctaacccagttgggattcgtcgtggtattgaaaaggctactgaaaaagcagttgccgcattgcacaacatgtcacacgaagtaaagacaaaggatgacatcgcacaaattgcttcaatttcttctgctaacccagaagttggtaagttgattgcggacgcaatggaaaaggttggtaacgacggagttatcactattgaagaatctcgtggagttgacacaaccctcgacgttgttgaaggtatgcaattcgatcgtggttacatgtcacaatacatggttactgacaacgacaagatggaagctaacctcgacaacccatacatcttaattactgacaagaagattgctaacatccaagacatcttgccattacttcaatcagtggttgaacaaagccgttcacttttgatcattgctgatgacattactggtgaagcattgccaaccttggtattgaacaagatgcgtggtactttcaacgtggttgctgttaaggcacctggttttggtgaccgtcgtaaggaacaacttgaagatattgccatcttaactggtggtacagttatcactgacgaccttggcttgaacttgaaggacgttacaatcgaacaattaggtcaagcaaataaggttacggttactaaggacgacacaaccatcgttgaaggttctggtagccaagaacaaatcgctgaacgggttgcaatgatcaagcaacaaatcagtgaaacaacttctgactttgacaaggaaaaacttcaagaacgtcttgctaagctagctggtggggttgcagttatccgggttggtgctgctactgaaaccgaattgaaggaaaagaagtaccgtatcgaagatgctttgaacgctactcgtgctgctgttgaagaaggattcgttcctggtggtggtacagcacttgttaacgtgattgcttccttggaagaccttgacgcagaaggcgacgaattaacaggtatcaacatcgttcgtcgtgctcttgaagaaccagttcgccaaattgctgaaaacgctggtgaagaaggttccgtcatcgttacaaaacttaagacacaaaaagatggtgttggttacaacgctgcaactgacgaatgggttgatatgattgaagctggtatcgttgacccaactaaggttactcgttcagcacttcaaaacgctgctagtgtatccgcattgttattaacaacggaagcggtagttgctgacttaccagaagaaaagccggcagctccagcagctccaaacccaggtatgggcggaatgatgtaattaaactttcgtgactgatggagatgcttaccgaaaatggtaaaccatcgccgcaattaatcactgaaggcaactgaataatccaggaaaagacgcgcaatgcgcgtctttttttgtgtccaaatgctggggcaaagggttatcgcaaaatctctttaaaagttaatcaggaattttgttttatttgtctaaattctgttattatcagtatatgagtgagaatccaaaaatatgctagctaatttactggttttggagtagaatttcacttgcatatttttaaaaacggagagtaaaaaatgttttcgtatttgaaacgtattttaattggtaaaccactgaagacgttagacgaaagtggccaagcgttaacgaaatttaaggcgctcgctctgctatcttcagatgctttatcatctatcgcatatggtaccgaagaaattctttcggttttaattgttttatcagctgcggcaacttggtattcaatcccgatcgcagcaatcgtgttagtgctattatttgcaattacggtgtcatatcgtcagattattaaggcgtatccttcgggaggcggtgcttacgtagttgctagcaagaactgggggacttcggccgggctagtcgccggggggtcgctgttagttgattacatgctgacggtggccgtaagtgtgacttccggaaccgaagcgattacctcggcgattccggcgttacagaagtatcacgtggccatcgcggtgctgattgtgctcggaattatggccctgaacttgcgagggttgcgggaatcggcaagtttccttaccatcccggtttacctgttcgtagtggtaatctcgataatgattattgtagggttatataacatcgttaccggacaagttacttatcatgcggcggcagcaattggctcgaccgtgccgggaatgaccttcgtgctcttcatgcgggcgttatcttctggatcatcttccctaactggggtagaagcgattagtaacgcggtgcctaatttcaagaaaccgcggcggaaaaatgcggcagctactttggcaatcatgtcgttgattttggcttcgttcttcgcgggaatcacgttcttagcttactacagcggaattacgccgatgagttcgcaaaccgtgctttcccaaatcggggttacggtcttcggccacgggattttctactatatcctacaattgtcaaccgcgttgattttggcggtagccgcaaacaccgggttctcggcctttccaatgttagcctacaacttggccaaggataagttcatgccccatgcttacatggatcggggcgaccgactcggctactctaacggaatcatttcgttagccgcgggcgcaatcgtgctgattttgattttcggtggacaaaccggtctcttaatcccgctttatgctattggggttttcgtaccgttcacgttgtcacaatccggaatgatcgtgcattggaaacgagaaggcggcgctcattggtggataaatgcttctgctaacttactaggagcgttactatcggcagtcttagtagtctgcttgctattcctacactttagcaacgtttggccatacttcgtggttatgccactgttattgcggatgttctacaagattcgtaagcactatgacgaagtcgctgaccaactgcgggttgtggaaaagggcaaggttaacttgcacgactatgacggttcaaccgtaattgtgttggttagcaacgttacccaagtaacttctggtgcgatcaactacgctcggtcaatcggggactacgtaatcgccatgcacgtttcgtttgatgctaacccagaaaaagagcataagacggcgatggaatttaaagcggaatatccggatgttcggtttatcgacattcactcgtcgtaccgttcgattaccaatccgacgcttcggttctgtgacgtaattgctaaacgggcggcggaacggaattacaccacgacggtattggttccgcaattcgttccccgcaaaccatggcaaaacattttgcataaccaaactggtttacgattacgggcggcattaaattcacgcgaaaacattattgtttccacgtataattatcatttgaaataaaagtaaacgggttaatgaagtgagtttccttaacccgttttttgtgcaaagactccgggaaaaacttcgttgaagtgaatagatgttatttttctgtggaaacgttgtcgttttaaaatgaaaattatcgttaaattatgtgagttttcggtgaagttactgtataaggcatgcaaatttcggtataatgagcttattatgaacataaaagaggacaaattatgcgatttgaaatagttgtcagtttatttgcaaccatgatcatttcggcgattttaacaccatttgtccgaagaattgcttttaaaattggagcggttgataagccgaacgctcggcgggttaataaagtgccgatgccgacgatgggcgggttagcaatcttcttggcatttaatttctcactctttttcttactaagaaatcaaattcctaacccgcaattttacggaatcttcttcggcgaatgtataattatgttaaccggaattattgatgatatttttgaattaaaaccttcgcagaaaatgattggaatcttactcgcagctttagcggtgtattggtttgcggaagtgcaaatgacgaccttgactttaccgtttattgggattgtccatttgggatggttttcgttaccaattaccctaatttggattgccgcgattactaacgcgattaacctattggacggtctagacgggttggctaccggggtcaccatcattgcgctatttacgaccgggtttaccggattgttctttttaccatccactaatatttacattgtaattatgatttttacgttagtggctgcagaagtgggctttttgccatataatttcttcccggcccgcatttatttgggggataccggggcgttatttattggatttatgattgcggtcttttcgctttcaggattgaaaaacgccaccttcatttccgtcttaatcccggtaatgattttaggagtgccgttaaccgacacaatttacgccattttgagacgactgctaaataaacaatcaattgcgcacgccgataagcgccatttgcaccaccgtttaatgcaaatgggattgacgcatcgacaaaccgtgttggtaatttatggtatttcaatgattttttcctttatcgcgttgctctacccgctttctacattgtggggctcggtattgttgacgatcggaattttagtgggaattgagttgtttgtggaagcaattgggctagtaggggaaaatcggaccccgatgctaagctggattaagcgactagttcggaccactacttctaaaactgctagcaatgaatttaaagaagaagatactttaaaagatcgggtgcgttcgcgtagtgaacgtcaccaacaaaaaaagcatcacgactgatgtagtaatccctaaaagttagattttggagatactatgtaaggcgtgatgcttttttgttaaataattactgaggttggtatggaacttgaacgcgttgttgtccgccgtctttaaagctaacgttgccactaaagagtccggttagttctgcctttaaatcggccacttggtcctggtcgacggctacggtggtgattacctgggtggtatactcgtgattcacctgggtaatttggtgttgttcgaggtagtaggttaactgatcgttattttggtaatcaatggtgattgctagcaattcttggtctaccgattccattagggtagcagattgcacagcaagagaagtactcgatccgtaagcccggatcaacccgccggcgcctaatttgatgccgccgaagtaccgggtgaccactaccaaaacgtttgttagattttcgcgttttaaaacttcaaggatgggcgcgcccgccgtgccagaaggttcgccatcgtccgaagctcgttgaatatcttggtggtctccaagcacgtaagcaaaacaattatgggtagctttagcttcgatttcacggatatcttgcagtttagtttgggcttcttcttcggtttgtaccggaataatccggctaatgaaacgggatttcttaatgtcttgttcagtggtaaccggttctttgacggataaaattaatttcaagaaaaggtctcctttttaagtatcttatagtatggaagcaaaggttaaagaaaaatattacggccggctagtaccggttaatcaggcggaagctactgatccaacggttaattattttccagccgttatcgtaaaaaaacggcggatccaatgtcagcgctgtggagcgactaccaaattaaaggagggcagcttacccaaccagcagtattattgtcgacactgtataaatctcggtcgaatgtccacattggttaagttaggaaacttgcctgaaccgaatcactttcctgtgggccgttcgtatttaaagtggcaagggcagctaaccccggaccaacagcgttgcgccaacgaaattatttcgtcaattaaacagcaaacggatcggctgctgtgggccgttacgggggcgggaaaaaccgaaatgctttttccgggaattaactttgcgttaaaaaaggcgctccgggttgcaattgcctctccacgtatcgatgtagttttagaactgcacccccggattcaagcggcgtttccggaaattgcgatcgcattattacacgggcgcacttccactccctatacgtatacacagttagttttatgcactacgcaccagctacttcgattttaccacgcctttgacgttttaatcattgacgaagtggattcgtttccctttgcaatgaatccagcattacactacgcggcgcaccaagcgcgtaaggagtgcggtacgaccatttacttgacggccacgccagacggtcaattgttaaaggatagtcggtcccaccggttgcctactagctatttaacccgccggtttcacgggcacccgctaccagaaattaaaatggttagtgggtgcaattggcaaaaattaattcaccgccggcggcttccggaacgactacgccaatttctaatggctcaagcaaaggcacagcggcaatttttagtctttgttccgcgaattgaccagttgtcttcagttttgcaggccattcaaaaacaattcccggagcttgatttagcaacggtgtacgcagaagacccggaccggattgagaaggtttcagcaatgcgggaaggtcagcttaccggtttaattacgaccaccattttggaacgcggggttacctttccgggaattgatgtagcagttttaggtgcggatgatgaaatcttttccatggctgccctcgtacaaattgctggaagggtcgggcgcagtcctaaacgaccaaccggaaccgtcttatttatcggccaaatgttaacccgccggattaaaagggcccaacgccagattaaatttatgaaccagcaggcctttaagcaatgaaccgctgtttattatgcagtcgaatgctgaatagacgagttgacctatcctttatccttagctttcaacgggcgcaaccgcagttgctttgtcacaactgtcgaaaccagttagttaatttgcaggagcgtaaagtttgtgtaagctgcggacgactagctaaccagttacagtgctcagattgccaaaaatggaatgaccaatttaacaatcaagcactttttcaatacaacgcgttcatgaaggaattttttcagcgttataaatttcagggagactactggttgcgtaaagctttttgcaacgattttatcaattttattcaaagtttagttaaagaagatgaacatttagtaccaattccggtcgatcaaggtacaataaaggtacggggatttaatcaggtggcggggttaatagaaggtctggaatttgagcccgttttaattagccaacgctctgaacaagcccgccatcagtttcaacgtagccgtcgggaacggttgcaacgtgaaaatcctttccgggttgttgaacctaataaagtcgccggagccaaatgggtaattattgatgatatttacaccactggggtaaccgttcgccaagccggacgggagcttagtaagcatggtgcgcgtcaagttcgttcaattacgctttgccgatagtttttgagtgtattaattgtttattatagcgttttcatttataatataagtgtacagaaatacatgaagtaaaacttatatttctgcacgtggacgcactttgttcacagttgaaaggagagagtcttatgcttgattttaatgtacgtggtgaaaatattgaagtaacagaatcaattcgagattacgttgaaaaaagaattggtaaaatcgaaaagtactttgatcaaggtgctaacccaaaggcacacgtaaatttgaaggtataccaagatcggacagctaaagtagaagttaccataccattaccatacttggtattacgagcagaagagacatcgcctgatttgtacgcaagcgtggatttagtaacggacaaattagaacgacaaattcgtaaatacaaaactaaaattaatcgtaaatcacgggaaacgggttataagggagttgaaatcccacaagaagacgcacgtgaagacgaagaagaggccagtgaatttgatattgtgcggactaagcaagtatccttgaagccgatgggggctgaagaagcaatcttgcagatggacatgttaggccataacttctttatttacgaagacgctgatacaggatcggttgatattgtttatcggcgtcacgacggtcgctatggtttaattgaatccgctaacgaataattgtgaatgttaaaaataaggattgcttaatagaccacacatggtttgttaagctttttttgatgaactttgataatatagaaaaaaatgataaacttagacaagtttatcgtggacacgatttagaagagtacggaaggaattatacatggcaaacattttaaaaaaatgggttgaaagtgatgcccgtgaaatcaaacggctaggaaaaaaagccgacaaaattgatgcccttaaggatgaaatggcacaattaagtgacgaagaattaaaggcaaaaacgccagaatttaaggaacgtttaaaaaatggggaaaccctcgatgatattttaattgaagccttcgcggttgcccgggaaggtgccaaacgcgtgttgggactattcccttttcgggtgcaattaattggtggaatggttctccatggcggaaatattgccgaaatgaagactggtgaaggaaagactttgaccgctacactaccagtgtaccttaacgccctaggcggcgaaggggtccacgtagttaccgttaacgaatacttagcggaacgggactctactgaaatgggtgagttatacaagtggcttggtttgacggttggggttaacacggcagaaatgtcccctgacgaaaaacgggaagcctacaattgtgacattacctactccaccaatagtgaaatcgggttcgattatttgcgggataacatggttgtgtacaaggaagatatggtacaacgaccattgaacttcgcgttaattgatgaggttgactcggtattaattgatgaagcccggactccgttgattatttctggacaaactgaaccttcggttaccttataccaacgtgcggaccgcttcgtgaagacccttaccgatggcgattacacgattgattgggaatctaagtcaatttcattgaccgaaaacggaattcgacgtggtgaaaagtatttcaacacggataatttatacgatgtagaaaacagcgccttgaatcaccacattgaccaagcacttcgggccaactacatcatgaccaaggataaggactacgtggtctctgatgatggtgaagtactaattgttgattcgtttaccggacgggtcatggaaggccggcgtttttctgacggtcttcaccaagcaattgaagctaaggaacacgttgaaattcaagatggttccaagaccatggctaacattacctaccaaaacttgttccggatgtataagaaattatccgggatgaccgggacggcgcaaacggaggcggaagaattccgcgaaatttataacatggaagtggttagtgtaccaactaaccggccagtagtccgggacgaccgccctgatttactatacccaactttggaaagtaagtttaaagcggtagttaaggaaattaaaaagttgcatactaagggacaaccggtgctggttggtaccgtggcggttgaaacttccgaatacctatcccggttattagaccgtgaacggattccgcacgtagttttgaacgcgaaaaaccacgctcgcgaagctgaaattgttgctaacgcgggccaaaagggtgccgtaaccatcgcgactaacatggctggacggggaaccgatattaaattgggacctggtgtagtcgaactcggcgggttagccgtaatcggtaccgagcgtcacgaatctcggcggattgacaaccagttgcggggacgttctggacggcaaggtgacgtcgggatgtcgcaattctacctttcactagaagacgacttgatgattcgctttggttctgaacgaattaaggacttgctttcccggatgaaggtagcggatgaagacgcggtaatccaaagccgtttgattagccgccaagtggaatctgcccaaaaacgggttgaaggtaacaactacgacgcgcggaagaacgtcttacaatacgatgacgtaatgcgggcgcaacgggaagttatctacgcggaacggcaacaagtaattatggaagaacacagtctaaaagatgtgctaatgccgatggtttaccggacgattgaccgggtggtagacgcgcatacggccaagacgaagaagagttacgacctagatacgattgtggaatttgcccggaccaccttggtaaacgaaaatgatattaacattgaggacttagaaggcaagtcggctaacgaaatcaaggattacttgaagcagctagcagaccagatgtacaagcaaaaggaagatgcgttgtacgcgcctgaacaaattctcgaatttgaaaaagtagttatcttacgagtggttgaccaacactggaccgaccacattgacgcgatggatcaattacgtcaatcagttggactacggggttatggtcaattaaacccactagttgaataccaacaagaaggctaccggatgttcaacgaaatggttacggacattgagtacgaaactacccgactcttcatgaagtcggaaattcgacaaaaccttgaacgttagtagctttataatataaactggggaggcggcaaagctgacccagtttttttagttaaaagaaaaaaggagtagatgaaatggagctaacggacgcaaaacatcaaattgaagatatgcaaaaagaggtcgctgacttcgggaggtctctttgacttagatgcgttgaacgaaagcatcagtgttaacgaggcaaagatggcggaacctgatttctggaatgatcaggaaaaagcccaaaaaataattaacgaaactaacgtattaaaagctaaatacgacaattataaaaatttaactgaccatgtggaaaacttagaggtcaccctagaactattggaaatggaagcggaccccgacgtgcaggcggagtttgaagacgaactttcccaaacggccaaactgttgcgtgactaccggttagggctgttgctgaatggcaagtacgatgccaataatgccattttggaaattcatccgggagctggcggaaccgaatcccaagactggggctcgatgttactgcggatgtatacccgctgggcggaacggcaccaattcaaggtccaaattgaagattaccaagccggcgaagttgccggaattagtagtgttacaatacgggtgatgggccataacgcctacggctacctacgttcggaaaaaggggttcaccgcctcgtgcggttatcgcctttcgattcagccgggcggcggcacacctcgtttgcttcggtagacgtaatgccagaattagacgactcggtagaagttaacattaacccagacgatttacgggtggacgtttaccgctctagcggggccggcgggcagcatattaacaaaacttcttcggctgttcggattactcatttgccaaccggaatcgtggtcgctagccaagcggaacggtcccaattgcaaaaccgggttaccgcgatgaatatgttaaaggccaagttgttcgagttagaagagcagaaaaaggccgaagaaaaggctaagttagagggaacccagctagaaatcggttggggatcccaaattcgctcttatgtttttcatccgtattcaatggtcaaggatcaccgaaccaatttagaaactgcgaatgtgcaaggtgtgatggacggcaatctggatgactttattaacgcttatttacaatggaagttgcagaaacgtaatcctaaataggagattttttcatggcaatgacaattttagtggtcgatgatgaaccggcaatcgttacactcttaacgtacaatttaaaacaggctaattatcaagtgattagcgtagacaacggggttgatgctgttaaagaagtgcaacgcgggaaggtcgattttgtgattatggacttgatgctgccccagttggacggggtcgaagctacgaaacaaatccgtaagttcaacgaacaaattccgattattatgttgacggctaaatctaacgaagtggataagattttaggactagaattaggggcggacgactacttaaccaaaccgtttagcccacaggaattaatttcccggattaaggctattttgcggcggactaaccgggtggtcgacttaaaggaaattgtccctgaattacctgccacgggaattacgattgattttaagcgactaacggtacaaaaaaatgggcaaccggtggctttaacacccaatgaatttcggttgttgaagtttttgtttcaaaatagtaaccaagttttatcacgggatcaaatcctcgaacaggtttggggatacgagtatggcgggcagacgcgcattgtggatatgcacatcagccatttacgcgacaagctggaagatgatccaaaacatccacggttgattaaaactattagggggttcggttatgagttcttcacaaaagaagggcattagaaaaaccattcagtttgggctagcaagtttgattgggaacgcgtttatggcctttctggtttataaattaattgttaaggaaaacccgcgggtcacccgggtcgacatgaccttaatgattgcggtaattttattgattaccgtgattgaagtgattgttttttggagtaatcaaaagaacatcattgagcggcaacaccagttccgaattaacctggaagagaccattaaagggaataaggttcctaaaatttacctggatccagacgaccccttttataaattatctaaggccgttaatgaaattagtaaacacgagcgtcaccaaattcacgagttgaccaaccaacaaaatgaattaaaagcgattatggataacttaccggtgggagtgttagtaatcaatcgacaccgggagttacaggtggcgaatacttacgccattaaccggttaggaatcacggcgctcgatattccgcacccttacacgttagacgtgcgaaatcaggagctcagaaacttagttgaccaagttttccaaagtcgccaaagcgtcactaaaacactcgaactggaagacggcgggcaatcttatatttttgaaactaacgtagtttacagtcccaaagtgcaccacaagtttgaaattatcgtgttgctttacgacgtaactgaaagcgtacggtcgaaacgaattgaacaggattttgttaacaacgcctctcatgagttgcggaccccaatcacttcaattgctggatttgcggaaacgttgttggagggcgccaaagacgatcccgaaacgctggataactttttaaatattattaagtcggaaagtgacaaattagtgcgcctggcggatgatattttgaccatgtcccaggttaaaaatgaaccaaagacctggaagaaagttaacttgtacgcttacgtggaacagcaatttcacatgttacaaaacaatttacaagaaatgcagttgacggtggaaaataaaattccggaaacggccatggaaaccgtggtagaaaacgaccttttccaaatcactaagaatttgattactaacgcgattagttacaatcgccatggtggaaagattaaggtcgaatacgcttcgcaccacgatagttgggaattgtcagttagtgataccggaatcggaattccgttagatcagtctgaacgagttttcgagcgcttttaccgggttaacaatgcggtgaagggcggaaccggcctggggttagccattgttaaggaagccgtcgtggatatgggcggtagcgttcggattgaatcggacgatgacgatagtggaaccaccgtcgtagttcggtttaagcgccgggtttaaaataataatttgcacaattaaggtgtcggaaaattccgacgcctttttttgttgactttgacgatgtaaaagtaagtttttgctcatggggatgtggataacttagctaatcttggcgttagtttcgacatctttacataatctttacattacccatatggaacctttacctagctttcataagctaaatatgtaagtaaggaacaggaaaaacgggaggttcgctaatgaataaatggcttaagttgctacttagttgcggattaattttgggaattgggttacttgcgggttgccagaataaagacgccacccaaaaagtaaccatcgtcggttcgactgcgttacaacccttggtggaaaaagcggcggcagattatcaggtaactcatccgcaagcacagatcaccgtgcagggtggcggatcgggtaccggacttggtcaagttcaacaaggagcggtacaaatcggaaactctgatgtatatgctgggcaacaagatgggattcgagctagtcaattaaaggatcaccaagtggcggtagtcggcattgcacccgtggtcaataaagacgcggggattaagaatttgtccatgaccgagttacaaaaaattttcacgggaaagatcaccaattggaaacaggtgggcggcccggatgaaaaaattgtgataatcaatcgggcccaaggcagcggaatccggaaaacgtttgaacagacggttttaccgcatggtggcgcggtaaatgctcaggaacaggatgctaacggaacggtgcaaaaggtggtgcaggcaactcccggggcaatcagttatctgtccttttcatatttcaataagcagttacagccaattgcgatcgacggagtacaacccaccgcggaaaacgtgcaaactaaccggtggaaaatttggtcgtatgagcacatgtacacccagctgaaaactaactcagcaacccgagacttccttaagtacatgacgtcccagacggtacaaaaaaatttagtgagtgatttaggatacatttccattcatgatatgcaagtgaaacggaccatggacggaaaagtgattccgatcaggggggagcaaaatgattgatgaaattcaaaaggaattaacccaaaagtcacaagccgcgcggcaagatcaattgggcaaattaatcgcccggatttgtgtgggagtaattatgctagtagttctagcaatcttattcatgatcacttccaaaggcttagcaactttttcagaaaacaaaatcagtgtaggcgattttttcaccaaaacaatctggaatccgactgctaatccgaccccgttagtgggcgcattaccgatgattgtcggttcttttgcagtaaccctgggctcggcacttttggcagcgcctttggcaatggcaacggccatcttcatggtggaaattgcaaacaaacggcgtcggggccttcttcaagcggtaattgagttactagtgggaatcccatcggtagtttacgggttcgtcggcttaacggtggtggtccccgctctccgtagtattttcggtggaaccggttttggaatcttagccggcgccctagtgttattggtaatgattttgccaaccgtaaccgcaatgtacgtggatagtttacaagcagttccccgtcactatcgggaagcttccttagcgttaggggcaacccgttggcagacaatttctaaagtagtggtgcgtgcttccttacccgggttgttaacggcgattatttttgggatggcccgtgcctttggcgaagcactcgcggtacaaatggtaatcggaaacgcagcggttttgccaaaagacgttttgactccggcggctacgttgactagtgttttaacgactggaatcgggaatacagtgttggacactttaccaaacaacgccctgtggtccttagctctggtactgttgataatgtcactatttttcaacctattaattcggatgattggcaaaaagggggcgtttaaatgaaggcgaaacgaattgaccggattgcaaccggggtaatttacgcaatggtgggattggtcgttttaatcctaattgggttgctaggttttatcttagcgaccggattaccacacgtatcgtggcgatttctgacatcttcggcggccgcctttagtgcaggaggcggcattggggatcaattgtttaactcattttatttattggtgctaaccctgatactatccttaccgattgcgttaggagcagcaatttatttaaacgagtatgcgccccaaaataaaattaccgaaattatgcgaatcatgattgaagtgttgagttcgttgccttcggtagtggtcgggttgtttggcttcttacttttcgtggtgcagtttcaactaggattttccattctttcaggtgcaattgccctaacgctattcaatttaccactgttaacccgtagcattgaaaatgccttggcaggggtgcctgatttacaacgagaagcaggtttagcgttggggatttcccggtggcacacgattaccaaggtaattctaccagctgccttacccgggattttaactggagtaattctgagtgcgggacgggtgttcggggaagccgctgcactaatttttaccgcgggacaaagcgcaccaagtttaaattacgccgattggaacccgcttagcagcactagtccactgaatatttttcgaccggcggaaacccttgccgtccacatttggaagattaacacggagggaatcatgcccgatgctagccaggtatctgcaggagcttctgcagttttgattattgtaattttaatatttaatttcagcgctcggcgcttaggtaactgggtataccggcgaattactgcgagccgatagggggatgaatgcaatgcaaaccaacgttaatgaaagttcaatcttaaggtttccaactaaccgtgaaattgcactggaaactcacgatttacaggtattctatggggaaaagcaagccctttttgacgcctcgctacagttcccccggtattcaattacagcgttaattggtgcctcgggatcgggaaagtcgacctacttacgcagcttgaaccggatgaacgatggcattgcgcgagtaaccggtagcattacgtaccgggggttagatattaatacgaataacgttgatatttaccaaatgcggcgccggatcgggatggtttttcaacgtcccaacccgtttgctaagtcaatcgaacgtaacatcacctttccattacgcgagcatgggataagggattccgcgcaactagctgaagtggccgagacgagtttacgacaagctgccctgtgggatgaagtgcatgaccgcttaaatgcaagtgccttagcactctcgggcggacaacaacagcgcttgtgcattgcccgggcgttggcgatgaatcccgacattctactgttagatgagccggccagcgcgctagatccggtgtcgaccgctaagattgaaaccacgctgcgagaattaaaaaagcggtatacgatcatcatcgttacgcatagcatggagcaggcgtcacgattaagcgattatacggcgttcatgcatttagggaagattgtagaatttgatacaaccaagaatatttttaccaatccccgtgaaaaattgacggaagactatatttcaggaaactttggttaaaggagaagggtaatgagtaataacgtggtaactgcagaagacgtgcgcttatcttatgggaaaacggaggctttacacggaattaaccttaacttgccaaaaaaccaaattacggcgttaattggtccgtcgggaagtggcaaatcaacctttttacgttgtttgaaccggatgaacgatttaattccagaagtgcgggtgaccggaacgattcgggttgcggggcaggacatttacgatgctcaaactgacgaagcggatttaagacggcgggtcggcatggttttccaacaacccaacccctttccattttcggtttatgacaacgtcacctacgggctccgccttgcgggaatcactgacccccaagttttagcggaacgggtggagacgagtctgaaacaggccgcggtttggcaagaaactaaagatcatttaaaaagcaacgccctttctttttcgggcgggcagcagcagcggatctgcattgcccgggtgttagcggttcaaccggaaattattcttttagatgaaccaactagtgcgctagacccgatttcggcggggaaggtggaagaaagtttggtggctttgaaagaaaattacacattagcggtagtgacccacaatatgcaacaggcctctcgaatttcggatcagacggcgttctttttaaacgggcagttagtggaagcagggccaactgctaaactatttttaaatccggatcagacggcaacgagtgattacttgaacggtaaatttggttaagggggaattggtatgcaaggaatttttaaggaagagcttaagcggctattagaacagttcacggaaatgggactggacgtgggggaacaaatttatcaggcaaccaaatcttttattgaccacgatcgtgagctagctcagtccgtgattgaacacgatgaaaaagtcaacgttgccgaagtgcggttagaagatcaggcaattaatttgatggcgctgcaacaaccagtggctaatgattttcgacaggtgatcgtagttttaaaggcgagttcggaactggaacgaatcggcgaccacgcggtggggattgccaaggaaacgatccgaattaaggggcatcagcgggatgcaataattgaagcagaaattgctgaaatgacccatttgattcgggggatgcttgacgcaacgattgacgcctacgttaaggatgacggccggcttgcaaaagaaattatcgatgcgaaccaccaaatcgaaaccagttttaaaaaaattcggcaaagcattgccagtaaaatgaaacacgacgccaaagtggtgactggagggaccggatatttaatggttgctagctatttggaacggattggcgaccacgtaattaacgtggtggagtggatcatgtacaaccagactggaaagattacggagttatccggggacaattaaaaataaacgggtggaggctgggaaaaaagtaaaaaatgcttttcaaggataaaaaggtccttaaaaagttgttttgatgttttgacttcaatagagccaaaacgtgtgccaaaagccagtttgttccgcttaaccaaaaattgaccatgatgccaaatccaggcatcatggtcaattttcagttaatgctcacaaactacccgacttttgtcccactctcgcttttttatttttatcatggaaaataacataagatgtgctgccttttaggggattaatttaaaattttggtaatacccgtactttttatggggataaagtttgctaatcgaaagtgaaaagctgtaaaattacagataattaaaaagcttagaggtgaaatgtttgaaatcaggtttcaaatcaaagtttacaaagtctaacgaccgttttgttgctggagtatgcggtggcattgcggagcattttggctgggataagtcccttacccgaatcattgcgttagtactaattttactatcacacgggttgttgttgattccatactttattttagcttggtacatgccaagtcaaaatacaggattctttcagcagtttgccaactggactggcttttcgggaaaaactcccggacaaaagcaatcacggcaaagaaaagaaattaaggacgccgaagtacacgacgtcgatgaataaaagattaggagaatgcaaatgcgcttttggcaacgagtattagtgaatggaattttatttgtcgctttaacgggatttttccaaaatagcggaaatttctacgtttctaacatttggattgcgttagcggcaagcctcgtcttggcgattttaaatgctagcgtgcggccagttttacaaattatttcgctaccaatcatgttattgaccttaggatttttcagcatcgtgattaacgcgttaatgctgacgttcacgtcggcgctggttggtcccgctaacttctatttttcgtcattcgggatgacgatgttgatctcggtgattttgtcgatttgtaacatgattatttcgaatcatttttccaatcgttattaaaggaggcccatcgtaatggccgatagtgtttcaattacagaattagttaaaaaaattaggctcgacgtattttatggggaagacctgttagataaaaagcaggttacggttagtgacatttcccggccgggattagaattaaccaattactttaaattttacccccgcgagcgaattcagttgtttggccaaaccgaaatttcgtacgcaaaggatagcatgacgagcgcggatcgcacggttgtctacagccaaatggcagataagcaaacgcccgccttcgtaatttcacggggacttccggtgcctaaggagttaattaaggcggcaaaggataacggagtgccgattttaacgtcgacccttccgacttcccggttgttaagtaacatgactaactacctagaagaccgtttagctgaacgggattcggttcacggtgaacttgtggaaatttacggactaggggtactgatcaccggtgattccggaatcgggaagagtgaaactgctctagaccttattaaacgcgggcaccggctgattgcggatgaccgggtcgatatttaccaacaagatgaacagaccttaattggggaagctccccaaattctccggcatttgttagagatccggggagtcggaattatcgacgtgatgaatttattcggggctagttcggttaagaacagtaccgatattaacctaatcgtccacttacaaaattgggataaagaaacccattttgatcggctcgggaatggtgaacaaacccggcatttctttgatttagacatccccaaaattacgattccggttcgtgttggacggaatctcggggacatcatcgaagccgccgcaatgaactttagggctaaaaatatgggttacgacgctacgaaggttttcgatcaaaaccttaacgcgttgattaaagataactcacaagcataggaagtggatttagtgaatttaagtgtcggagctttaaatccgattgcattttcgtgggggagcctccaggtgcactggtacggaattatcattgcctctgccgtggtcctggcaaccattctagcggttcgggaagcgcgacgccggcgcgtggatcccgatcgcatctatgatttgattttatggtcgctaccggtggccattattagtgctcgcgcctactacgtgatttttgaatggggttactaccaaaaccacctttccgaaatcattcgggtttgggacggtggaattgcgatttacggtgcgttgattggtgcgggaatcgtggtttacctattttgtcggtactactggattccggtttggttgatgttggatatcattgctccggtgctgatcatggctcaaggaattggccggtggggtaactttatgaatcaggaagcctttgggcgagtgaccagcctagcttttctgcaaagtttacacctgccgcactttattattcagcagatgtggatcaacggcgcgtttcgccaaccaaccttcctgtatgaatccgtatgggacattttaggctttattgtgttaatgagtttacgtcacgtaccgaaactttttaaacaaggtgaaatctttttgagctacgtgatttggtattctttcggacggttcttcgtggaaggaatgcgaacggatagccttatgttattggggattcgggtctcccaatggttgtcggtagtgttatttatgggcgcgattggcctgttgatttggcgccgaacgcgggtccaaaatccggttcccgactacctggatggaaaccagttcgcaccaaaagaccttgagtaaagtacctttatatatgataatgagagggtacatatttttaaataattatattttatagattgtaaggggattaataatggcaaaaaaagttgcagtgttaggagccggttcatggggcagtattttagcaaacatgttggttcaaaatggcaatgatgtagttgcttggacaaacatggaggcgcaagctcaagagcttaacgaccaacacactaacgagcattacgtgccaggtttcaaatatgatgaacgtttagtagcaacgacggatctagaatttgcgttgaaagacgttgatgcggtgttattcgttgttcctactaaggtaatgcgcttagttgctcaacaaatggttgccgttttagaaaaaacaaagcaacaaccagtgattattcatgcaagtaagggacttgagttaggaacgcacaaacgtctttctgaagtattggaagaagaaattccaagccagtaccgaaaggcgatcgtggtcttgtctggcccaagtcatgctgaagaagttgctaaacaagacttgacgttggtaacggcggcaagcactgatttagcaagtgctgaaatggtccaaaaattatttatgaaccactatttccgcgtttacaccaatgacgacatcatcggcgtagagatgggggcggcgttgaagaacgtcattgcgattggcgcgggtgctttacacggccttggatacggggacgatgctaaagcagccctcattacccggggattagctgaaatatctcgtttaggggttgcctttggcgctaaaccgctaacctttattggtttatccggggttggtgatttgattgttacggctacgagtgttcattctcgaaactggcgggctggtaacgaacttggccaaggaatgcagctacaagaagttatcgatacgatggggatggtcatcgaagggattccttctaccaaggcagcttacgaattagcccaacaaaaacatatcgagatgccaattactgaagccatctacgatgtgttgtataatgataaaggtgttaaagaagtcattgatgaccttatgcaccgggatggaaaatcagaattagagtaaatatttggaggtttgagtttttatgacaaaagtacgtaaagcaatcataccagcagcgggattaggaacccgattcttaccagtaactaaggcttcgcctaaggaaatgttaccaatcgtggacaagcctacgattcaatacatcgtcgaagaagcacggaagtctggaattgaagatattttgatcattaccggaaaaggtaagcgggcaattgaagaccattttgacgcggttcctgaattggaagctaacttaaaggcaaagggcaagaagcaaatgttaaagatggttgaagaaaccaccggtctgaacatgtacttcaagcggcaaagtcatccccgtggtttaggggacgcggttttaactgcgaagacattcgttggtaacgaaccatttgtcgttatgttaggtgacgatttgatggaagacaaggttcccctaactaagcaactggttgattcgtttgaagatactggtgcttctacattagctgttttaccggttcctcacgaagaagtttcgaagtacggggttattgatccatctgaagaagtggaaaaaggcttgtacaacgtttctaagtttgtggaaaaacccgcagctgatgaagcaccaagtaacttagcgatcattggtcgttacgtacttactccagaaatctttaacattctcgaaaaccaaaaacctggtgaaggtaacgaaatccaattaaccgacgcaatcgatacgttaaacaagaagcaacgggtgtttgcgaaagtatttaacggtgaccgttacgacgtgggtaacaaatttggtttcttaaagaccaacattgaatatggtttgaagcatccagaaacaaaggatgaacttaaggcctacatcaaggaattggctaaaacgctcaaataaaaattaacataactatttaggggagactcggacttttggtcccgggctcccttatttattttctaagttgcttggtgacttgctaagcattaaaaatgcaatttttaaattagtgattataatacagaataatggacagttattaaaagtaagtgtatagtggattcattatcagatatggaggattattatggcaaagcaatatgatgtgatagtaatcggtgcggggccggctggaatgactgcggctttgtatgcatcgcgtgctaatttgtcggtgctgatgcttgatcgcgggatttatggcggccagatgaataatacggcagccatcgaaaattatccgggatttaagtccatcctgggaccagatttagcaaaagaaatgtacgaaagctccactcagtttggcgcagagtacgcttacggaagcgtcgaatcaattcgtgacgatggagccactaagttagtgaagaccgatatgggtgaagaatttatcggcaaggccatcatcattgggaccggctcagaatacaagaagctgggcgtgcctggtgaagaagactttagtggccggggagtttcctactgtgcggtatgtgatggtgctttctttaagggaatgcacttaatcgtggtcggcggtggtgactcagcgattgaagaaggtatttacctaactcaattggcatcgaaagttactgttattcaccggcgggaccaacttcgggcacaaaaaatcagccaagaccgggcgtttgctaaccccaagatggaatttatttggaacagcaacgtaaccgagatcgtgggtgatgataaagttaccggcgtaaaggttaaaaataaccaaactggcgaagattcttttattgaagctgcgggagtatttatctacgttggggtaaagccaatgaccgctccgtttaaggacttgggtattttagatgaaaacggctggattccaaccgacaacctaatgcacaccaaggttccgggaatttttgcagtcggtgacgtacggaagaaaaaccttcgccaagttgctacggcagttggagaaggtggcacggcgggacaacaagcttacgagtacattcaatcgttatcctaaaagtgtgaagtcattaatcatttaagaaaattatgaagcctccagaagccagggaaaaccttggtttctggaggcttttttggtgaactggagtggtttaataattaaaaacttttttatggattagctgtactttataattataggtagtggcagagtgcgatttttgggtaaaacgctttctgagtgactaatcgtattgtataataaaaattaagttactcacaccgaggaggaattttttaatgaactgggaagattcagttaaagaatggcaagattttgccgatttagattttaacttaaaacaagaattaaaagaattagcaaaggatccacaagcgctaaaagaggctttttatgcaccgatggaatttggaactgcaggaatgcggggagtaatgggtccgggaatcaaccggatgaacatttacacggttcgtcaagcaacggaaggtttagctaacttcatggacacgctaaatcccgaagacaagcaacggggagtagcaattagttttgactcccgttaccattcgcaagaatttgctttagaagctgcgggtgttttaggcaaccacgacattccaacgttcgtgtttgatagtatgcggcctactcccgaactttcttttacggttcgtgaactcgatacctacgctggtattatgattacggctagccacaaccctaagcaatataacgggtataaaatttacggtccggatggcgggcaaatgccaccaatggaatcggaccggattactgaatacattcggaaggtcaccgatatttttggcgtaaaagctttgacgcaaggccaactccgtgaaaagggcttaatgaccctaatcggcgaagacattgaccagaaataccttgcgcaagtaaagacggtttccatcaaccacgaccttattaaaaaatatggcgcagatatgaagttgatctattcgccacttcacggaactggaaaggtagtcggcggccgtgcccttgaaaatgccggtttcaaagattacacgatggtaccaaagcaagccattgcggatcctgaatttggcacaacaccattccccaacccggaatttgcccaaacttttgatttggcgattgagttaggtaaaaagcaacaggcagacctcttgatcgcgacggatcctgacgcggatcggctaggtgcggccgttcgtttaccaaatggcgattacaagttattgaccggaaatcaaattgcggcggtaatgctagaatacattttaaccgcccacgatgaagctggagacttaccaaagaacgctgcagccgtaaaatcaatcgtttctagtgaattagcaacccggattgcagaagctcatggcgtagaaatgattgacgttttgaccggatttaagtacattgccgatcaaatcaaacattatgaagaaaccaacgaacacacctttatgtttggctttgaagaaagttacggctaccttgttcggccatttgtccgagataaggatgctattcaagggattgtactattggcggaaattgccgcttattaccggagcaagggccaaaccctttatgatggggtacaaaacctcttcacaacgtatggctaccatgaagaaaaaaccatttcaaaagacttccctggtgtggatggtaaagcgaagatgacagcaatcatggaaaaggttcgtgaagaacgcccagaccattttgacgacgttgcggtggttgaaacccaagacttcttaagtcaaactaagtacgcagataatggcgaaacttcgccaatcgaattgccaaaggcggacgttttgaagtttaagttggcagatggctcatggattgcgatccgcccatccggaacggaaccaaagattaagttctatatcggagcggtaggcgaaagcgaagaagcaactttgaagaagatcgaaaactatgaaaaggcgattgatgggttaataaactagagtgcgcagggacccgggtagattttgaggattaactgaatatcgggactaatcgcggtttgagcgattggtcccgatatttggttaaccggagaaaactgggtaccggagcacgtttcggctatatagcagtgaagcacaagtttaactggattttaggtttgattgcggtttgagcgatcgaacctaaaatttggttaaccggaaaaaattgctggccggaattcgttttgactatgcggcagttgagcacaaggattaactgaatatcgggactaatcgcgatttgaacgattggtcccgatatttggttaaccagagaaatctgggtaccggagcacgtttgaacttatccatcaatttgataactcgataagcaaagattcggctaacggccggatcttttttagttttcagctgttttaaaaggggtgctgagccaagtttgttccccggcggaaaactttcacattccagtttatttgtgatagtatgttaacaatttaaatttatttagggggaattttttatggggatgcatcaattttttaaaagtttaagtaatttagaaacaatttaccgggcacccggattttttaagtatcaaaaacattcggttgcggaacattccttcaaagtggcggaaattgctcaatttttaggcgacgtggaagagcatgcgggaaaccaaattaattggcgtttactttatgaaaaatcccttaatcacgactataacgaacggtttatcggcgacatcaagacgccggttaagtatgcaacggccgacttgcgaaagatgctggcaaatgtagaagattcaatgaaggataatttcattaaaaatgaaattcctgctgaattccaagctgcttacgaacggcgtttgtcagagggcaaggatgacacgatcgaaggccagattttagcggtggcggataagattgacctgctttacgaatcgtttggtgaaatccaaaagggaaatccggaagacgtttataccgacatttataaggaaagcttaaccacgattgttaaatataaggacatgccgagtgtgcaatacttcctcgaaaaagttttacccgaattgttaaatgaagagtttacggaccaactaaaattagaaaaaattagtcgcacaattattcaatagcaaaaaaatagcgaaagtatgttcggtgtgatagaatagtggcagtaactcaaacgttaataatcaaatggctgagagccagaacctaacggggttcatctcagtttttttgtgtgaatgggggaaaaataatgattgaacgcgaggaaaatcggcagttcgaactagtttctaagtaccagcctaccggagaccaaccgacggcgattaaacaactagttgatgggatccagaagggtgaaaaagaacagattcttttgggtgcgaccggaactggaaagacttttaccatttcaaacgtaattcagcaggtcaacaagccgacgctgattttatcacataacaagacgctcgctggacaattgtatggtgaattcaaacaatttttcccaaataacgcagttgagtattttgttagttattacgactattaccaacccgaagcatacgtgccttctagtgacacttatattgaaaaagattcgtccattaacgacgaaatcgatgagctgcggcattcggcgacgagctcgctattggaacggaacgacgtgattgtggtggcctcagtttcgagtatctttggtttaggggacccgcgcgaatatcgtgaccaagccttatcactacgcgtggggcaagagattgaccgtaatcaattactccgagaattagtcgacattcaatatgaaagaaatgacattgattttcaacggggacgtttccgagtgcacggcgacgtggtggaaatcttcccggccgctaacgaagcccactcgatccgggtggaattctttggcgatgagattgaccggatgcgtgagatggacgccttaactggagaaattattggtgatcgcgatcacatcaccattttcccggcaacccactttatgactaacgaagaccggatggaacacgctatcgaagggattgaagcggaattaaaggaccggcttgcagaattagaaggccagggtaagttattggaagcccaacgactgaagcaacggaccacttacgatatcgaaatgttgcgagaaatgggttataccaacggaattgaaaactattcccggcacatggacgggcgcaaccccggcgaaccgccgtacacgctgctggacttcttcccagacgatttcctattggtagttgacgaatcccacgttaccatgccgcaagttcgcgggatgtataacggggaccgggcccggaagcaacaattaattgactacgggttccggttaccaagtgcgttagacaaccggccgttgaagcttgaggagtttgaaaaacatgttcatcaagtggtttacatgtccgcaactcctggggactacgagacggctaggacagatcacgtggtacaacaaatcattcggccaacgggattattggatccgactattgaagtgcggccgattatgggccaaatggatgatttgcttggcgaaattaaccaacgcgtagaaaaagacgaacgggtctttgtaactaccttgacgaagaagatggccgaagacttaaccgattatctaaaggatatggggattaaagtggcctacctgcatagtgacgtaaagacgttggagcgaactcgcattattcgtgatttacgactgggcaagtacgacgtcttggtcggaattaacctgcttagggaaggaattgacgttccggaagtttcgctggtggcaattttagatgccgataaggaaggcttcttacgtaacacccgttccatgattcaggtggctggacgggcggcgcgtaacgaacacggacacgtaattatgtatgccgaccacgttacccaatctatgaaggaaaccatcgatgaaaccgcgcggcggcgctcgattcaggaagcatacaataaggaacacgggattaccccgcacacgattaagaaagatatccgttcgctaatctcagctaccacggagacggaagacgctggtgaaaaggacgactttttggatgtggacttcgcggatatggatcgtaaagaccaaaaagaaatgattgaaagtctggaagaccaaatgcgcgcggcagctaaagaacttgatttcgaaagggctgctaatctgcgtgatacggtattggaattaaaagcccagattgattaggaggaattccgtttggtaaatgataagattatcattcacggtgcgcgagcacataacttaaaaaatattgacgttaccattccgaaaaataaattagtggtggtaactggtttatctggttcagggaagagttcgcttgctttcgatacgctatacgcggaggggcagcgccgttacgtggaaagtttatcagcatacgctcggcaatttttaggccagatggacaaacccgacgtagattcgattgacggattgagcccggcaatttcaattgaccaaaaaactacttcgaagaacccccggtccacggtgggaaccgttacggaaattaacgattacctgcgcttactctgggcgcgggtgggaactcccgtctgtccaaacgacgggacgatcattactagccaaacggttgaacaaatggtggatcgggttatggaacttcctgaacgaactaaagtacaaattatctccccaatcgtgcgcgctaaaaaagggcaacataaaaaggtgtttgctagcatcaagcgggaaggttttgtgcgggttcgggttgatggtgaaaccatggatgttgaagaagttccggaattagaaaagagcaaggcccattccatcgacgttgtcattgaccgcattgtggttaaggaggggattcattcccgactctttgactcatttgaagcggctttacgattaagtaaagggtacgcgaccgccgatgtgattggcggagaccccattctattttcagaacactacgcttgcccaatttgtggatttacggtgggagagttggaaccgcggttgttttcatttaacgctccgtttggtgcctgcccagattgtgacgggctcggggttaaactggaagttgatatggacttagtagttcctgatcaggataaaacgttgcgggaaggggctttggctccttggaatccaattagctcccagtattatccaaaattactggaacaggcggcggaaagttttggcatcgatatggacacgccgttcaaggacctaccgaaggatgcacggcaactaattttatacggatccaagggaaagcaattccattttcattacgaaaatgactttggaggagttcgggatgttgataccgaatttgaaggggtcattaataatgtcaaccgccgttatcaagaaaccaacagtgacttcacgcgtgaccaaatgcggtcatacatgcgggagctaacttgtcaaacttgtcacggttatcgccttaatcggaaggcgcgggcggttaagattgctggtcaacacattggtgaggtttctgaattaccgatcgatcgttgtacgtccttttttgaaaaacttaatttttcggaacaagacaccgtcattgcaacgccaattttgaaggaaatccgggaccggttgaacttcttacggaacgtggggttggaatacctgaccttaagtcggtcggcacgaaccctctccggaggcgaagcgcaacggattcggttagctacccaaattggttcgaacttatccggagtactatatatcctggacgaaccttcgattgggttgcaccaacgggataatgatcgcttgattagttccttgaaaaagatgcgtgatctcggcaacaccttgattgtcgtagaacatgacgaggataccatgcgggcagcggactatttgattgatattggtccaggtgccggagaaaatggtggcgaagtaatggccgcagggactcccaaacaggttgaacgcagtcgtaaatcgcttaccggacaatatttagctggtaagaagtcgattccggtccctactgaacggcgggatggtaacggcttggcaattcaactaaagggcgttcaagaaaacaacttgaaaaacattgacgtgaagttcccattaggaaagtttattgccgttaccggagtttcgggatccggtaagtctaccctggtaaacatggtgttgaaacgagttttggcacaaaaacttaaccgaaattcggaaaagcctggtaagtataagtcggttagcggaatcaagaacattgaaaaggttattaacattgaccaaaccccaattggacggaccccccggagtaatccggcaacttacacgagtgtgtttgatgatattcgcggactgtttgcccaaactaacgaagctaagctacgtggatacacaaagggccgctttagctttaacgtaaagggcggtcgttgtgaagcatgtaagggtgacggaattctgaagattgaaatgaacttcctgccggacgtttacgttccttgtgaagtatgtcatggcacccgatacaattctgaaactttagaagttaagtataaggggaagaacatcgcggaagttttggatatgaccgttgaagaagctgctaagttctttgcgccaattcctaaaattgcccgcaagcttcaaaccatcattgacgttgggttaggatacgtgcatttagggcaatccgcaactaccctttctgggggcgaagcgcaacggatgaagttagctgctgaattgcataaaaaagctaacggaaaaaacttctatattttagacgaaccaactaccgggttgcatactgatgacattaagcggttgttagatgttttacaacgcctagtggataatggcaacactgtcttggtaattgaacataatttagacgttattaaaacagcagatcacctaattgatttaggaccagaaggcggcgacggtggcggacaaatcgtggctaccggaacccctgaagaaattgcggaagtggccgaaagctatacgggtcaatatttgaaacctgttttagaacgagatcgcaagctacagaaaaagtaattttatcaaaaattaagcggaaattagaccatcagattggttagatttccgcttttttagtagtaccgcggggatttttggcgatgacctttggtggtcgccaagttttcgtggtatcatttaaaaaatgacacgcccggatgtgttatactggagaagttgttaccttggaatgggggaatcattatgaacgaatcattgaaattggtagtggtaacgggaatgagcggtgccggaaaaactgtcgcaatgcaaagtttcgaagacatgggtttcttttgcgttgataacatgccgttagcactgttaccaaaattttgggaattaattaaagaaaatggcaacatcaccaaagttgccttagcagttgatttacgttcggatgcattttacgaacaagtcatcacgatgctgaccgatacccaagcactttcgggaattaatcgtgacatcttgttcctggatgctactaatgaggaattaattgcgcgttacaaggaaactcgacgggcgcatccgttagcgatggacggtcgggtagcggacggaattcgcaaagaacgcgaactgcttgccccaatcaagtcggaggcccagctggtgattgacactagcaatttaacgcctcgcgaattaagaagtaaaatttttaaccaattttcaaccaacaaaacggttcctaaattccatattgaagtagtttcgtttggctacaaatacgggttaccgattgacgcagacatcactatggatgtgcgttttttgcctaacccatactacgtgccggaactaaaaaatcaggtgggaaccgatcaaccggtgtacgattacgtaatgaaccagccggctacggaaaaattttaccaagcttatttaaagttactgatggatattatgccggggtaccaacaagagggaaagtcgaatttgacgatcgcgattggctgtaccggtgggcaacatcgttcagtagcgattgcggagcggttaggaaatgatttagctaagcactacgttactcacatttctcaccgagatgtaaataagcgaaaggaaacggtaaatcgctcatgagtaaaattaagggacctaaaatcgtggtaattgggggcgggactggccttccagttatcttaaatgagctacacaaacgcaatgcagacgtgaccgccatcgttacggtggcagatgacggaggttcttcgggaattattcgagactacgttaacgtggttccgccgggggatattcggaacgtcatggtggctttgtcggacatgccgcccgaactcaaggacattttccaataccgctttaaaagtgaagataactttcttgccggacatgcgattggtaatttaattatcgctgcactttctgaaatgcggggcggaattgaccctgcaatccgagaattatcgcaaatgcttcaaattgaaggacatatttatccggcaagtgctgaaccactagtgttgcacgctaagtttacggatggcacgaacttagcaggtgaatcagaaattaccgcggcccacaaggatgttaaacaggtttgggtcgaaaacaatccctggagtgagcataaaaagccacgggccgttccagaagccttagaagctattgaagcagctgacgaaattatcctaggaccgggaagtttattcactagcattttgccaaacctaatgattgaagacattcgtaaggctgttttagcgacccaagcggaaattgtttacatttgcaacattatgactcaaaaaggtgaaacaatcggctttaccgattccgaccacgtccgcgttttaaaccaacatctaggtcgaaactttgtggataccgtgttggttaataccgaaaaagttcctgaatcgtacatggatttcaaccgttatgacgaagtttccaaacaagtaattcataattttaaaggactccgcgagcaaggggtacgagtaatttcggataactttttgaaactgcgtgacggcggtgctttccatgatggtgaaaaagtggtcggtgagctaatgcatatctgtagcaacccaattaagaaacaagcataggaggtgtggtcgtgtcttatgccagtgaagtaaaaaaagagctgactagcttagaagtccacgaacataacgcaaaggccgaattgatggcgttgatccggatgaacggttcaattgggattaataaccggcagttagtgttaaatactcaaacggaaaatccggcgattgcacggcggatttactcgctactaaaaaacttctaccacttagaagcagagttgagtgtgcgtcgtaagatgaagctgaagaaaaacaacctttacattgtgcgtttgcggacgggcgctcagcaactacttaacgatttatcaattttaaaggacgattttcaaattaacgaaaccgttccggaggggctcctatcaactgaatcggagctacgctcatatttaaggggggccttcttagcgggaggttcggttaataatcccgaaactagtcgctatcatttggaaatctattcgctttacgaagcccataatcaaatgattgcggattggatcaatcagtaccacctcaacgcccggacaacggagcgccgaagcggctacattgtttacctgaaggaagccgaacatatcgcagattttcttcaactaattggcgcaaccaattcaatgttaaaattcgaagatgttcgaattatgcgggatatgcgtaattcggttaatcggttggtaaattgcgaaaatgctaatatgaataaagttgccaatgcttcgatgaagcagattaataacatccagtacattgatgaagtggtaggactcgacgagttgccgcctaagctgcgcgacatcgcgaagacacggttagcgcaccgagaagttagtttgaaagagcttggcgaactagtgccgggtgggccaatttctaaatcgggggttaaccaccggttaagaaagattaatcagtatgcagaaaagttgcgagcttaaagtttttcgcaataaaaaatatttcttaagaacttttgcattggttaatacaggaccaatgaatataaatttatctaaaatacgtggggatggacaggaatactgttaacttcgcgtatttttattttgcaagtaaaatgtgccaaaagcgctacactacggactttgtaactataatgtaaaacgttttaataaacagatgtgctatccttaaggggatatataaatcaacgccgaaaaggtttggatataggagagtagttaatatatggaaatcaaaaagcattacaaaatgtttaagtcagggaagaagtgggcattcgcaagtatcgctacagctagtttgggtttggtagcactcaatactaatgctgaaaaagcacatgcggatagcgatgcgcaagctaacactaattctgcaagtcaacttgatcaacagaccaagacggctccggttaacgaaaagcaagttacgttagctaagccagcgactgtcaaagctagttcagctgccgttacagcacaatcagcagccccagcttctagtgctgctcaatctgcagctaaggttaacgcggatagtactgcaaaggctgaccaacattctgctgcagcaaaagttgaaaccaaagcaactacttcttcagcagtaaaaccagctaaggaagccgcttcagctaatgcagttaaagcagccccagcttctagtgcagctaaaaaggtaagtgctagtgtagctagttctgcagctccaagctcggcagcaagcaagacggttacttcagcagccattaaggatagcgcagctaaggaagccgtatcttcagcagctaatgtgaaatcaagttctgccgcagctaaaacttcggttaattcaagtgcggtttctgaagctgcccaaaaagacgctaaagcggaaaaaactgcagaaaagaagaccgataactcatcgaaggactacacgattgataatacatatcggttagctgataacgaaggtagcgatcaaaagactaacaataaaattatcgttgcccatgccgttggacaatactcatctgctcgcgacgttgctatctacgaaaaacgggaatgggatagtagtgaaacctacgttcaatacatcgttggagatggcggacgggtatacgccgttggagaagaagggtacgttgcttggggtgctggtaaatgggctaacgaaaatgctcccgttcaagttgaattagcacaaacttactcggatagccaattcaagaaggactaccaaacttacgttaacttactccgtgattccgcaaagaagtggaatatcccaacaactttggatagtgatgaatacactggaattaagtcacatgtttgggttaccgaacatgtttggggaaatcacgttgacccatacggttacttaggtactcatggaattaccaaggaacagtttgcgcatgatttggcatatggtttcggtaatgatgctgctaacgacaaccaaaacaataatcaaaatgataatcaccaaaatgataatcaaaacaaccaaaataataaccaccaaaatgactcttcaaataaccatggcaaccaaaataaccaaagctaccatgtaggcgacaaggttaccatcaagaacagtgcttctcactgggcaactggtcaatccatttacaatggggttaagggtcatacttacaagattatccaaactaatggtcacaagttgttgttagatcaagtaatcagctggattaacgacggtgatgtttacaaggcgggttctaattccggttcgtcaaacaatcataataataatcacactactaacaatgcggacattaaggttggtaccgtggttaccattaacaacaatgctagtcactgggcaactggtcaaagcatctacagtggtgtaaagggcaagagctacaaggttatccaaactaacggaaatcgtcttttattggataaggtaattagctggattaacaagggcgacgttcacgttcctggttcgaactcgaataacaataactctggcaaccaaaaccataataatggcaataaccacaataataacggtaatacagaatcaatccacgttggctcaaaagttaccatcaataacaatgctaagcgttgggcaactggtcaaaatatttatagcggtgtaaagggtaagacttacacggttattcaaatgaacggtagccggctattgttggataaggtaatcagctggatcaacaagggtgatgttcaccttccgggttcaaacggttcgcaaaataacaataacaacaataataaccacgctaataataacgatggtacgatccgggttggtacaaacgtaaccatcaagccgtctgctaaacgttgggcaaccggccaaaatatctactacggcgtaaagggtaagacttacaaagttatccaaatgaacggtaaccgcctcttgttagataaggttattagttggattaataagggtgacgtatacgttccaggttcatccaataataacaatagcaacagcaataataaccacaacaacaacggtagcaattaccactttaccaaccaaaactggacggctgctcaaactaactttgttaacagcattgcagcagacgtaatgaacgtttgccaaaacaatcatttatacgcttccgttgcaatggcacaagccgttgtagaaagtgcttatggtgcttcaactttggctcaagaagcacacaacctctttggaattaaggcagacagcacgtggcatggtgcaacctataccaagaatactcaagaagttattaacggtcgggtagtaactatttcagctgcgttcagaaaatacgattcattcaaggattcgattgcggactacgctaagaaattagaatcacgtccacaatacgcgaatgcattttctaaccatgcgcacaactacgttgaatcagttaaagcaatcaaagctggcggttacgcaacggcacctacttacgtaagcagcattgttaattgcattaataactatggattctacaaattagatggcttggactcagcaatttcgttgtaatttctgtagataaaatttaatataggtgtataagcagaagaggctggaacgtaatgttacagtctcttctttaataagtgagtgatgggggatgagcaaaagtgaagtataaagaatatcaatttgttcagctatgggatggccggatgggtacaattattaagacgctgtccagtggcggctatttaattgaagataatttctggggttggctagaaatgaagagtaaggaagatcccgaacattacattttcccaaatgccgatgtagaacggcgcttctctgctttggaagaagaaattgaaggggaagcccgaatggccgaagaatggtatgaatttcggtacaaagtgatggttagcggtttagggaattaaactatagataaaaaaagagcttggaaatcgttttttgatttccaagctcttttgctttgcaagtatcagtaagattgcttacttaaggcttgcgttcttttccatgataccgtcgatcaaaccataatcaactgcgtcttgcgcagagaggtagttatcccgttccgtatcgaggttgattttttctagcggttgacccgaattttctgccaaaattttgtttaactctttccgagtcttcaaaatttgttcagcggcaatttcaatttcagtttgttgaccttgagcaccaccagaaggttgatgaatcataacttctgaatgaggcaatgcaaaacgtttgccttttgtaccagaagaagctaaaacactggccatcgaagcagccattcccattacgatggtttgtacgtcagctttaatgaagttcatcgtgtcgtagattgccaatccagcagtaactacgccacctggagagttgatgtaaaggtaaatgtctttttcagagtcttgtgcatcaaggaatagtaattgagaaatgattgagttagccaaatcatcgtcaattggacctgataacataataatccgatcttttaatagtcgtgagtaaatatcataagcacgttcgccacgtgatgattgttcaataacggttggaaccaagttcataacttagtagcctccttttcggataaagatttagtattaattactaaccatggctttagtttatctcattggtcaaaaaaggtcaaatgcttttgctcattcattaaaattaatgcttcaaaagtactatctagcaccaacaaggagtaaaagatgggggaagaaatgaaaatacttgttaaaacctacgctggaatactaaatacgggtttatcatggataaagcgctattactagtatataatcgacgttaaagaaggacttatcaaaatggtaagttgtttataaaaaaatatctgtcatcagcaattatttaaattactaataacagatatcgggaactgaagatgacaattactcgcaaccccagtacttttacgtttcagaatataaaaaaatgcgccatcggggagtcgaaccccgatcttgagaaccggaatctcacgtgctatccattacactaacggcgcttaacaaaataaattttacattatgttggcaaaaaaaacaagctaaaaataatagaattatggagaaaaattttatggtaatgaagcaaggatttacgcagaaccaaacgcaacagcaaaagcaagtgcagcgtttggcaatgacgcaaacactacagcagtcaattcaaatgctgcaatacaatgctgaagagttgcaaaatttcttgaaacaaaaggaaatggacaaccccttaattaccgttgaagtagctgaagaacggcctttaagcaaggtgtcgaaaaattccgacacgcatgagacctttatgaatcaaattgctagcgatacggaacaatcattatttgattatttattggatcaagtccatctaaccatgcgggatacgccactaaggaagttggttcttttcctattggattacgttgaccaaaatggttatttgcgaatcacggaagacgaaattaagcaaaaaacgcaggctgatgacattgccatcatggatgcagtcacgcttttgcagcaactggatccgcccggggtcggtgcacgaactctgcaagaatcattaatgctccaaactgaaaatgacgagggttcgcctgagattgcttatatggtcttagaagagtcatttgacgacttagttgaccgtaattgggaaaagattgctcagcgatatgacattacattggctgaggttcaagaagttttcgactacgtgcgcactttaaccccaaatccaggagcgggctttggtaagcaagatcgcggatacattacgccagacttaattttcaagttggaaaatggcgaaccccgactaatccaatcgaaagcttcgcgaccacgggtcagtttttcacaggaatactttgaacaattacgtaaaaaggctgacgatgaagtaaacagctacgtaaatgagaaaaaacgcgaatacgattggattgccaaaagcttgacgcaacgccaagataccattttaagggtgggcaagataatttttgagcgacaacaagactttttccttcagaagagtaaagaattaagtccgttgatgctacgagacgtggccaataaattacatttacacgaatcgactgtttctcgtgcggttaatggcaagtatattgcaacgacctttggaaccttcgaattacgttctttcttcagcaatgcggttaaccagactagcgacgtctccgccgatgcggccaagcaaaagattaaggcaattatcgatcaagaagataaggaaaagcccatttcagatgctaaaattgaaaagcagttaaaggcgcagggggtcacgatctcccgcagaacggtcgctaagtatcgggaagcgttgggaatcccgtcgtcatcaaaacgaaaacgctatctggaaaaataagcttaaaattaaatagaatatttaggcaggcaaatttgcaaaatgatggggagcttgttataatttgatttgtaagtgaggtatgcaacaagaattagttcttatggttgtgtgccatttatttttaagttgttgggtcgttttatgacacagctggacaaataaagtcccatataggagataacatggatgataatgaaatggatttattagagtctgttgtcccgggtttaatcagcgagtttctacaaagatttgatattttaaaatcaatcgacttgttggctccagttggtagacgagttttatccgaacacttacatctaagcgagcgggttttacggtcccagacggacgtgttaaagtctcaagggttgttaaagacctcgccagcggggatgtcgctatcggatgagggtcgtcgggttatgaacggattggaaccggtggctaatagattcttgggcttaactagccaagaaaagcaattagcggaacggttaaatatcgaacggtgcttcattgttcgcggtgatcaagcggagagcccggtcgtttccaagcaactaggaattgtcttaaatgacgcacttgcaaaattattgccggagggtaataatactatagtggtgatgggcggatcgacgatggcgtcggtagcgacgaggcttaaaccagagctctcacagcaccgccagttgatttttgttcctggaaggggcggcattggcgaatcagtttctaagcaagctaattcagttgccgctacgatggccaagcagaccgcaggggaagctaagtcattatatattccggaacaactcagcgaaagcacatatcacccgctactaaatgaaccaacggtgagaccggtgttggacctaatcgtgcatgccggggttgccatccacgggattggccgagcagatgcgatggctcaaagacgaggagttaactccgaaatcaagagttatttgcggaaggcgcgggccgtgggagaagcgtttggctctttctataataaggaaggtcggatcttatatcaggttcatcgcattggactccaattacaggatgtccagcatttcaatcatgtatttgccgtggccggtggtcatgacaaggctcaagcgattgagtcatacatgaaaattgcaccgcatcagacaattttaattactgatgaaggtgccgcaaacgtgattttaaaaaagtgaggccaattgtgactgaactttttaaaataaattatttttttagattcctaaaggaggaaatcttagtatgactgtaaagattggtattaatggttttggacgtatcggtcgtttggcattccgtcgtatccacgaattgggtgcaaagtcaaatgatatcgaagtagttgctatcaacgatttgacaagtcctgcattattagcacacttgctcaaatatgattcaacacatggtactttccctggcgaagttagcgcaacagatgacgctatcgttgttgatggtaagaagtaccacgtttacgcagaacctcaagctcaaaacattccttgggttaaggaagacggcgtagacttcgtacttgaatgtacaggtttctacacatcaaaagaaaagtcacaagctcacttagacgctggtgcaaaacgtgtattgatctcagctcctgctggttcagaccttaagacagttgtttacaacgtaaacgatgatgttttaactgctgacgaccgcatcgtttcagctggttcatgtacaacaaactgcttggcaccaatggcatacttcttgaacaaagaatttggtgttgaagttggtacaatgacaactatccatgcttacacaagtacacaaatgatccttgacggccctgttcgtggtggaaacttccgtgctgcacgtactgctgctgctaacacaattcctcactcaactggtgctgctaaggctatcggccttgttatcccagaattgaacggtaaattacaaggacatgcacaacgtgttcctgttgttgacggttcattaacagaacttgtttcaattcttgacaaggatgttacagctgaagaagttaatgctgcaatcaagaagcatacagaaggcaacgaatcatttggttggaacgaagacgaaattgtatcaagcgacatcattggtacaacttacggttcaatcttcgacccaacacaaacagaagttacaaaggctggcgacaagcaattagttaagactgttgcttggtacgacaacgaatacggcttcacttgccaaatggtacgtactttattgaaatttgctactctttaagattaaattcttaaatatttgtagatttcaaaccgtctaatcggtcttggagacggagggaggtcacttcctccgtctctttttttaagaaaaaataatttattgctcacttaaaaggaggaattatcttggctaaattaacagtttcagatttagatgttaaaggcaagaaagttttgatgcgcgttgacttcaacgtgccagttaaaaatggtgtgatcggtgacgataaccgtatcgtagccgcactaccaaccatcaaatacatcattgaaaatggtggaaaggcaatcctcttctctcacttaggtcggatcaagaaggaagaagacaagaaagaattgactcttcgtccagttgctcaacgtctttcagacttgcttggcaagccagttacttttgttcccgtaactcgcggtgcacaattagaagacgcagttaacggcttgaacgacggtgacgtattgttattcgaaaacacacgtttcgaagaccttgacggcaagaaggaaagtggcaacgatcctgaattaggtaagtactgggcatcacttggcgacatgttcgttaacgatgcatttggtacagcacaccgttcacacgcatcaaacgttggtgttgctacagcaatgaaggcagaaggcaagaaagttgctgctggtttcttaatggaaaaggaaatcaagttcttaggtgaagctgttgacgatcctaagcacccattcgttgcaatcttaggtggtgctaaggtttctgacaagattggtgttatcgaccacttacttgacaaagctgacaaagttatcatcggcggtggtatgacatacacattctacgctgcaaaaggcatgagcattggtaactctcttgttgaagctgacaagattgacgttgctaaagaaatccttgctaagggtggcgacaagattgttcttcctgtagacagtgttgttgctgaaaaatttgacaacgatgttcctcacaaagttgttgaaggtgacattcctgacggttacatggctcttgatattggacctaagtcagttgctgaattcaaggacgttcttaaagacgctaagaccgttgtatggaacggaccaatgggtgtattcgaaatgagcaactacgctaagggtactcttgaagttggtaagttcttaggaactctatcagacgcaacaaccatcgttggtggtggtgactcaactgccgctgttaagcaattaggcgttggcgaccaattgacacacatctcaactggtggtggcgcatcacttgaataccttgaaggtaaagaacttccaggtatcgctgcaatttctaacaaataattaacttgaatggggtcgggaatccacagggattgctaatcccgttcggttacatattttgtgattaagaaaggatgttttattttgcgtactccaattattgctggaaactggaaaatgaataagaacccccaagaaacacaagaattcttggaaggtatcaagggcaaattaccagatgcttcagttgtagaatcagtaatcgctgctcctgcaattgatttaaacactttagtacaattctctaaagatgaacaactaaagactgctgctgaaaactgctacttcgaagatgaaggtgcttttactggtgaaactagtccaaaagcattgtctgaaatgggcgttaactacgtagttatcggtcactcagaacgtcgtcaatacttcaaagaaactgacgaagacatcaacaagaaggctaaggcaatcttcaagaacaacatgaagccaatcatctgctgtggtgaaacgcttgaacaacgcgaagctggcgaaactaacgaatgggttgctggccaagttactaacgctcttaaagacttgtctgctgaacaagtcgctaacaccgtaattgcttacgaaccaatctgggcaatcggtactggtaagactgcttcaagtgaccaagcacaagaagtttgccacgtaatccgtgaaacggttgctaagttatacgaccaaaccgttgctgacaaagttcgtatccaatatggtggtagtgttaagcctgcaaacatcgctgaattgatgagcaaagaagacatcgatggtggccttgttggtggtgcttcactcgatccagaatcattcctacaattagttaactaccagggttaatttaattctagaaatataatataatggtaactgcataagcagattataaaatgtgaggagatattaaaatgtcacttattactgatatttatgcacgcgaagtcttagactcacgtggtaacccaactgttgaagttgaagtttacacagaagacggcggctttggtcgcggaatcgttccttcaggtgcttcaactggtgaacacgaagctgttgaacttcgtgacggcgacaagaaccgttacgaaggcaagggtgttgaaaaggctgttgctaacgttaacggcccaattgctaaggaaattgttggttttgaagtaactgaccaaatcgcaattgacaaggcaatgatcaagttagacggtactcctaacaaaggtaagttaggtgctaacgctatcttaggtgtttctttagcggttgctcgtgctgctgctgacgaactccaaattccactttacaactacattggcggatcaaacgcacacgttcttcctacaccaatgatgaacgttatcaacggtggtgctcactcagataacaaagtggacttccaagaattcatgattatgcctgttggtgctccttctgttaaggaagctatccggatgggttcagaaacattccacgcattgaagagtcttttagctgctgacggcaaagctacttcagttggtgacgaaggtggtttcgctcctgactttgctaacaacgaagaacctcttcaatacttgatcaaagcgatcgaaaaagctggttacaagccaggtaaagacgtagcaatcgctgttgacgttgctgcttcagaactttggaacgacgatgacaagaagtacaagcttcgctggtcaactggtgaagaattcactactgaagaattcgttaagtaccttgaaggcttagtaaacaaatacccaatcatttcaatcgaagacccaattgacgaaaacaactgggaagactgggcaagcatcacaaaagaacttggcaagaaagttcaacttgttggtgacgacttcttcgttacaaacactgaataccttgcaaaaggtatcaagatgggtgctgctaactcaatccttatcaaggttaaccaaatcggtacacttacagaaacaatggaagctatcgaaatggctaaggaagctggttacacagctatcgtatctcaccgttcaggtgaaacagaagatacaacaatcgctgacttggttgttgctacaaacgctggccaaattaagactggttcaatgagtcgtacagaccgcattgctaagtacaaccaattaatgcggattgaagaccaactcgaaggcgttgcagaatacaagggtatccactcattctacaaccttagtgcacaagcacgcgaagatattacaaacaagtaattcatttcgagtgatctaagagaaggatggacattttgtccatcctttttttattgtttaaattggaattcacccgtaagtatgttaaattaatactagaacttatttagaatacaaaggaggtcatcttgtgtactcacttttgatgacaattctattgattctgtcagtggtcataatcattgcggttatgatgcaaccggcaaagactgataatgcgatgtcttcattgacaggtggggctggtgacctattctcaaagcaaaagtcacgtggatttgaagcgttcatgcaaagagtaacggcagtcttgcttttcttgttttttgctatcaccattgcaatggtttacgtatcggcccattaaaagcgatcgtatctaacaaaaaaattgcatttagcgaagtcctaaggcatttttgggacggattaggaatggctaaagacaaaatcgagcatggttttgtctttagcttttttatttaatactatgaatttatagaggtaagtaatggaatcaagtaaacttcaagcttcaatcattaattatttggagcgacggcctacacaaaaattcaccgcggaagaattgtttaaaggtcttagtttagaaaaggcgtccgtattcaacgaattggtcaaagaattaacttcgttggaacggtcccataaagtagaaatcacggcggatgacaagtttaaaattgcccgcccccaaaaccaattgctcgttcacggaacctttcgggcaaatgaccgcggctttggttttgtagcggtagaagatgatgaaattcctgatatttatatcagtgaagaacacaccgcctacgcgcttaatttggacgaagtcgatgtaaaaatcgtgcgtccgtctaaaaaaggtgacgaccggggtcctgaaggaattgttaagaaaattaccaaacggcatctcacccaagcagtgggggtatttgaatttgctccagaccctgctcataacgtgctcgggcacattaatctaaaagataaaaagatgtctaactacgagtttgacgtgctagaaggcggtattcaccccgaagacggagcggtgattactgctcaggttacccagtatccaaaacccaacgcccctaagttaattgcaggggttgcggaaaaaacgattggataccgtgacgatccgggagtagacattctggaaattgtttaccaacatgagttaccaactgaatttccggatgacgttaaagaagaaattgctcaaattccagaccacgttactgaagccgaaaaacaaggccgcgtggacttaactaacgaagtagtggttaccattgacggcgatgattcaaaagactttgatgatgcagttggcttacaaaagttagacaacggtaattaccgcttgctagttaacatcgcggacgtttcccactacgttaaggaaggctctccgcttgataaggaagcataccggcgcagtaccagtgtttatttgacggaccgggtaattccaatgttaccgcgaaagctttctaacgggatttgttccttaaaccctaacgtggaacggctagcgatgacttgtgaaatggaaatcagtccggatggagaagtgttaagccataaaatctacccaagtgtcattgagtctaacgcccggatgacttataacgacgttaacaaaatcttggaagcacgcgataagaaaaccatcgagcgttaccaagatttagtgccaatgtttgaaatgatgggcaagttgcacaaattgctgttgaagcgccgtaaacaacgcggagccattgaatttgacgacaacgaagcacaaatcattgtcgacgaaaatgggcacccaattgatattaaggtgcgggaacgcggaacttcagaacggatgatcgaatccttcatgttggcggctaatgaaacggtggcagagcattactacgacgcccacgtgccattcttgtaccgggtccatgaaaccccagatagcgaacggatgttaaccttcttcgaattcttatcaacctttggccacgtggttaaggggagcactaaggatcttaaaccaaagatgttgcaaagcgtcctcaagaaagttgcgggaacccgtgaagaagccatgatttcggttatgttattgcggagcatgcgccaagcgaagtacgatgctaggtcattaggtcactttgggttagcagctaagtactatacccactttacttcgccaattcggcggtatcccgacttgtttgtgcaccggttgattcgccattatgcggaagatggtactggaaaagacgctcaagaaaagtacgcggacattattccagaaattgcggaacatacttcccaacttgaacgacgggcaatcgatacggaacgcgatgttgacagtatgaagaaggctgaatacatgggcgaccacattggtgaacaatttaacgccatggttagttccgtaatgaagttcggactttttgttgaattggaaaacaccattgaaggcttaatccatattagtaccatgaaggatgattactacgaatacgtggaaaatcaaatggcgctagtgggccgtaacacccaccggaccttccaaattggtttaccagttgcggtgaagttaatgcgggtagaaaaggaccaggctgaagtggacttcgagttgttgcatccggaaaagacgccaactagcgaaattaagttgccacctcgccaatcctttaaccgtaacaagggcggtcaacggaatggtaaccgaaatcgccgacaaaatgggcaacgttctaataattccaacaacaaaccattctacaaagataaaaacgtcaaacgcttttctaagaatacttctcacaaaaaataaagaggagggtttcgtatggctaaaaaaccacaggtaaaggatcaagctttagcccaaaataaaaaggctcgccatgattattccattttaagcacgatggaagcgggaattgcgttaaccggcacggaaattaaatcagttcgggaacgccggattaccctcagagacgggtttgtgcaaattcgccatggtgaagcgattttgatgaacgtgcagattagtgaatacttgcaaggtaatcagtttaatcacgatccgttgcgaaatcggaagcttttgttgcacaaaaaagaaattcaaaagttacaagaatctagccaaaataaaggaatcacgattgtgcctttaaaagtttaccttaagcacggttttgcgaaggtgctgatcggggttgctaaaggaaagcacgaatacgataaacgagaaactttgaagaaacgtgaccaacaacgggaaattgaacgcgcgttgaagaaccgttaaacgggcggcgtttattgataagtgaataataaaaaatagctgtggataactccctccatcgaggggaataatccacagctatttttggtttctacagttacttagcaaggtgatgaaaaagaggccggataagatcgggtagtttatgagtaaactaaaaatcgactattatgccaaattcaggcataacagtcgattttaggttgagtgatgcaagctgcttttgctgctatgaaaggcaacacaccaaaacgatttttaactttaacaagggagttttagtctttcccctatccttggtttcgattactttaatgagaattcgagaaggttaaacttcctttttcaagtgttggtagtggtgaccagaaacaatttgccggtggtcgagttggaaaccaattcgccggtaaaggcgttctgcgtcaggattcaaatcgtcaactagcagcccgaccatttttaagtcacgagctttcgcgtattcgggaagggcattgagtaacttagtaccgattccgtggttttggaaatcagggttaactactagcgaatcgaggtaccattcgtcatcgtcagcttcagcttcttcgtaaatgggctgaggagcgagggcaacttggtcaaaatgattttgaaattcatcctttaacttctcttcgttagcacctggatagccaaaagcgactcccgcaacttggttatccattttagcaacaaccacgtcggcagcctcttggtatagggggctttggaaggttgctacgaatagtttagtaacttcttgaggatcgtttttcaagtaaaaaggcagttccatttcgtcgagaatgattttgagtagctcgacaacctggggcatgtcttcagtagtggctttagtgatttgcattagaattctccttcgaaaaattattatagccagccgtgtctgactcaatcttccaagttcgaactagtttaggctcccgaagcggggggcgtttttgaatccagcggtcgagaatcgccgctaaacaaataaacagtggcgtattggattctacgaaaacgttcaattcaatatatgcactgccgttgatttgaacgcggttaacttcaagaattttagttaagccatgaaaaaccttaaaatggcaggtaacggtatctccaataataatccagcgaaggttgtgaacgtacaagagcccgcgaatgaagcctacgggagtcgtcaccgtcccaacttcgtggttatttaaaaacaatttaaacttgggtaatagtcctaccgcgatttgcttaagctcagcgcggagctggccttgcatatcgtaaacagaaagggcatcgcgtttgatgccccatttgccaactagaaggtatttggaattatggttttcatcgctaaccgtggtagcacctttattttctagcccttgactttttagatagaatctctgcatcggcttagcctctttttaattattgttgattttcggcaagctgttccaggatggcttttccaaccccatcctcgttgttagttacggtgaggtggtttgccaagcgcttgatctccggaattgcattgcccatggcatagctaacgcccgcgacgcgcaacatggaagcgtcgtttaagttatcaccaatcgtcatcacttgggacatcggaatcccaagttggtccgcaaaattctgtacggcaagtcccttttgcgcacggggactgttgatttcaatgttattttcaaacgatgatgaaattgctacgtcaacttgttgttgaatagcttcccggacgggttgtaatcccttttgaccgttttgaccaaacgcaaccagcttcaaaatttgaattttcggatcgtcaagtagcacttggtaattatctacgtaccggatgttcattaattctacccgggcagaagacatggccactgctagtttgaatggcgtatctgggttaacggtctctaaaagatgagagaccgtttcaatccgccgggttcgactgttggaaaccacgccttggttggtggtgatttcgtagtaaagtccgcgtttctcgagttggtgcatgattaactgcgcgttaggcttagtaatcggcacttcatcaagaattttgccttcggtgtcaaaaattgcggcaccgttgagggtgataagtggtacggaaagcccgtaagtctctaaaaggggtttcgcttcacgatattcgcgacccgttgccacgacgaaatgaactccggcgtcctgcgcttttttaatcgccgcagcattacctggtgaaatttgcatttcttcgttaagtaacgttccgtccatatctgaagcaatcactgaaatcatgttatgcacatccaatccatatatttatcctaattttaacatgaaccccgccatttttttcagaaatcagttagaatggaagtaacaaattgttcgaggaagattgaggtatgaaaacaattattcataacgattggcagaaggttttagaaagtgaatttgaaaaggattattacgcaaatctccaccagtttttaaagcaggagtacgcaacccaaaatatccaccccgatatgtatcacattttccaagcattcgaatggacgccgttttcggaggttaaagtggttatcttagggcaggatccgtatcatggccctcaccaagcgcacggactaagtttttcggtgcgcccgggagtgccggtgcccccgtctttacaaaacatctacaaagaattacaggatgatttaggagtcaaaccggtacaacacggatacctgaagaaatgggcggaccaaggagtactgttgcttaactctgtattaacggtccgcaacggccaggccttttcacatcaaggtcacggctgggaacggctaaccgacacggcgattaaacggttgtcggaacgtgaaaagccggtgatctttattttgtggggccgggccgcgcgtgacaagattaagttaattgaccagtcccgaaacattattattcaatctgcgcatcccagtccgttatcggcataccggggcttttttggctccaagccgttttccaaaactaacgcagctttggaagcgatgggggaaaagccgattgattggcaactaccagaacacgtagaagaggaaaaataaatgcaaacttatcaattacgaaacgaagaaaagaccattgaatttggcaaaatgattggtaaacttctacatccaaacgatgtggttgtgttagacggagatctcggtgcagggaagacaaccttaacgaagggcattgcccaagctttagggatcaaacgctacgtaaaaagtcccacctacacaatcatccacgagtaccatgacgggcggatgccgctttatcacattgacgcgtaccggttagaagatgggaatgctgatgacattggtttagaagaatattttgaaagcgatggggttaccgttattgagtgggcccagtttattaaggaatacttgcccgaagagtacttgaagattggattggaccggaaccacgataatacccagcggttcctaactatcgaacccaacggcgaacggtaccagcaatttgaaaagttccttgaggatcaaatcaatggccaatagggaagatgaagtttacctgacggagggaactcccgaggacgcccaagcaatcgtggggctaattgaccaattagaaacggagacggattcaattgagtttgacccgaccatccatcagctggagctcaagctggtccaacaaaatttagcgttaattcagcaaagtccgactaactttttattgttggcaaagttgggggatgctccaatcggcttgctgacgattgtggaaacggacgctaaaaaggggcaggccgagttgggagtcggcgtgcttgaaaaatattggcacaacgggattggaaccctattagtcgatgaagcattatactgggctaaaaattacagctccttatcgaccatttggctagacgtcctgacggataacgagccggccatccacctatacgaaaagatgggctttacaactaaaaaagccccgatcaaggatgatcagggtcgtagtttaaaacgaatggcacgtaagcttagctaactttacgaataaagctactgatggcgtccgcaccgaactgcttcttctcatacaacaagatgttcgcgcacgccaaactatcgtctaaggcgttgtggtggtgctctaattcaatccccaaattatcacagagcgtgttgagcttgtggttaggataattagggaaaaagctgcgggaagtccgcaaagtgtccaaagtttggtaaggcagccggttaagttcgtaacgctccagcgtcttctttaaaacgctattgtcgaagttggcgttgtgggccacgacaagttggtcgggagtaaagaacggctgtaaaattggccatagctccggaaaggtgggcgcgtcctggacgtcggcttcgtggatcccgtgtacttgaacgttccgccaatgaaatttggtttccgggttaattaaagagtacaattcgtcggtgatttgatcattttgaaccaccgtcagcgcgattgaacaagcgcttgcccgcgcaggcgcggcagtttcaaaatcaatggcaacaaagttcaaaaatatcactgtccttatattattttaagtcaagtttaacgaataaagattagtgcgtaaaggagtttttccaatgattaaagttggggtaattggattgggaaacatcgctcaaaaggcttatttgccggtagatagtcagttacaagatcgcttcgagtggtacttggtcagccggcaagccgaaaaattgcagcatttgcaaaaaaagtacggttttcaacacgggacgacccggatggatgatttgtttgaggaaaacgttcaggcggtgttcattcataccgctacctccacccattacgcgattatcaaaaagtttctgcaacacggggttcacgtttatgtggataaacccatttcagaaaatttggcggaggtgaaagaactttaccaaattgctgctgagcagcacgtgttattaacctgtggatttaatcggcggtttgcgccactgcaccaagcgttcgggcaattgggaaccccgcatttagttcgggcaaccaagacccgggtgatggaaaatcaaagtccccagtttgccgtttatgacctaatgattcacgtaattgatttggtccagtttttaatgggatcatcaaaagtggaatacgtggatggccgcctacaagaacaggatggtcagttggtctgggcggaggtcgaactaaccaatggggatgcttctggcgtggcccaaattgatttgcgcgctggtgcgaatactgaagtagcagaggtagttagcgatcacggagtcgcccgagtggaaaacttacaaacgttaacccatgatcacgacgggcaacggatgatccaaagtacgccagactggcaaaaaatgctggtaacccggggatttgcgccgttaattgaagcttttttgcgggcggtggaaaatgacggtcccaacccggtatctccggcttcggtgattaagtcccatacgctatgtgaccgtttaatccagagtatgaaagtgataaaataagcgaagagattttcgatgaatcgtgaggattcacaatgtaaatgaggtaagaggggaaagtatgatggatcaatcaataaccgcagcatttccagaaattaaggtctacaaagatgaaccgttgtcaaaatacaccaatacacaaacgggcggaccagcggatttgctagtatttcccaagtcggtgactgaaactaagcagttgatgatttgggctaaggaaaccgctacgcccctaacggtgattggaaatgcaagtaatttgattgtgcgtgacggaggaattcgcggactagttttaatcttaaccaagatggacaatatccaagttaacggcaataccgtgattgcggaagcgggggcggctttaattcaagccaccgaagtagcttaccaatcaggattgaccggttttgagtttgctgctggaattccgggttcagtaggcggtgcgattttcatgaatgccggagcttatggcggtgaaattagtgaaattgtggaaagtgccgaagtgttgacgccagatggccaaattaaacggctgaataaccacgaattggattttgggtaccgacacagcagcgtgcaggattatcacgatgtggtaatttcagcatcatttaagttgcgtcctggtgatcaaactaagatccgggcgcggatggatgagttaaaccggctccgtgcttccaagcagccgttggaatatccatcgtgcgggagtgtgtttaaacgccccaccggttactttaccggaaagttaattcacgaagccggtttgcaaggcttcacgattggcggcgcccaagtttctaaaaagcacgccggattcatcattaacatcgggaatgctacggcaactgactacttagacgtgattcaccacgtacaagccacggtatttaaacagtttggggttaagttggaaaccgaagtccggattattggtgaagaaaaataaattgaatatttaaacgaagtgacctccaatttggcaaacgggtaaaatgcaattgggcacatttgaagcgtgaatgtgcgataaattaaccccctgcaacaaataggaggtcactttatattctctctggtataattatccctgaatatgaatttggagggacaggtatgaacataaattggtcccagttgttaacttggagcgatgtcatcaatattattgatgtactcgtggtttggtttgtaatttatgaattgattatgctgctgcggggaaccaaagcggtacagttatttcgtgggattatcgtcattattataattatggcgggaagctggtatatcggattaagcacggtttactggattatgaatcaggtcatcaattggggagtaattgcgatggtgatcatctttcagccggaaattcgccggggactggaacacttaggtcgcgggtcgatttttgcaaagaaccattcgcaaaaagaagcggaagaaaaaatgattcaggcgttggataaggcgattcagtacatggctaaacgccgaattggagcgttgatttcaattcagatggaaaccgggcttgatgactatattgaaaccggaattcccctggatgcggacgtttcgggagagttgttaatcaacatttttatcccgaacaccccgttacacgatggtgcggtgattattaaaaacggtaagattgccgtggcagctgcctatttgcccttgtcacagagcaacttaattcctaaggaactcggaactcgacaccgtgcagcagtcgggatgagtgaagttaccgatgcattgaccatcgtagtctcagaagaaactggagaagtttctattatgaaggacggcgaactattacgggatatgtcgcaagaatcttacttacggtatttccggacccaattaattaccagtgatgaagggcccaccccgttcttcacttcggttacggaaaatatttcggccttctttaagggaaaaagggggcggcactagatgaaaaaattttttaccaaaaattttagctatcggttaattgcgttagtcttagcccttttgctttttgcgtacgtaaagaccgatcaccttacttcaacgcgggtttcggggaccgacgcaaaccagaataaaaccgcgttgatgtccaccaagacggctacaattacgatgccggtggatttagatgtggattcaagtaagtacgtagttagtggataccaagaacgcgttaaaattacgctgaccggctccagcgcaatgattactaccttaaccaacacccgtaattttaaggtgtaccttgcattgcaggattatgcaccggggaagcatacggttaaatatcaggtggaagggctcggtaaggatattcgctaccgaatccaaccagaaaaatcaaaaattacaattgcccaccggaagacgaagaaatttgaaattcgctaccgttacgataccaacatggttaaggaagggtatacgatggggaacgtaaaaacctcggtaacgacggttcaagcaacgggctccgcatcagaaattgaccggattagccaagtggttgccgacgttaacgtccctagcaacacgacagaggatgtttctgcgcgttctgtgttgcaagctttggactcaaacggtaacattgtaaatgtagtcttgactccgcaatcggtaaatgtcactattccagtttccaaggcgaaaacagaaaaagccaaggaatctagtgaggcaagcagtcaagctacgtcctcttctagcagttcggaaaaatcagcaagtagcgcatcctcatcgagtggtgaagaaagttcttcgagttcagcaagtagtgacgagagttcgtccgctgacgatactagcagtgacgggaatccgcagctccaacagtgattcataagtgaaaactagcttgggagctgtgctaattaaattgctgattttataatttagataatgagttaaaagagattgacggcgggctacaggtcttgtcgcaaagaaggagattttcaataatgaaattgaagtattttggtacagatggagttcgtggaatcgcaaacgaaacgttgacaccagaactagctttccaattagggcgaactggcggatacgtattaactaagcacgccaaggatgctgatcagcgtccccggatactggtttcacgagatactcgagtttctggccagttgttaaaacacgccttgatttcgggccttttgtcagtagggatcgaagtaatggatatgggaatcgttacgacgcccggggttgcttacttagttcgtaagcaagaagctgacgcaggagtgatgattaccgcttcgcacaatccagtagaggataatggaattaagttcttcggttcggacggttacaagctatctgacgaattagaagctgaaatcgaagttctcttagatgctgaaaaagataaccttccccggccatcggctaagggacttggttccgtaacggattaccctgaaggtgggttaaactacacggcattcttggaacaaacgattcccgacgacctagaagggttacatatcgcggtggatgctgctaacggtgctactagcggctacgtttcccaaatatttgctgacttaaatactgaatttgaaacgatggcaaccaatcccgatgggttaaacatcaatgcgggagtcggctcgactcatccagaagctctagcaaaattcgtggttgaaaagggcgcggatatgggagttgcttttgatggggacggcgaccgttgtattgcggtagacgaaaagggaaatatcgtcgacggtgataagatcatgtacatttgcggtaagtttctaagtgaacggggtcgtcttaaggaagacaccgtggtaacgaccgtaatgagtaacctcggaatgtacaaagcgttagaaaaacacggcatgcattcggttaaaacccaagttggtgaccgttacgtggtggaagaaatgttgaaggatggttataaccttggtggggaacaatccggccacatcattttcttagaccacaacactactggggatggcatgcttacggctatccaattaatgtacgtggttaagcaaactggtaaaaaactttccgaattagctgctgaagtaactacgtatcctcaaaagttagttaacgtacgggttcaagataagaaattagcgcttgaaaaccaagccatcaaggacattatcaaaaaggttgaagacgaaatggctggcgaaggccgggtattagtccgtccttccggaactgaagacttacttcgggtgatggcggaagctcctactgaagaagcggttaaccaatatgttgaccggattgttgcggtagtcaagagtgaagttggcgttgattaacggctgtaattaaataataaaaaaacgaaacgggcggagaaaatctctagcccgtttttgattgtctaataaaatgagtttggggtaaaaaatttaagggagtctaatcccttgtgctatacctattcccacatttgatatataccaatttcgaaaaataatgtttgacaatcgcctgaatcggtaatatattaagaatcgttaattataccaattatataaaaataaatagatgaatttaggagaacagggattatgtgtggaattgttggagtaacaggtagagcagatacgaccaaacttttagtgaatggtttgaaaaaattggagtaccggggatatgattctgcgggaatttacgtaaataatggtcaaggcaaagattacctagttaaagcgcaaggaaagattcaaaacttagaagatcaactttctgatgacgtgaacggcagtgccggaattgggcacacgcgctgggcaactcacggtattccgagcgtggctaatgcgcacccgcatttttcggcagacaaccggttttacctcgttcacaatggagtgattcaaaacttcaaggaattaaaacaaacttatttagcagacgtgcctttccaaagcgataccgatactgaagtagtggttcaattagttgaccacttcgctaaagaaggtttatcgaccatggccgctttcaagaaaactttaagcttgttgaaggattcttcatacgcgtttgttttaatggaccgggaaatgccggacaccctctttgtagccaagaacaagagcccgttattaattggggtgggcgacgactttaacgtagtttgcagcgacgctttagcaatgatcaacgtgacgaaacggtttgtggagttgcacgatggtgacgtggttaaaatcacccctgacgaagtgaagctatttgatgcagatggtcaagcaattcaacgggatccttttgaagttgacattgaccagtccgatgctgataagggaacttacccatactacatgttaaaagaaattgacgagcaaccagccgtaatccggcgcatcgaagaaaaataccttgattcaaagggcgcagttcgtttcgataaagcaatgttagataaattaaaccaagccggtaaaatttacattgtgggtgcgggaactagttatcatgctggtttagtgggcaagaagttattggaacgctttgccaaggtgccaacggaagtggtgctagcatccgaatttgcctacgacgatccaattattgaaaaagatgccttcttcatcttccttagtcaaagtggtgaaactgctgatagtcggcaagttttagtccgggtaaatgatgaatggcaaaagccaagcctcacgattactaacgtggctaactcaacgttggcgcgcgaagcagaattctcggcaaccttagaagcgggtccggaaattgcggtagcgtcgaccaaggcctacaccgcgcaaattgccgtagaagcacttctagcggtagcaatgggacggatgaagcaaatcaatgcggcaactgattttgacattgcaggacaattaagcatggtggcaaacgcaattcaaacggtggtggatgaaaaggcagctatcgaacaattggccaaagacacccttttaaaggcgcgtaacaccttttacattggccgggggctagattatgcggtagccctagaagcttcccttaagcttaaggaaatctcttatattcaagcagaaggttttgcagccggcgaattgaagcacggcacgattgctttaattgaagaagggactccggttatcgggatcattacccaaggtaaaactgccgatcacacccggagcaatttagaagaagtgatttcacgcggagcacaggtaatcaccttcgctagccaaagcctcgccaagaatacggatgacgtaattcttcctgacgttgatgaaatgttgatgccgttggttagcgtcattgctgctcaattattggcttactacgcttgcttgcaacggggttacaacgttgaccaaccgcgtaatttagctaagagtgtcacggtagaataggaggaagagcagtgcaaagtcgcctaaattttaatttgaatatttttgaaatttaggttgacattattatgtgtaagcgctaacatatggttgtaaggtagtggcgcatctcctacctgcacaatcaattctctttctctcttatgctggatccgactcgtacaagtccggatccttttttggtgccataataattctagacaggagtcggtaacgcactttatactagataagtggaggcgagagaatgaagagtaatgagacattcaccttgattcaagagattacccgtttggatggtactaaatacattgaaattggtaacatgatgatgaatggtcgcgctgagctagcggccgaacgtggttatattaaatcagtgcggattatgcagctgaacatttcgcattcgcaacatgtaattaattatgaaaaatacatcggggaacgctacgaaatgcctgacgaaaacatgacttcgtgggaagaatggcaaaaagatgaccggattatgaaggacttcaacgcgattttacacgaaaatcatatcagtgctaataaagaataattacttggtttttaaggcccgtttttgcattatacaattcaagtgattcaaatgcttttctggaattttttaattctgggaaagcattttttggttttcacagttctttttttgtaccagaaaaaataatttttattcgcaagtgtaaacgctcgcaaaaattcgcttttcgtgttaatctattcttgaatttaaatataagaataatcaggtttgtttccacaagggggaatcgatgatgagaaaagcgtttatgattggtacaggagttgcaaatttagctgccggcgtatatttgattcgtgatggtggttggagcggtaatcaaattaccatgttcggactcgataaacacggggctaacgatggggcagcggttgcggattacgagacggaatacggcaaccagcggctatctaacgatcggggctttttagccaagggcggtcggatgcttaacgaagagacctacgaaaacttgtgggacgttttgcggagtgtgccgtctttggatcacccagggcaatcggttacggatgacattttaaactttgaccatgctcatccaacccatgacgtggcccggctaatggataagcgtaacgggatccggaataatggcggtgcggacgactattcgcatatgcaatttaataaccaagaccggaagttgttaaccaaattaatggtgatgcctgaaagccaagaagcaaagcttaacgacgtcagcattgcggaatggtttaaggatagtccgcacattttcactactaacttctggtacatgtgggaaactacctttgcgtttaagaaggaaagctccgcaatggaattgcggcgttacatgaaccggatgattctggaatttagtcggattaacacccttgaaggggttaccagaacgccgtataaccaatacgaaagtatcattctaccgatgcgtaagtacttgagcgatcacggggttacctttatcaacaaccgtaagattaccgccttccaattcaaggacactccgttgcgcgatgatatcatcgttactggcttagagtacgaagacgtaggggaaaataagcaaaccggcacaatcccggttgacgaaaatgacctcgttttcgatatcaacggcgcgattaccgatagttcatcgattggtgatttcaacaccccaattaaggaaaatatggaatacgctcctagcgcagcattatggaaacaagctaccgaacatttctataatctaggaaatccggacaagttctttaacgaccgtgcccaaagtgaatggatgagctttacggtaaccacgaagaaccactatttggtaaaccaaattagccggattacccaacaagaaccggggaatgctttaaatacttgggtagacagtaataatttgttatccatcgtggttcatcatcagccgcatttccacgctcaaaaggaaaacgaaacggtcttctggggctacttcatgttcccacgtaaaaatggggattatgtggacaaaccggtaattgaaatgaccggaaaagaaatgctgcaagaattactaggtcatttggcagaagttgatcaagcaacggatagcattgtttatcatgaagaggaaattatggatagcatcgttaacgtaattccggtttacatgccgtacgctagcgcactgttcaatacgcgagctgtcggagaccgtcctgaagtagtgccaaagcattcgaaaaacttggcatttgtcagccagttcgcagaaatgccatttgatatggtctttaccgaacaatactcgttccgggcggcacaacgggcagtctaccatttcttaggaattcctgaagaaaaaatgaccccagtgcaccactacgagaagaatccaaaggtgcttttgaaggcaacccggaccatgttccgttagaattatctatttaataatactaaaagttgatttgagagcttgattttattgaagcgccaacgaaatcagctgttccgcttaacaaaaaatcgatcgttatgccaatttaggcaacgatcgatttttttgttaatgcttgtaaactacccgacttttgtcctgctcttagcattttgggttaggacttagtaaagttttcaagtccgtcacgcgtacttttactacttacgggtgattttggggaggacgtagttttggtagtaatcttggtaggtttgtttggaaatttggccccattgttcttggctgaattccttaattttttcggtactaaagttagcctctttaattgcgctgattgagaagacttgggtttggtcgccgacacttagccgaattttcttcaacgaacggggaagcgtgtcgccctggattttcttcaaaatatggaccatattgggtgcgtaaagctgggtgaaatcaaacaagtttaacttagggacccgaatgataatctgggagtccgtaaagttaacttgaaaaggcaggcgaccgttaaaactatccgcaatttgattttcaatcaaggtggcctcattggaggcgttttcttcgacataggaatcagtatttgaatgaatatctaattgttgattggtaaaattagggtaagtttgaaagcccagaattgccaaaacaactacggttaagttagatttagaaaagattctgggacgtttgaatttctttgctttagccatgtcttatatccgttcataataaacccgttaaacgtaattacgtttaataatttcaacaacatcaacaattatagtaaatttaaggtatttacacaaacgtttgtttgctaaatgttaaaggataagttacgataaatgaaaaattatttaaggggtaccagaatgttaaaatacgcgatttttgatttagacgatactttactggattttaagaagggtgaacgtatcaaagctactgaagtcttacgtaaatatggcgtgcaagatttgacgactggattggcaacctacacaaaaattaaccagcaggtctgggaagcaatcgagcaaggtgcacctcgggatcaagtgttgaaaacccggttttcgaaaacctttgcggcactcggagtggatggcgatggggtcgctgctgaacgggaataccgccagcgattggcaactagctactaccaatttgaaggcgcgcaagtattactgcgggatttgaaatcggcaggaattcggttgatggtgggaactaatggggttaagaagactcagttgagtcgactcgctggttccaagttagaccaatactttaccgactgctttatttcagaagacgttggttatgctaaacctgatgaacgcttctttgcgccaattaagcataaatatgcggatatgagtttccagaataccgcaatggtgggcgaccggttgcaatccgacattttaggggccaatcaagccgggctcaaaagtatttggtacaacccccaacaaatcgcggtggatgcgccaatcaagccaaccgcggtggcacattcttatgaccagttgcgggaattaatgttgtaaaagcaggagaagaaactacaattttagttgtcaaattggtccaaagttatttattaatcaataacttgatgaacaaaattcaaacgatatatacttgtggatgaaaaagaagttatgagttgagcctcatagctttcccaatctagagccgtgtaagccggtgactacattcaagctaaaataaccgaaactttgtcagagttggacggttatttttttgattaaattttaggatttcgatgcctaacaaagcaaaactaactactagggttaatgcttgaaataccgccacaccggtcccttctggtgggaaaatacatattaatcatcggcatcactccactttctgtgaggtttagccaccatcttaacttttctatacttaaaattttagtatgttcagttgaatggtgcttttaaggaaaaagcaccgttctctttcttctaaattttgctaaatgataacgatcttaagccttcacgatttagtatcattaagaacaaagaatggttagaatacaaaattttaataaacaaagctttgcgccgcctgatcggggggcgtttttttgtaccttggcgtaaggatggcgattttattttttgttagctttcacctgttaactctcataaaaatactaatttagtaataaagtccaaagcaaagtttcctgacaaacgggatagtaagagcaagaaaaatatctaaattaaatgccattttaaatttttaggaaatccattgttgacttttatgtcgataacgtcatataattacttttgtcgataacgacataacattcaaaagcaggtgaagtaataatggaaaaacaatttaaaactttagaagactttttaggaacgcactttatttacacatacgataatggttgggaatacgaatggtacgctaaaaatgaccatacggtagattaccgaattcatgggggaatggttgccggccgctgggttaaggaccaagaagccgacatcgtaatgttgacggaaggtgtttataagattacttggacggaaccgaccggaacggatgtggcgctagacttcatgccaaacgaaggtaagttgcacggaaccattttcttccctaagtgggttgaagaacatcctgaaatcacggttactttccaaaatgaacacattgatttaatggaagaatctcgtgaaaaatatgaaacttatcctaaactagttgttccagaatttgctaaaattagttacatgggtgatgccggacaaaataacgaagacgttatttctgaagaaccatacgatggtattaccagcgacattcgcaacggaaagtattttgatgaaaactacaagcgaattaacaagtaattaatttttggaggagttcgcatgccacgaccacgagttttaccgtacattgttttaggattgttaaataaaaatggggttatgtctggaaaagatatgattgcggaatttaagaacgaaattagcgagttctggacggtttcacacagccagctgtatcctgaattacaacgaatgacggacgaaggccaaattgaagtggttgacgatgaacaaaatcggaaagtcattaactacgcaataactccgaagggccaaacagatttgcgggaatggctcgctaccccgatcacggccaaaaatgatgaactgacgtcacttaaaatgtactttatcgctgaccgacatgatccacttttacagcaaattttaaaacaggcggcggaccttcacgaacaaaaagtggcccacttaaggcaacggcaaaaattactgtttgaagaaccatctgcgattgaggaaaattacggacattacttaattttgtcccgggcggttgaaagggaagcatcccatttagcctggctaaaaaagcacatcgaataatccgaaaaacaggtttacaagtaggtggacgtgggaaaattcgggtggcttgcgagcactaacccaaaatcggtagttgtgcctaaattgggcgtaactaccgatttggggcccttaaagaagtcgtcaccaaaacagcactgagaagtttgcaaactctcagtgctgttattttaatatcctttttaattaacctttaccgccttgaaaggatggataaagagtcatcccgccatcaacgaagagggtaattccggtgacgtaacttgattcagcggaagctaaccatgctgccgcagccgcgacctcttcgggatccccaattcgttgcatgggaatcatactggtagtggtttttaactgttcaggatcggcaaatttttttgcgttgatgggcgtattgatcgcgcctgggccaattgcgtttacccggatgtgccggtcggcgtattccatcgcaattgtttcgttgaacagttttacgccgcctttgctagcagcgtagtgtgcaaaagttggccacggaattttctcgtgaacggaagacatgttgataatgtttccgggtttgtcatgcgaaagaaaataattaatggccgcttttgaacctaaaaacacgccgtttaggttgacgtcgagcactcgtttccagctttcaaacgataattccgcagtcggttgttgattttccatccccgcgttgttgacccaaacgtctaggtcgccaaattgatcgacggccgtgtcgactaggcgcttaacgccttcttcggtcgatacgtcagcttgcacgaccacgccttcaccgccggctgcgttaatttgatcccgtacggcgttggcgccatctttatcagagttgtaattaataacgacgtgcataccttcttgcccaaagcgttcggcaatcgcgctgccgattccttttgagccgccagtaatcacggcaacttttccatttaaatctttatataacatagttattatccccccagaacataactgtaaaataaattcttgatgttcgtaacgtatgataacatcagaaatcacagtaagggaactgaaacgatttggcgttgcttaccttatgcttagcttaatatttttgggggattgttgctatacacaaaggcaaaataaccctgtaaaagcaaacttgattttatagggtcgatgagttttaaaaaaggtggagtgattggattaaaggcaataaaattaacaaaataatgatgataatcatgcttaatccaaagaaattattcgggttaaaggtcaccccaaagccaaatactttggggattaagagtggcgaatgccaatcgaggtggagatttcggtcatttttaagccaggttacgtaaacggtcgccaggatgagacagatcgccaaaagcaatacgaaactaaccataatataatactccgtttcgggaaaatatttgagcatagaatagcatactaaaggcgtgaaaacaacgaaatcccaatttacaaaaataattttctatgctaatcttgaagctagctaattgaatataatcaaaaaccgtaagaagaacaagtattttaagcccgtaacttaaagcgaattgaggatggtggaagctcaagaagttattcttttaagaaaaacatcttctttgtttctaggctgaacgattaagcgtccagtaagtctagacgtgaccgatacgttatcgtttggagagcatattttagatgtgcttttagagatgtttatttttaaacgaattttgggtggtaccgcgaagtctttcgtccctgttacgggatggaagacttttttattggcggactttttacgaagacaatggagggatttttaatggaaaatacgttggttaaatcactttatgcgcaagcaacgcatgatgaagatgtagcagtagaagtaacgggttggctaaaaacgctccgttcttccaagaaaattagctttttggaaattaacgacggttcctgcattaaaaatgtgcaggtaatcatggaaaatgggttggaaaactacgaagaaattaagaaagctcccatttacactaccttaaaagtagtcggaacggtagtggacactccgaaagctaagcaaccgtttgaaattcacgcaactgaaattgaagttttaggtaactcagacagtgactacccacttcaaaagaaacaccacacaccagaattcttacgtgaacaagcacatttgcgtccgcggaccaatactttctacgcagttttccggattcgttcgttggcagcctttgccatccacgaattcctccaaaagaataactttgtctacgttaacactccgttgatcacttctagtgatacggaaggtgccggtgaaatgtttaaggtaactactttagaccttaacaacgttccaaagaacgaagaaggcaaggttgattctactaaggacttctttaagcaaccaactaacttaacggttagtggtcaattgaacgcggaagcatttgcgttggctttccgggatgtttatacttttggcccggctttccgtgcggaagattcacacactacgcggcatgccgctgaattctggatggttgaaccagaaatggcgttcgctaacttgcaagacgtgattaacgtttccgaagacatgttgaagtacgtgatcaactatcttttggaaaatgcttctgatgaaatcgacttcttgaaccaaaacgtggaccaagaattacgggctcgtttggaagcaactcgcgacgccgattttgcccaaattacttatacggaagcaatcgacaagttgttagctgctgaccaagaattcgaaaacaaagttgaatggggaattgatctccaaactgaacacgaaagatacttgagcgaaaaagtttaccaaaagccagtgttcatcacggattacccacgcgacatcaaagccttctacatgcgggaaaacgaagaccacaagacggttgccgcagtggacttattagtacctggcattggcgaattgattggtggtagtcaacgtgaagaacgactagctaagttgaacgaaaagattaaggaatttaacttggatcctgaagaatacaagtggtaccttgaattaagaaaatatggggaaacggaacactccggatttggaattggtttcgaaagattattgatgtacgttactggtgtggaaaacatccgcgacgttatcccattcccacggaccccaggtaacgctagcttctaattcaaaacgttaatagtaagcaaaaagccttgaatttagtcagatgatgacggattcaaggcttttttgaatatttagtggctgcacaaggggtgcatcctaatctcccaacgaaaaccgcagcttcatattgcgggaaccgaggttgattgcatcgttaagcagtttagtagcctgggctaaggtgaaatcggccattgcctggttagcggacgttaaatgtttttccgtgagggtggcttggcgatccgtttctttttgcattcttagcacgttttggagtaccgtttgggcaaagttttcctgtaaatcttggtagagagcaaaatttccgtctccaattaaggcaagcacccggctaatccagtacatgtagttggtattcactaccgtgggagtatcgcggtagcaagccggagtatccgcgacgttactataaaacggcaccatggcgttgaacgtgttgggaccaaaagctagccaatgaattcccgcgatttcatcgggaacttggttgcgtaactctagaatgtgagtttctagattgcgattgatgccgattggccgaaaacgtttctcgggcacagtttcgccataaggatcgtagggcgtttcttgatagtgtgaactcaaaagaaacttcaaatcttccacagaaattttcttggttgcacgattaatgaaaggtaaatcctggtcggtaggctctccaacaaaattatcgtccaaaaattggtggacgtaccaagcccgggggttattgtagtaccggtctttaatcgtggcactaccaaaaatgtgccgtaaattaaagccttcgtgacccggattaagttgatttttggcaatgagttccgggagatccgcagaagctaggcaatcagctgaatcaaaatcgaaatcggtgatgttccagcggttcggcgcaattgcataggcatcgtcgggaattcggattgcagtccagtgatggcctccgatggtttccatataccaaatttcttcgcgatcggcgaaggcaattccgttggattcgtaagtaccgtattcttctaaaagtttacctaagcgtaagacgcccgccttggcggactcgatgtacggcaaaactagcgtaagaaaatcctcttcgccaagtcccttttcgactaacggatccacgctaagtacccgggcgttagtagtaatggtttcggtagcggtcatcgccgtatttttactgttgatgccgccagcaccccaaataccatacgtggggtcggcatcgggcgtggcggtgtagcggagcggattgtcgggaaggggaatcgttaaatcactatggacagaatgatagggttggggctgatcttcggggttaacgaccacgaaccgttgggcattagaatcatcggcaccgtcttcgttacgggcaatgatggtggaacccgtcaggctagcgtttttaccgactaaaatagtggtgcaagttttcaacatgtgcttgtcctccaattgatttttactgtaatggtagcacgattagctaaataggcaatcactattcagttagaaaagggaatgctatcatggtcaatatacagtttaaactaacatgaggagcgttaagcaatggttaaaacaattgcaatggaagatttttaccaaaaatatccgctaactaccgccgttttattggacgtgcgggaaccagacgaatttgcggctgggcacgcggtgggggcgcgtaattttcccttaagccaactgtccacccggttagccgaattagaccaagcgaccgcatactacgtgatctgccgttcgggaagacgttcagcaaacgcgtgcggggtactcgaagtccagggctttgatgcaaccaacgtggccggcggaatgctagcttggccaggaaaagtggaaaaagactagataaaaataaacgcgggaaacaaaagtcgggtaatttctgagcgttaactgaaaatagaccattatgccaaattcaggcataatggtctatttttggttaagcggaacaaactaatttttggtgcacaaaggcccaacacccgatttactatctaaaataccaaaccagtacttgtaaagctaaaaaagttcccgcggcaacgccccagttccatcggggaatggcgtaagtttggtagtgggtgcgcgcctgattttcgctaaagccgtgggaatgcatggcaattgccaagttatccgaccagcgcagcgatagtaaaatcgccttaaaaaagattgtgggggaccagacgtgtaaaacttcaccacgcatcatggctgcggttttaatttgttgaacggccgtttttacccgggggatgaagtaaaaggcgcctaacgatccgtaaacgaatttggtaggtaaatgccaattttgttccagggaacctagcagactttcgacggtcgcggtaaaggaaaatgccccacccaaaacaatgtaagcgtaaacccgggtagccattatccaagcggtccgcaccgcgttgccagtcccgtttaaataaaacgaaatccaagttgctacggcaggaagcagcgggattaccaaaagcagacccagtttgcgcaccgcaattcgtttccaaagcaagtaggctaatccgccaatgataatcactaggttaacggggacacttttaacaaaggcaatttcaaaactaattgccagaattaaaatgaatttaactgatgaatccatttagctcctcctgataaataagctggtgatcggtcagtgccaaatgatagtcaaaaaattctggtagccccgtcaattggtgactgatcatcacgatggtttgtttttgtacttgggcagctttttgaattaattgcataaccacccttacggaagctaagtccaagccggccaaaggttcatcaagtaaaacgagcgggttgcctaaaattaacatggttaagatttggagctttttcttttgcccgcccgaaagttgataaacaatctgttcttgtaactccgctaaattaagacgttccagccagtcctggatacggtcggcagtccaatattggggtgcccgggcatgctgtaagcttaggtcgatttcttccgtgacggtcattttaagaaattgcatttcagaatcttgaaagaccaccgtagcagttttggcccaagttcgcgcgttgaactgagaaagcggccgattatcgtaaaaaagtttgccctgatagggatgaagtcgggcaattgcttcgaataacgtcgactttcccgagccgttttcaccagtaagcaaaattaagtgttgcttggggaaggacgtttggacggcctgaagtagataccggcccccgttttcaatcccaaaatcttgtaactttaggattgcagcggcgtttgcgttaggaatcgggaacgccgtgcgggtggttaactggtaacgtgcaaaaatcggttgtggatcagtaattaagctaacttgttggtgatcaagctggtataagtgatcgcaaatttccgcatagtcgttgagatcgtggtcggcaattaaaatcgtcttgccttcttgtgcctgcagcttttttaaaagcttgatgagggctttgcgagattttaggtcaacgttggcaaatggctcatcaagtaaaattaagtcactgccggttgccagagtaatcgcgagggcgactttttgcagttctccgccagaaagggtggcgagttgccggtggcgcaagtgagcaatccccacttgactaagcgcttgagtaattaaatcgtcaatttcatcagcgggaatagccaagttttccaaggtgaagatgaattccttttcgacttggtccatggcaaattgttctcgtggattttgaaagagcaacgccaatttttgggtcagctctgcgggttgccaggcggtaacgtccttcccttccaatttgatggttccttggataattgttcccgcaaagtgagggtacagtcctgcgataatccgtagcagagtggactttccgccaccagacggaccgtacaaaacgttgaaactaccagccgttaggtgaaagttaagttgtttgagaatcggctgagttgcctgccgatatttgaaagttaaattgttaattgtgactttttccataattggatgcctacttccgccgcataatgcccgaacgctctaccagccggttgatccaggcaactaaaacgccacagaagaaaccaattgaaataaaccgagcgataaacaaaacgattagaaagcttggacggtaagcggcatagccttcttgggcaaggctccagccgaaggtaatgatggtgctagtgacggtcgacaaaaataaggccagtttgtcgtaatggcggtagccagtgaatgtgaaaccaagctcgctcccaattccttgaatgagcccggaaagaattgcaccagcgccaaactgcccgcctaggagcatttcaaccagaccacccagagtttccgcgatgatactggatccaattttgcgggtgagcatgatgcctaaaggaccggcaatcatccataggccaagtaacaggtcgttagctagcggaccgagaccaattgcggccaaccccgccgttagaaaactatacgataaattagtggcgaaaaaaatcaccccacaaaaaatcgcgattaacacaataaagactacgtctcgtaacgaataattccagtttgcttttttagtattcataactaaaaaacctcctcagtaaattaataaatttacttagaaacaagaagccagaaaaatagccagcttttcggcaacgaaaaactggctgttattatccaatatctccctacgctaatactaattagaccaggttcaatgggtattatctcagccaaaacggcaccccagcattgttgtttttaagtttttactatgaagcaatcgtagcattttgtaatcggcttgtaaagcggttacttggctgcaaatggtctacctgaaaattatggaaacaaattggtaaggtcacgttattcttaatgttagatatgacaggggacccaaccgaaaaaataacaggggtaataggacgatttgtgaaaacgattgcaaattggtactggtaggtttatgcttaagttgatagggaatgcgccgaataaaataggtttaggaggccaatgaaatgagtagactagacggaaaagttgcgattattactggtggagtaaaaggttttgggttagcctgtgccaaactttttgttcgggaaggtgcaaaagtggtgatcacggacgttgatgttgctggcgcaagtgaagcattgcaggaaattggcgaagataaggccgttttcgtcaaacaagacgttgcggtggaagataattgggaacccgtttttaggacggcaattgataaattcgaaaaagtggatattttggttaataatgcgggaattttagcctttgacgatgctgaaaatattgaacttgacgaatggcacaagattttgtcggttaacctggacggcatcatgttaggagtgaagtatggcattcgacacatgaaggaaaagggtggttcgattatcaacatggcttcgattgcgggcctgattgggatttctaacctgtacgcgtataacgcctcaaaaggtggggtgcgtttacttactaaatcagcagccttgtactgtgcggagaaacattatccaatccggattaattcggtacatccgggatacgcccacaccccgatggtggatgcgtatcctgaaatgcgggcggacttggagaaactacatccagttggccgcctaggcaccgcggaagaaattgccaacatggtgttgtacctagcttccgatgaatcctccttctcgactggctccgaatttgtggtggacggcggatacacggcacaataggtttagcacgctactcaatttaataatggattaataaaactggtccaaataggaggttaagcctatttggaccagttttttagtggcagtgatattggtaatgagtagagaaacgtacgtgtacgggtagttaacttaaaaaaataaatttataatgtgcttctcagtcataactatgggcgtgaagctaaattgtttttccatgcttttgtgatgaaaaacaatttaaatctaaaaacctggtccgcaactaaactgcgatgaccaggtttttgattgttattttaaattacgttacatacaccatatatagtggttgatcgttcgttaagcacatatatcttgtgttttcaacctttatctttttgcgaaatcggagtaatctatgatgtgaagagaaaccaatcaagccagtttcgaatatcgaacagctttaaataaacagaaaataataacgttgtttattatagcgagaattgaacgagattggaataaaaaattagaaaaggacgggtggttaaaatgatcaattcgcaagcaatcgcaaccgacgcttggactgaattacgtcaaaaacaagtagttaaagcagatggggaaaggatgcaattttacccctataaaatcgcgctagtggttgatcaattaaccacggacgaggttgaacggcgaaaaattacgcaagcaattttagagcagttaacgcaaatggcgtcgccattaacggtagaacaaattcgggcggtttttaaagcaattcttcatgattatcaacgggacgacttgtggaaaaaatatgctgaatatcggcaagccgatgaagccaagtggcagaccgcaattgatccgcaaaataaattaagccagttatttgatggacaggatacggtagttcacgaaaatgctaataaagatagcaacattttcagtactcggcgggacttaacggccggaatggtcggcaaatcatttgggttaacgatgatgccacagaccgtagcaaaggcccacttgcgcggcgacattcattttcatgacttggactattcgccgctaacttcaatgaccaactgctgcttgattgacttcaagagtatgctagcgaatggttttaagattggaaacgcggaagtagagtcgcctaagtcgattcaaactgcaaccgcccaaatgtcgcagattattgcgaacgtggcatcgagccaatacggagggtgttcgtcagaccggacggatgaaatgttggcgccttacgcaaaattaaattacgaaaagcacttgaaggaagccgaaaaatgggtgctccccgaacaacgggaggcctttgctaaggaaaaaaccaagaaagatatttacgacgcaatgcaagcgttagagtacgaagttaacacgctgttttcatccaacggacaaacgccgtttaccacggtgggatttggtctgggaacttcgtggatcgaacgggaaattcaaaaggcaattttaaaagttcgcattaagggactcggtaagcagcaccggaccgcaattttcccgaagttggtcttttcaattaagcgcggaataaatttaaatccggaagatcccaactacgatatcaaacagttggccgtagagtgcgcaactaaacggatgtatcccgacgttttaatgtacgacaaaattgtggaattaaccggaaactttaaggcgcccatgggttgccggagcttcttacaagcttggaagaacgctgatggcgaagaagttaatagcggccgaatgaatttaggggtcgtaaccgtcaacttgccacggattgcgattgaagcccagggtgatcgggaagtcttctgggagattatggaagaccgggtggcgttggcgaaaaaagccttactcttccggattaaacgttgccgggatacccaaccgcaaaatgcaccgattttgtataagcacggtgcctttggggtccgcctcaaagatggtgacgacgtggaccaactgtttaaccaccggcgggcgaccatatcgttaggttacattggattgtacgaagtgggaaccgcctttttcggtccggattgggaaggtaatcaggaagcccacgatttcacggtttcaatcgtgaagtacctgtacgaacagtgcctagcttgggaaaaagagtacggctaccatttcagcgtttactccacgccagccgaatccttgacggataccttctgtgaggatgacattgaaaaattcggcaagattcaggacattaccgacaaggaatactacactaacagtttccattacgacgtccggaaaaatccgactccgtttgaaaaacttacttttgaagaagagtacccgaagtacgcggccggcggttttattcactactgtgagtacccgaatttaaaacaaaatccggctgctttagaagcagtttggacctgggcttatgaccacgtgggttatttagggacaaacgcttcgatcgaccactgttataaatgtggtttcgatggcgactttaaacccacggcgcgtggctttgaatgcccgcaatgtgggaatcgcgaccccaaaacttgtgacgtggttaaacggacttgtggttacttaggaaacccaatgatccggccaatggttcacggacggcacaaagaaatttcgtcacgggttaaaaatatggaataggggtgaaaacgtggttaaacaacgacgaatacggtcaccgagaaatccccagccgcaagaatggctggcgaaggatcgcagtttagaatacattgccgactataagccgtttaacatggttgacggggaaggcattcgttgcagtttgtacgtttcgggttgtttattcaactgtccggggtgctacaacaaggcggcgcaaaatttccattacggacgcccctattcgcagaaattagaagaccaaattatcgaagacatggggcaaagttacgtacaggggctgaccttgttaggcggggaacccttcttaaacacgcaggtttgcttgcggctagtccggcgggtgcgccaagaatttgggcacgacaaggatatttggtcgtggaccggttacacctgggacgaactgatgcaggaatcttacgataaattggaattgttaagtgaactagatattttggtggacggccggtttttagaagctaaaaaagatttgacgcttcaatttcggggaagttccaaccaacgaattatcgacgtgcctaaatcgttagccgcaaaccaagtcgtcatttgggataaattgcttcgttaatgtaggagaatttgatgagtaagttagaaattaaaaatttaaaggtcaatgcgggtgatgagcgcattttaaacggggttaatttacaaattaatccgggagaaattcacgcgttgatgggacctaacgggactgggaagtcaacgctttcggaaacgattatgggaaatccgctctacgagattgtagatggccaaatttggttagacgggcaagacatcacggaaatgagcgtggacgaacgggcccgggcgggagtctttttagcgatgcagtatccgatggaggtcgcgggaatttccaacgccgacttcattcacgcagcgttaaacgcacgtaaccaagatcaaccggttgccgtactgccctttttaaaacagcttaaagcgaacatggaatttttagaaattaatccggaatatgcggaccgggggcttaacgccgatttttccggtggtgaaaaaaagcgtaacgaaatcctgcaaatgatgatgttacgacccgagatggctattttagatgaaattgattccggattagatattgacgccctcaaaattgtggcaaaggggatcaacgcaatgcgcagtaccacctttagctgcttgatggttacgcactaccagcgcctgttgaactacgtggtgcctgacgtggtgcacatcatgatggacggccggattgttaaaagcggcggccccgaactagctacggatctggaaaagactggctacgctgaattagaggaaacgttaggaagtgaaaccagccatggcgattcccttgaataaaacgacgaccgcaagttatccccgaattttaggaattcggtatgaccccgcagtttttaccttgacggattcttccagcgccgcttgggactgggaggccaacgcggaagctttacaagccattaatgcagcgggaggtacggtccggcgcattaatggtgcgccagcggaactatccgggctgacccaattactagcttccacggacaaccaatttgtgcaacaacacttgcaagaccacctccaaggtgtggtaatcagtttgccggaccacgcggaaatttcgccaacgctaaacttaaccttgcgaacggagtcagcttttcctgtggaatggacagtttggtttgatttaggggaccatagtcggctgaccacgaagttaacgctagatttagcaggagaagtgccccaatccaactgtttgattggggggactttagcggacgaaagcaatttgacactcatcaccgacacgcaaagccatcaggctacccgaagtttattgctaggtgattttgtgagtgctcgggatgctaacctcgattggtccttgtggccacaaactaagggccagctgttgggtgatttaaacgtaacgcttgctggaaccggcagtcgggcaacccttaacttggcgcgttacggctaccaagatgactgggtgggcatccgtggtcaaattaagcatttgggccaacatacttttagccgaatcaacatgcggggagttttgtacgaaaattcccgggtcaactttacgagcattggccaaattgatcacggggccagtgatgcggacgcggaccaggaaagtcggttaatgaccgtagaaccgcatgctaagggcagcgttaacccggtcttagtgattgacgaaaacgacgtccgagccggccacgccgctagtgtcggccagtatgacgaagatgaactttactacttacaaagtcggggactgccgatggcgacggcaaagcaaattttaattgataactttatggaaccgatttggcgtttgcgcaacggggaggttggctaagatgacggattaccaagacttaacttatttggacaacgcggcgaccacccccatgccagaggaagttttagcggtaattgacgagtattaccggtttaacaaggtcaacgtccatcggggaatttatcagcttgcgggacgggtcaccagcgcttatgaagcggttcgcgaacaaatcgcccagtggctgcatgcttctcaaacagagtcggtcgtttttaccagcgggactaccgacgcgttaaaccaggttgccttcggatatgcacagccacggttgcagccgggtgacgaaattatcgtcagtgtactcgaacaccattctaacttagtgccttggcaacgggtggctgcccaaactggagcgcacctgcgaattgtgggaatggattcgcaaggtaacctggattatgctcaattagcagagcttatcaatacgcataccaaggtagttgcgctcacgatggtttccaacgtgttggggacggtggttgacgtggcaaaggttgcccaactagttcatcagtatgacggaatcttagtggtggacgctgcccaagcggtcgcccatttgccaattgacgttaccgccatggatgtcgattttctcgcgttctccggacataaaatgtttggtcccacggggattggggtgctctatggcaagctagctcggttagaggagatggaaccggtccgttttggtggcgaaatggtcgacttggttacgccaacttcggcaacttttcagccgttaccaatccgtttagaagcggggacccccaacgttgctggcgtactagggctaggagcggccgtgaagtatttagaaaaacaggactttgccgctattcaaaaacatgaagcacgcttaatgcagtttttacttaccgaactccaggaagtgccggaggttaaaatttacggcccgttagactatcaacaacgggtgggagtggttagctttaacgttggcaaacaccacgcccatgacgtggccacgattttagatgcttcgggagtggccgtgcgcgccggacacctgtgtgcggaaccattaatgcaagctttgaacgttagtagcgtcgtgcgggcgagctttaccttcgaaaatcagattgctgatctgcaacgcttagtggacgcggtagaacaagtgggacgaattttatcatgaacaatttacaagagttataccaaaaaattattttaaaccacgctaagaacccggtgggctacgggacagtcccccacgcaaattgtgtcggggcgttgcgcaatcccgaatgtggcgacgagattacggtttatgccgaagttgacgcacaacgaattcagcaactgggtttcacgggggcgggctgtgtgatcagcatggcatcggcaagtatgatggttgcgcaattaaacggccgtacgttagcggattcccaccaactctgggaaaatttccaaaatttagtgttacaaaaggattgtgatcccgatcagctgggggatttagcggcttttgctagtctgcaccagtttccgacgcgggtgcggtgcggtaccttagcgtggcatgcactcgcagaaggtttaaaggagaagggggaagtttttgatggatgaagtcagtccaacgcaaccaggaaattttaaggacgaatgggggccgatggatgacgtccagccggtcttttcaaccggggtcggaattaacgaggaaaccatccaagccatttcgcgggcgaagcaagagccccaatggatgctagacttgcggttacaggcctaccaaatttaccaatccatgcccatgccgagctttggaccagaccttagtgagattgatctgaacgaaattaaatacttccagcgggcaacggatcatattgctcgcaactgggaggacgtgcccgacgaaatcaagactacctttgaacgaatcggggttccagaagccgaacgaaagtacttagccggttcggcggcacagtatgaatccgaagcggtttaccacaacctcaaacaggatttagaaagtcagggaatcatttttatggatactgattcagctttgaaacagcatccggaactagtccgacagtactttggtaaattaattgccgcaaacgataataagtttgccgcattgaataccgccgtttggtcgggtggaacttttctatacgtgccgaaaaatgtgcatgccgacgtgccgatccaaagctacttccggattaacgcgggtcggacgggtcagtttgagcgaaccctgattatcgtcgatgaaggcggcagcgttaactacgttgagggatgcaccgcgccaaattatgcggaggatagtctgcacgccgcggttgtagaagtgttcgttaaaaaggatgcctattgtcgctatacaacgattcaaaattggtcaacgaatgtgtacagcttagaaaccaagcgggcccaggccgaagcaaatagcaccatggaatgggtcgacggcaatttaggctcaaaggtcaccatgaaataccccagcatttacctaacgggcgcgggcgccaccggttcaatgctgtcgattgcggcggcgggtgccaacatgcaccaggatactggcgccaagatgatccatttagcaccgaacacccatagcacgattgtttcaaaagcaatctgccataacggcggtcgggcggactaccggggattgattaagtacactaaggcggccaaacgggctaagtcccacgttgagtgtgatacgattttgatggatcaagacagtgccagcgatactttcccagttaacgacattgaaacgagcgacggcacgattgaacacgaggcccacgtttcgaaaatctctgaagcccaattgtactacttgaaaagtcggggattagacgaagcaaccgcctctcaattaatcattatgggatttttggagcccttcaccaagcaattaccaatggaatacgctgtggaattagatcggttgattaagtttcagatggagggcagtatcggctaaagctgtgaaatttgcgaacgttatgcaaaattttgctaataaaaagaacggcgaattaacgccgttcttaaacgattgataataaattaaagtggaaaacatttttaaataatagagccaaaacgtgctcccaaagtcagtttgcgctgcttaatagggaattggtaaccatggtaatgcataaccaccgattccttgttaatgctcacgaactagccgactttgggggcgcgttttattttaaagatggaaggcggcttgcacacccacaatcagcattttgacgccgatggttgctaaaatcagccccattaacttggtgatcacattcatgatgttgttgccgagcctgtccatgatttgttcaccgtagataaaaatgaagtaagcaatgatagctaaaacaacgaacgcggccacgacgatgaagggattggttccactagccaagttcatggtggtggcaatggttccggggccagccaaaattggcatggctagcggggaaatcgcgacgttggtgttactactgttgacggaatccttaacggatttttcgggatcgtgctggatcggcgaaacgttaccttgaatcatgtggtaaccaatcaatcctaaaatgatcccgcccatgatgcggagtgcagcaaggttgatgccaaaaatggtgaagatgtaatttcctagaaaggcaaacaacaccacgatgacggtcgccacgataaaagccagccgggcaatcgcgttgatttccttgcggctgttatcagcagtcaaactgacgaacattggcaagttagcaaaggggttcataattgcaaaaaatgcggtgaatgaaagtaaaaatgcttgaactaaatgcatggtcgtcctccttgttaaacgttttcaatgcaatgattgttttttaattatatgggttaggtggggaaatgccaagtttggtgatttttggttaagcggaaccaactgacttttgacacacgttttggctctattgaagtcaaaacgccaaaataaaaacgattcatgaggaagtttcacttcatggaccgttttttatttagagccttttgtcacagcccttttatttattgataaggacggtaatgagaatgtttgctttcaaattccttgatttcggcaatttgtaaatctttaaaggtgattaaggaaacaccgtcaaacttgaaattctttccatgatcaacgcaagcaaacatccattctacgatataagtagcgccatcatgatagatatttttaatgtcccagcaagtcacggtttgtaccttgaatttatgagttatccaccgctgaatctcttgaatgccaacgtactccgctccatagcattccacgtaatgcacagctggagtgaaaatttgtgctaaatcaattagctttttatttttccacatgttgaagtaacgttggatgagttcaatttgctggttcatgagggtgctccttattttgattggttaaagttggtgactcatttgatgagtgatggttattgtttatatataactgatttcacttcattttaacactaggaaattgttaacttagttacaaaaataatcgtttattttgaagttgtctaaccgacaccagaaacaatttacttataaggataaaatacgtatgataaaggcgatgaaaggagtaggatgtgctaaaaagcgggtaagcaaatggtaaaacttaagtgattcattagcacatccaatgtgtactcgtgaaaagaaagttaatttacccagtaattataagcgaatataaccatgaaggtcattattatgtagtcacttcttaacatataggggatggtgactcagggagatacgttcgaagacgcggtttactgggcggaagatgccattggaaccatgttagatggcgaaaaatcctatcctaaggtccaagatccaagtaattggaagttaaataaaaatgatcggttagtttacattaccgttgatatgagcaaatggctaaagaacagaatattaacgtatcgcgggttgctagcgaagcgctgaaaagggaactgggaatctaatcatggaattagatttttactatgcaatccatcccttagtccaccacctcaatcaaagttatgctatgctagatgcaacattttttagggaggcaggattttgcgagttaatcaacatcaagaatggctagttaatttttatcagaaacggaattggtatcagctttccccgtttgtgcgccttaattttttaactgaagaagtgggggagttgtcacgagcaattcgggccatcaaaattggccgggaccatcctggagaaccgcagcccaacacggagcagttgcgcgataatcttacggaagaacttgccgacgttttggaccaactattaattattagtagtaaatttgatatcgccccagaaacgttgcttaaatatagtgaggataaattgaaggcgcggtttaaggatgcgctgaatgaagaataggatgataataaaaaagttctaaccgcttagcgattagaacttttttatttggaaactaaacggagctccaacttcaaataatattatttttcaaggaattccataaacaatttttgatagatttcaatgaaatcaaagtacatctttttaggtaaactttcatttacttgatgttgtgagccgtcacctgggccgtataccgcaaaaggaaaatcgtttggtttatcctttgctaagttagaagcatcggtaatccccgggctagcagccacgacaatctcacgtccagcgtattccttaccgattgattgaatagtcttaactaattggtttgaaggactcgtcgcaatcgggaactcattcataattatttccgtgctaatttgcgcgccggcgtcgttataagttttaaccaatgtttcaatcttcttagctacttggtcattatcatattctggaatggtccgaacattgattaaggccgtggctgaatcagggatggagttaatttgatttccaccatttaaaacatcaatgttgaatcttaccgggcccatttctccagcagggattgtttcaaaatattcgttagcttcatttagtagttgcatcaaaggaactagggcgttatagcccttttcaggtgtcgaactatgcacagaagtacccttagaagtaaatttaatatcaaaagaacccttttgttcggaagtagtgccgtaagttgaggaaggttcggcgatcagcaaaccgtccgcgtcttccatatagtggtcacggtaaaaggctgcggaaccttcttcaccaacttcttctccggcagttgcaagcaagcggatggtaccttttttaggcaagccttgttttttcaattcaatcatggcgattactaaagccgctaaaccagccttcatatccgtaatccctctaccaaagagcttgtcatctttttcagtcatggtaaatggatcgctatcccacgctgctaaatttccgggatcgacaacgtccatatgccccgaaacggcgaggacgggagcaccactaccgatttcagcaactaaattagcacgttggcctttaatcgggagaatttctgagtgaatatcatttttctggaataaatcttttagatattctgcgacttctagttcgtggtcattaacggacttaattttaattaaatcagctaaaatttttaaatattcttgattttctgaaagcatatttttatcacacctttccctttattactggaaaagattactactttctaatgtaaaaatctacttttaaaaatacgacaaatatgtccaaaaatcattggtacgggctggaggatcaatgctaaatgatattttttaaaatagaaggactaaccgccacgggatgtcgattgcattttttggaagattgtttaacagaaaatataacgtattcgtaggctaaacttgaagaatttacagaaggcaaaactagctctttaaaatatttaacgcttctgaaggcctaacaacgaggactttatgaattaggaatgaggaaaatgagcattttctatacaacttactttttacaagaggtacaatgtaaaacataccttaagaataagttacactcgctgaggaggaatgacgatgaaagcaattacgattagagaatacggggacgttaaccaacttcacgaagaggaattagcgattccgcaaattgcggacgacgaagttttagttaagatcaagaatactagcattaacccaattgactggaaagcgcgtatggggcttttgaagcaaatgtacgattggcaatttccagtggttttgggatgggacctttcgggcgtgattaccaaagttggtaaggacgttaaggagtttaaagtcggcgacgaagtattcgcccgtcctgacatctatgaagacggaacgaagggaacctacgcagaatacgcggcggttaaggaagataaactagcgttgaagccagccaacgtttcgtttgaagaagcagcggcaatcccattggcggggctaaccgcatggcaggtaatcgtagaccgtttaaaggtgcaaaagggcgacaaagttttaattcaagccggagccggcggcgtgggtatttttgcgatccaaattgccaagcatttaggtgcttacgtggccactactgccagtgctaaaaatgcagaatttttgaagggcttaggggctgatgaagtgatcgattaccatgagcacaagatcgaagacgtccttcaggattacgacgccgtttttgacacaatcgatgctttggatgagggcttagcaatcttgaaaccaactggtaagttagtaacgattgccggacatccaacccaacagcaacaagaagcgcaaccttcagcaacggcctggtggctccaacctaatggcaaacagttagccgaattaggtgatttagtggcaaagggtgaagttaaggtgatcattgatagcacattcccgcttacggaagatggtcttcgagccgcacacgaacgtagccaaacgaaccatgcgcgggggaagattgttattaacgtgggctaataagtggaaagttcatgagttccgcgtaaccaaaaattgcccattatgcccaattcaggcatgatgggcaattttcagttaatgctcgcaaactacccgacttttgtcccacgctcttttttacacttatttgcgttataatacaggaaaatagttaacaacaaaggagaaccgtcatgaaagcaaccgtatttatggaaccaggcaaagtggaagtccaagaaattgaaaagccaactttgaagaaaccaactgacgccgtaatcaaagtgcttagagcgtgtgtttgtggctcagatctatggttttttaggggaatttcagaacacgagcatggttcggcagtaggccacgaagcaattgggattgtggaagaagtgggtagcgacgtacataacgtttcggtgggagactttgttatcgtcccgtttacgcacggttgtgggcactgtcccgcatgtttagctggttttgacggtgattgttataatcgcgaaccaggtaataacgcctatcagtgtgaatacgttcgttatgccaacgctaactggggattggtgaagattccgggccaaccagatgattattctgacgaaatgttgaataatttcttaaccctgtctgacgttatggccacgggctaccacgcggccttcaccgccgaagtgaaacctggggatacggtggtggttatgggagacggtgccgttggattgtgcggggtgatttcggcaaaattgcgcggagcaaaacgcattatcgcaatgagccggcacgctgatcgacaaaagttagcccttgaatttggcgcgactgatattgttgaagaacggggagacgaagctgtagctaaagtaatggaaatcactgacaaccacggagcagacgccgttttagaatgtgtgggtactgaacagtcggtagataccgccactaaagttggccgtcctggcgcaattgtgggccgggtggggattccgcaaaatcctgaaatggataccaacgcgttatttagacgtaatatcggtttgcgaggcggcattgcagcagttactacgcacgatcgcaacggactactacaagcggttttggacggcaaaatcaatcctggcaaggtatttacccaacgcttcaagctagacgacgttcaagctgcctatgaagctatggaccaacgcaaagcgattaaatcattgttaattgtaagtgaataaagcgcaaccgaacgcgctaaaattatgagtattaactagaaatcggcagttatctcctgaatagggacagctgccgattttggattaaaggaggattgaacattttgaggtgttatttagggcatcttaaagtagcttctgtacgaaatattcccaccaatcaaaaaagcaagaacgctgatatcatcctaatcagcattcttgctttttctatcttatggagtcggcgggttttgtacccgactgctcacaaacgttgatataccaaagttttacatagctaattcaaaaattggctaagcttttggctatgttttataaaaaaatatgcttgcgaggccccaatttaattgggtctagaatttttggtgttggaaagtatttccattccaaaagtactaggccctttttgataacaaaaaaaggcatctaagcctccctagtgctatgctttaaacgacgaaactcaagataagcggggtagttataaatttctccgttaaaaattactgcttttgatttatcttcattgtaaataggttgcataccactgttgatatcaatgatactcaatcgacgaaatcctagcgccgtatcctcattaactaattcccccgaactatttggaccacgatgtttgatcgtatccatcatagcttctataactggctttttgtcagcaatcttcttgtctacgaaaccgacgataccgcaaatattaattctccttaaatttcaaaacttacgaatctggttgctgcaccatatccaaatatttggagcaacattttgtcgggattgatattaatgaaatatccagctaattcggaaatctcattatatcggcgatcccattttttattataatcagtcgttaggccatgttttttacccattaaggccgaacaatttaatattatatgattaatcccattaactttgtagtacttttcataatgcatgtgtccacaaatgtaattcgatatggtcgaaataccggtatcagtaaagttatagcgaacattaactccaaaatcatcggataattcatttttaagttgtccagaatccttattattaaagctagtaaaaatcttctgaactaagtcaccgttgaagttcaaagctgaacgaccactttgactgatcaaattagcatgaccaaaaactacgacatgcttatcaattgtcttttctaaaatagatattaaatcttcgatctgttgctcgcggataccacggacttttttgaagtcgtacttcttggtcccgccatttaggatatagggaatatcgctcgtattcaagaaaattactcgaatatcccctttatcgatccaagcaactttggaaccgagactcaagcgtttgatctcaggttgttcgaaatcatgtttcgttaccaaattatagtagtcgtcacgtctaaatgaggctgaagtaataaatttgtgttcatcatacttatcattttcatcgtgattaccttccagcacataaaaaggacgctggctattttggtaattttccatcgtgaattgtaacaatcctcgactgatctctggcttatcactaccgtcgatcaaatcgcctaaatgaatattgtaatccactggcaatgaatcgcaagccttattggcttcaataatatgccttacaccgttgagaccatagtacgatgaactggaaacagctttttcatgagtgtccgttaaaaccgataaagtcaagcaattttggctaaagttaggttcaacgttctttctgaaaacttgctcgatatattctgtaaaaaacggtctcggctttaattttctcaaaaagttatcagtttgaacagagataaattcagatagtctcgttctaaaaaattttttagtaagaaatttgattttcacgatttttattctcctaattggtagattgtaaaattaatccgaacgctgttcggacaaaaaggatcagcttcctttaaaatggtgtttaccacaaacccatcttttaggagctgatcttttgtctagtataacctattccaaacgaattaaaatcgaaaccttttgtgaactagggctgtccaatatccaaatgggcgttcggctgaaccgatcaccgtcaacaattttttatgaattatctcgatgtcaaccttatcaggctgaattagcataaacagatgccgaatacaagcgatcacgatgtggtcggaaaactaagctgagcgatgagttaaagcaaaaaattctcaaccatttacgtctaagctggtcaccaggaatgattgctcacgaatttaaactagctattaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaatcgcatcggcgattttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttaaatcacaatatggtattaagacctattactgccatgcttatactccagctgaacgtggtagtaatgaacgctttaatcggaatttacgttatttttatcttaaagggactcgttttgagcacattagtgctcaagatttaacgacgacgttactccaaattaaccagcgaccgcttaaaatactcgactggcaaacaccgtatcaggttatgctgacaaatttgtccaaaaattcggattaaatttgcaatctaccgtttaacttctgaacaagttgtttccgagggtattagtactaattcagatttttctgaagtctactttgctgttcaatccatcgctgatgccattcggcatcaagataaagaaaaattgttacaactgcttagaaccaagaccactactccatatcttcgtacactacttaatacttttaaaacacgcgttaaatcaatcgtatatgctctatattcaccattattaaatggtcgtattgaaggcactattcgtaaaattaaacaaattcaacgcacggcttatggatatagaaattggcagcacttgagagatcgtatatatattgaatttatatttaaaactaaaaaagaaaaccaattcgtgaatgaattgattttcttcaattgccttcagcaacacttgttgacttagagcccttaaaattcaacattaacgcaccaaatagggaccagagatttttaatctctagcccctattttttagtggataatcggattaggaggattaccacttttaaggtactttaaatggttagcaataaaataagttttgaaaaagctagtggttaagttggtaaccaacctgactgagcttatccgcgaaccttctcaccttggttgctaaccatttcgtgatacttcaggtacacctcggcgtaaggattttcacaattctcgtgccaaggctttacgtgtccgcagaaatgaattaacttaggatcttcacgtgtttctgcgtaaggttccaacaattcggtccgcggtggaaaaatggtttccattacaatgttggactgggcgttccattggggatgcaagtgtagccaatcgttgtaaaggatggcgttcaacgcgtcctgatcgtggaaacgtaatttttcggggttttggttgatgtaatctaacactttttgggtgattgacttcgcccgccaacggacaaggtcaattaacatcattcccgaattaaagtacttttcattttccttagtgattcccattttttccaaccggtcgtggaatccagcatcctctacggcagcaattacgttgccctctaagttggtttgccataattcatgcaaacttgtgttggcaatgatgtcgcagtcgaggtagattgcccggttgatggatggcaacaatgcgggagctaggatgcggtagtaggccgttttgacgattcggtcgctttctaccgcgttagctagtaattcttcgttaacttctacaattttaatcgtcgcgttgtcataccgggcaatgatgcttcccaataacatcatgtcgcgatcagtcaggtgatcgggtaacaagaagaaattgtattggtgttctggatcattttctaaaatcgaaatataagatgtggcaagcggttgaataaaggccgagtttgccgctgagataacgttaatcactccacgatgcatttccaattcaccaagttcttcgtgatactcatctaaataaggatggacggtgaggtccttccacggtttttcatgagtagtgaaatgaacaatgctaggttccttaatggcttcgtcgattagttcagcgtacccctggttgattggccgatgttttctgaaaataatcgagttttgtaaattccattttggatgaagaaattgaacttccccagctaacacggcgttaagcgcgtcttggtcgtggaaaataattcggtcggcatgatttctaataaatgccaaagttttttctgtgattcgatgggcgttccaccgggcaacatcgatcaccatgattccggaattgaaatatagattacttgcggcaaccacgggatcgacacctaggcgatgcaatgcaaaagcctgtcccgtatcaataaccgcacccacggtattaccatttaaattactttcggcaagttcggttaggtcctttcgaatcaaaacgtcaacgtctaagtaaattagtcgatcaatctgccgtgaagctagtagcttaggggcgatgattcgaaaatatgcggttttattgatgtgttggttcgttgggcaaaaatcaaaacgttcgtcgtcaagatttaaatactcaatggtatgaaaattatgcatcaatttgtctaacagtgcccgggtttggtcaccaaggttgttagttaaaacaatgaaatgggcccgggttgctgaatttaaggtttctaaagcagttttaatggtaatgcatagtgggtcagcataattacggtccgctgccaataagatattaatttttttcaaattcatacaccccttttttgatttatatgcccattatataaatttattcaaaattaagtaaagtaatatgcaatagttttgataaggaaatcaaaatatttgcaaacgctattctccgtctgtataatagtagattgtaaaattaatccgaacgctgttcggacaaaaaagatcagcttcctttaaaatggtgtttaccacaaacccatcttttaggagctgatcttttgtctagtataacctattccgaacgaattaaaatcgaaaccttttgtgaactagggctgtccaatatccaaatgggcgttcggctgaaccgatcaccgtcaacaattttttatgaattatctcgatgtcaaccttatcaggctgaattagcataaacagatgccgaatacaagcgatcacgatgtggtcggaaaactaagctgagcgatgagttaaagcaaaaaattctcaaccatttacgtctaagctggtcaccaggaatgattgctcacgaatttaaactagctactaaatctatttataattggctaaatcaggggagaattggtttctccttgaatgatctacctgaacatggcgtacgccaacggcgtaacgttgaccaacgatccaaatataatcaatctttggggcgatcaattgaacagcgtcccatgatgattaatcaacgtaagcgcatcggcgactttgaactagatacagtcgttggtcctcgtgggcatagtaaggcagttttattaactttaatcgatcgcaaatcacggttcctttgggcataccggttaaaagatcggacgacagcgactgttaatgaagcactaactaagttcctaaccacttttaatggtccggtgcacagctttactgtggaccgtggcactgagtttagtgggctagtatcacttgaatcacaatatggtattaagacctattactgccacgcttatactccagctgaacgtggtagtaatgaacgctttaatcggaatttacgttatttttatcctaaagggactcgttttgagcacattagtgctcaagatttaacgacgacgttactccaaattaaccagcgaccgcttaaaatactcgactggcaaacaccgtatcaggttatgctgacaaatttgtccaaaaattcgaattaaatttgcaatctaccgaaatacaaaatcgggaggtgaaacgaccggacgatatcaagcgattcaggaaatgatagtcgaaggctactcagttagtgaattaaccaaagcagctggaataacaaggcaggcttactataaatggctcaaacataagccaagtaagcgcgaaatcgaagagtcagagatttttcaattaattaagcagttagagaatgagcataagcaaagtgttggctatgacaagatgactaggttaatcaatttgagccaacaaatttcttacaatgtgaataagaaacgtatcattcgaataatgaaggaacatggaatcaaggctgactatcgtcagccgactcgcaagcgtatccagactcagcaagcttatgaagctgaaaacatcctcaagcgacaattcaatcagacagcagctaatcaagtttgggttacggataccacagaaataacatatggagtacggcttaataaggttcgactgcatgtggtattagatctatatggccagtatccagtaagttggttaattacacctactgaaaccgcggaaggggctattaaagcatttgaaagggcacgagtaaatgaaggagcattagctccgcttatccatactgaccgtggagcagcatatacctcaaaagcattcaaccagtatttagtgattaacaatgcacagcatagctactcagctccgggaacaccggcagataatgcggtaatcgagcactggtgggctgatttcaaagcaatttggatagctcatcttcctaaagctcaaacgttggtagaactaaaacaacaagtcaaagaaggcattacatattttaccgagaaatttatctcagcgaaaagaaatgaccttaccgcagcagaatatcgctttggcaaggccaactaatttttattatttaaagtgcaaacttgacagggtacagtacctgaaaataataaagtgttttttatatttaccaatttagaactaaaagaattacttaattgttcagaacacaaagtaatttctattaaaaagcaattagaagaatttggattgttacgacaagaaagtgtggggtttgatccaaagcaaaaaagaatttgcctaatcagctttatttaggacaactccatcttacagcaaccgatgtttataaaatgcctgatttttctaataaaacggctgaaacccttggtacaagcggaactgcaaattctgcagttaatcaagaagaatataataacttagatactaatagatactataaagagactgcacagctagatttttccactgctaatttttcaaatgctcaaattgaaaaacaaaatcaagacctagtacaacatgcaaaagaatttttgacagaagaagataataaccctattccatttgaaccagaaacaatacgactaattagtctatgggcaaataataatcctaaaatcattaaaaaaactattgggattattctaaatgctagacgagatgtccaagatttacacaaagatcatcatctattttttatcttagatcatgaaccagaattacaaaccaagatcacacaaaccttgcgtcggtattttaatgctttgcgaagcgacgataaacagattaaaaattacgagaactatttatatatcactatgaaaaatatgtttgaaaattacggtagttctaaactacaacgtgaatacaagcttgaacactcaacaaaccagatagcgaagaataatttatcaatggacttagggacggagtatctgaattaattagaaatgcaaaaaatgtaaatagtcgttaaaagctataaaatgccatataagcaattttatagttaaaacgactaattatccgtttaatatataaaaatggctgaaacacaaaaataaacgccttaattggcttttcaatagcaccaatataaaatatagaaagggataagaacgtaaaacatgaaatgagattcaaagcgagttagcaaagcatgctgaaagtattggagtggatgcccttgctgcaatcccaccaatttactttggattacctgaacacgcaattgaagcatattggacaagcatgatggaagtaactaatttagatttcattatatataatattccgcaaacaaccggttatgcactatcagaaaacttatttaaacgtatgatggcaaaagaacaagttattggggttaagaattcatccatgccagtaatggatatcaatatgtggaaattacgtgctggtaaagataatattgttttcaatgggccagatgaacaatttgtaggtggacgcgtaatgggggccgatgcaggtataggtggaacttatggtgtttatccagaattgttaatggaagcggatcggtgcgttcgtgaggatgaccttgaaaaagctcttcaaattcaacttaaaattaatgatttaatttcagaattgacatcatttaaaggtaatttatatgatgtgatgaagttaatcttagctaaacgtggggtaagtgtaggacgagcacgtaatcctttaccacatgtagaagatgatgaaatggatcatgttgaggtagtacggcaacatattgatgatgcaattgctgaatttactaaataataaaaaaaagccgagtctccttaaaagaggctcagcgtttttttaaatctgtgaccagacgtccgctcccaaagtagggaagagaggtacgatgcggcctagttgttcagctgtatattgaaactcaattgctggtaataaaacgttaattgcatcggcagcatgttcactaacttcagctgctcctacaagatgatggtcttgatcgtaaatcaaggtgttatcaccaattgtttccttatcaacttggcggaaccatccgtcaggaagatgattagttttaatggtgtaatcaggattttgctgagcttcttcgacgctcataccaacctgtgcgatttgtggtgaggtaaagacaatggttgggatgggcggatagttgattgcgtcagtagtctttcctgtgaaaagttgggttaaataactagattcaaagatcgcagtcggggtgagcttaggctgttctttatcaagcacatcaccagaagcatagatgttatcaatgttagtttgaagatgatcgttaacttcgatcccgttagcattgtaactaacgcctacttcgtctaatccgatgttttcgatgttaggaattcgtccggtagcatccaaaatccagtcggtggtgagggtttcgtgatcgttataagacacggtaaaatgagaaccgtcttcctcaaaacgatccacctgagcgttgtaaatgaacttcacccctcgtttttcgaggtcggcaatgacttgttttacgtaatcttgattaaatttgcgcaacgcccgattatggcgtaaaagtacagtgacgttcgcgccggcagcattggcaatcgtggcaaattccatgccgatatagcccgcgccaataattacgatattttcaggaagctgtttgaggctcataaaatcggtactgtcatgcgtaagttctgagcccataacatctagatggtggggacgtagccccgttgcaatcacgattttgtcagcggtgtagcgctgttgatccacttcgatggtgtgagcatcaacaaattttccacgaccgtgaataatttcgatgtcaacagagtcgagtaaaccagtaatcatgtccggcaagccgtcgatgacttcgtgttcatgttctacattggcagtccaatccagctttaagtcaccatttacaatgccatcaaggcgttcttggtggcgtaaaagttgaaccgggttgtccagcgtaattttcgcgttgcatccacggtttggacaagttcccccgattttgtccgcttcgataatggcgacttttttaccactattagctagtggaaccgccccgtcgaaggcaccatgccccgcgcctaagtacaaaacatcaaattgataactttcagtcatttaattacctccatcctaaatttaggtgaataaacaattaccattgttggcacgagcatagcagaagataggtgcgagttgcaagcgattgcaactgaagagaacaaaaagccatccttaactttaaataaggattgctaaaaaatatcttactaacgttttaatgatttaatcgatagcattgaaataccaccaatcaaggaaaaaataaatgaaacaataaaaattccagaataaccaaaaagacttatgacggcagcggctaaaacgggtgcgatagcttgtgtaattgtattacctaagttgtaaacacctaagaaaaatgcaacacgattttgatcggggataacttttaagtttaataaattatcaagtgcgttccataagcccattcctaaaccggcagctaaggcgtaaagaataataccagtattatttcttaagaagaacagggagagacctgcaattgctaataagatagttgagagacctactggtaatttcagtattttaaatttattagatagtggcccagcgactaatcccatcaaaatgccaaaaataagcataatcatgttaacaagttggatagaagattgagtttgattaccacgatgaagaaagtcggtcattatatataaaatgtatcctgtaattgcaaagtttccaactccctgaaacatttttcctataagagctaggtagtagtcgcgccaatttgccaagaaggaaaaattaactttacattttttaaagaaaacttttctttctttttagttgaggtttcatctaaattagaaggctcatggacaatcaaagttgtaattaatacgccagcaaatgtgaatataccaaagactataaatcctagtcgaacctggctaaggaacaaagcaccgataacgttaaatccgttattacctaaagccaggcctagaccaccataagcagaagaagcagtcccctttccatcttcaggtgcaaaggataatccagatttgaaaaagccaagagctaaaaaagctcaacaaactttacaacaataatcgtaaaaagcgcctagaaataggcgttttttcatgttttgacgtttgagaaacgcattctaagtccagtttttattaataaatgggttaatgtccgctaaatgaatatataaactacgtcataacttaacaattgtgtcgcttttttgtgccttataattaaaggtgttaaaatacgtcataacttaccaccataaagcagtccaattaatttatcgacttctaagtaaaataccaggagttttgctatgagttaactatgatcctaggtggttaccaaaacattccttaaattagggtctataattataaattagataatacattagaagctggggacaagattgtctagataatgtgtgagataaaatttttggcaggttatcatacataagacaaaatgtttttaaaactgataacgtatttatttcacaacaattacgcatttatttttgagaaaaatataaagcaggaggattacaatgctgaaaacttattctttaacaaaagatacattattagtttcgtcagaatcaaatatcaaaaattcttccgttgtttatgtttatggtgacgaacgagaatatatcgaatcttttgaacataaatatgaccttgaaataggcaatatactaacgtttgatgatcaagttgcatatgacacgatgatagatcggaacgatgaaaaaagtttgctcgtaagttttttgtttcccgaggtacatgaaggtgggcatctacataatctgacgacatctattgttttcttggtatttaaaaataagttgataatttttacaaaacaaaaattaaaattcattcccgaactcttatccaatatggttttacgtgatgtcaataatttcatagaggaagtacttttaaagatcatacaaaaagatttccatgtgatgcttaaccatcttcgtggagtcaaggaaaaaattgatgatttagactcagaaatatcaacgtccggttcactcagaccaacgtttggtgatttattgactcttcaaaaatacatgatagctttgtcaacaacctacggcgctaatcacaaagcgctggatttcattaaaaaaaatccacaactattaatgatattgattttaccaccaaaaaaataattggtgggatatacgatacaagcgacacaatggatagaattattttaggttatagccaatatttggatgatttggaagatatgataaccaatatgatttcgtatcagcttaacatgattatgaaaactctaacagagatatcaatcgttttgactattccagcgattatttttggcttttggggaatcaatgtccatgtcccgtttgaaaaatcttcttatggtgtttttgctgtgctgattatctctgttatactaagcctaatttgctggttttggttgcgacgcaaaaaatatttgtaaagtatttgtgataccctaatatgatttaaagcagaagtgctttgttgactttttaaaaggctgattcctttcaataatttaatagcttcagcggcttccttcacagtatgagagttagaatattcaaagatagccatattccagctatcttcttttcttttgggtataccctccttatagttgggattgtgttgccttgcaaatattttaccggcttgcatacgctcgataatcatatcacgctccacctccgcgaccgatagcaaagttctgacaatcatacgctcaattggggtgttatctatcgttcctaaatttaaaaccttaatcattattttttctttcaataagtcatcaattaagttcaatgcttctctagtactacgagcaaaacgatctaactttatgacgatcaatgtgtcattgggttcaatcagatggaccagtctttcaaattgcggttgcctggtgttacatttcagaggaaaagtatagtttgcgagagtcaatgaaccttacgctgggttcagaaggattacctgtggcacaagcaggaggacaaaagaagaagcaagatgaaaattctggtgacattataatagaatacaaggatcatactttatttcttgaagtaacactgatggataagaatgccattaaacgtggggagtgggaaccagtacttaggcataccgtcaatctttctgctagtcgcactgttccggttcaaacatatttcattactgacgctgttgataagaacaccaaaaatatttggcgttctgtggctgcaaccgatttagaggaaaccgctgtccaacatcgctctgttcgtgcaaccatatatcctctgacaattgatacgttgattaaatggttacatgataaaggtgtaaacgaaaaggttatttgggatgccgtagatacttcatataaaccaataatcgaaactgatttcgacgctgattggaaggctgacatattagcctcgatatcatcgaataactaaatacagaaaaatacaacaaatattatcagactagggactatactggtagcgtcaagaatcttgtgtaaatgaaatgccttcgtacatataatatgtatctaacttaaataaatgatgcttccaaggtgtcctggagtcctttgaaccctcggtggatccgcttcagagacttctcgttatagacattaaactgaaaaaccagtaagcgatccagtgaatcttccgttggaaattgttctttgtggtgggtggtgcgcttgagatgcttattaaagttctcaatcaggttagcggagtatagtgattgccggatagctggtagaaagtccatgaaagtgagtaaattcggcattttaagcagatctttgattaatttgggataggtctgatgccagttgttggcgaactcattcagtttcagttcggctgctttacggttggcggcccgatgaacttgtttaaagtcactgatcacggccttgcggtcttttacgcgaactttgttcatcagattccgcccaacatgaaccaggcaacgttgtcgtttggctttagggaaatgccgattcaagccttcatccaaaccaactaacccatcggccacaaacaacagcacatctttaacgccctgcttgatcaaggttcccagcagttcagtccagatgccagtcgataccgttggcgccacttggtagttcagcacttctttcgtaccatctggacgaatgccaatcgcaagatgaacggcttctttttgaacggtatcccgctttaatggcaagtaagtggcatctaagaagatggccgcatattgtgaagccagtcgacgttgctggaaagcttgaacctgttcattgacggctttagtcatgttggaaaccgtggctttggagtagtgaacaccgtacattttctcaatgagttcggcaatttcagcagtggtaattcccttggcatacaactgaatgaccgttgtttctaaattatcactatgccgaccgtaggctggcaaggtatgattttcaaaccggccattgcgatctcgaggaatggttaagttaagttggccgtacttcgtatcaaacgagtgctcataactgccgttgcggttattaccagtgttaatcccagcgtatgagtagggttcgtaacctcaaaactctgccaattcggtttgaagcagctggttaatcgcaatttcgaggtggtgacgaaaaacttcgtccaaatcttgcttttgggctagtgcagcgataatttctgtggtaagttcattcatggggaatgcctcctgtgatgttttctgtgattactaaatatcataaggaaaggcattccctatttctatacaattcagaaatcttttatgtatttacacaagatattttacgctctcctatgtgtcttatatggctactgtatgagtggttactatatatgtgtctatgcttgtgtgtggtgtcgtacgtgtgtgtcttgtgtcatgtacttgtggtctatagtcttagtgttcttgagtggctcggctgtctgtcctatgctgtcgctggtggctccgtcattgcttgtggtttgccttggtgtctatacctagttacttatgtgctcaccttatagttggtatgttgtgttgctgatatacatgatatgtatatagatgatgcgtttatgcttgtgcctagttgctcgcttgtggtgggaggtcaagacttttgcaatctcaaaattaaaataaaaaacgaaataaaaaatatatgtggctctagctgatcgctaggacttttttatgcatatattgaatgtttatacacaataatgaatatctatatagttggataggtgtaggaagattgaggcaaactaaaacatagaaatatgattttttaaaaattaatatcgatggaaatgcctatttaatagggcggggggtgatttagaaaaaagatgaaaattctgttaatgcctcgcaacctcaaatatatacacaaggtaccacatcgacttttcttgttaaaaatattttacacggttaagtatattgttctgccaaaagtggcaaaaacctgactcggcaatttaccgaattaggctgtatgtatggtggttaaaaatctgccaccattagcaattaattatttaattttctggattgctcttttgtcattccatacttttttgaaaaatccttgcttgtaatagttctatcgcttctatctttcggtaattgttgctttaattcatttgataaattattgtatatactttggttcttacctttaccagtcttatttttaccgcctaaagagttaccaacttgtttagatttattagtactattcgtagcccaatccaaatacagtggaatatctaatttatcttttttaattttcttcttcaattcaattgcaaaagttgatttactccaaacaccttttttaatattccacttattcataatttccttatagtcactatatggattaatgttagggtctccaaaatattcttttgttacattcttcacaacttcttccagtgctctattattattatctaattctaattgttcccatgcatctctacgaggcgtacttaataattggtcaaaataacttaattttcctatatacatccaatctttcttgcctctggttaatccagtatgaaggttattaattgtataaaaatcatgactttggggggaattggtcggtttcccatatagaaacatactttatcaaattccataccttgtatgttatctgttacacttccacacatgaaattccaatagtcaggatcaactgattctttatcaatagttggaatatctgggatagtatttttcaatctttctaaatatttattaaagggattgagatagatttcagagtctttcttttttggtgagacaaagggaaagtcttcaattggaattatatttccatcttctaacttatcgttggcttctctgattcttttgtaatcagggcttattatcatccacccatcattaaaacattgctttaggtgcatttgataattatggttaaatgaatgttcacttcttaattcctgataaaattcttcattaaaatctttagcattccaactagtaacggcatccattctatagttttttctcaatactctaacctgaatgctatcaatataaattttccagtcatcaactacatcaagaaatgtaccatcttttatattcttatatagttgtttcattagaccattaaaattcttgtcatcattatcatcaaatatttgtttattgtgttcatttttcatccagagtgcatccaaagcacctgatttattgattgctggttgctggtggctatctccatagcaataaatatttacatcttgtcctgattctttttggttattaacatgcattagtaaggattcaaaggtaatgctcgccatcttcccaaattcatcaataattatattacttgctttattagtgctataactaccaaagttaacccttacctttaataacttatttacacgtttaatactaccttgcaatctgctactggctgttttgttaggtgtagtcagaaatacatcattatcatcaatatttcttagtacatcatttattgccgttgtttttccagttcctgcgttgcctacgcataagaacatcttcacggttccattgctcatacacacacctctattttgtttttttcgttaaaatttgctagataccttatataagacctgtaccattttttaattaatttaagtcaatttatctatattaaatatatataattgcttcacggtaatttagtcgtttcttatatataaagtgattgactattttaccgtcaaggatttatagtcatggggcacaattccagaatggaatttgaagaatcttttcattttgtgggtttcaaaatgaaaagtccaagacaactagtagctaacttaataattactagaataattaacatgtaatcctaatttgggactacatcattatcattaattaataccgtagtgattcacgactctaatatataactactattagttatgttatccacatgcaaagcccgcatatgaataactcctgaagctatctaattattatgtctatgccgtacgatattttaaatagttattaatcatgttaaatgttttgccttctgagataggtttacaactacgtgaaggtctcaaaagtcctgtcttagtcgggtttaacaactctggctttagggggatggtgtgattaacttgcttaatacgggcatcaaactctatccaatcatatttttttaacattccgatgttatcccgcatatccttagtgtaagttagatgtgcaaaatcaaaatgatgtttagaaccacttacatttctgagatagattacaggtctttgcttagtgtcgttagcatttgtgtatatattaaaacctatgactgctcccgtgaagtgttctcgttcgttattcatagtaattcctccaattacttagcattttgatagctttaaaattcaaaaatgccgtcatatcaacgtttgtagggtgtttatttggtataaaatattcattttatttagttcagtgattctgtgtacaataagcctcgcaagcgtatttttttatttaaatctggttattttttaaatattcgtcaattgttaggcggtcgaagcggagtacacctccaattagaacggaaggcagtccctcggcaatagctttctggagagttctatagcagacccccatatatttacatgcctctttcttgttcatatatcgaggggtagggttgaacatgatggctagttgtttcatcagttccttattttcagttatctgagttaattccatatgtgtatatcctccaattattttttaagccatctaaatatatggctatgtatgattgctccccctcacacttcttaatatgtataaaaatgagggattttgccaagtttttaaaattaattatcaattctatgcaattcgatggaattaaaacataaatggtcttgtacatagttaatatgtataagacacttaaatctcacaaacaaattacagaataatttttaatttttttccttacactcctaatatggggtgaaaataatggtttttactaaaaaaatatcaatttaatgcaatttcatttaatctcttacatagataacatagtgaaaaactggtcggttcgagtaaaaaaattaaaaaaaatatccccatgtctatatatgtataaaaaaaacgagaaaatgccaagaaaatacaaaaaatatcaatcagatacatttctatgcctctgcagataatatgtataaaaaagaaatctcacaaacaaattgtgaaatctcttaaatttatgttttgagttgcctaaataaagatttaaatgtaacatgtagctgttgcgggtctggctctgcaacacgggaggtcatcccaatattttcaaaaaatgtgagcctcgcaagcaacacaggagcgaaaataaaaatggcaaaaattaaaaaatacacaacaaaaacaggaaaaattagatatgaatttcaagtatatgcaggggttgatcctctaacgggacgccaaaagaccacgagaagacgtggctttaagacgaggaaagaggcctccatcgtattgagtagattagaattggaaatcgaaaaaagaggactacaggaggatgagagacgctttttcagggatgtttgcacagaatggatggaacagtaccgcttaaccgtacgtgagtcaacgctagagaagacccaacggattattaatattcatgtactgcctgcttttggcgacatgcttattgaccaaatcacacccaatgaatgccagaaggttgttaacaggtggtttctgcaagcaaagtcttataaaaaatggctaaattacgcctctatggtttttgattacgctcttagagctgaatatgtgagtcgaaatccttgcacgctggtaacaatgccacgagtacaggaacaggcaggagagaagctagaaaacttttggactagagacgaactgaatacctttttcgactatatgacccccaaaagggacgtagaacaattcaccatgttcagattattggcttattcaggtatcaggaaaggggaattactggcgctaacgtggaaggatatcgactttgaaggcaacacgttacgggttaacaagactcttacgcaaggattaggtggtaaattaatcgtgcaacctccaaagagtagggctggacgccgtacaatcgacttagatgacagtaccatgggatacctcaggcaatggaagggtgttcaacgtgagacttttctggggatggggttcaatactaacaatgctagtcagttggtattcgcaagcaatcgcaaccatttccgctcgatgaatactcccactaaatggcttaataaagctattaaagcaacaggactcaagcatatctctatccacggttttaggcatacacatgcatccctattgtatcagtctggagtaggtcttaaggagactcaacagagattgggacactcaagagcagacagtagtgttacgctagacgtctacacccacacgacagaacaacagaatatggaagctttgcagaggtttgaaaattacgttgaggctaaataaataaaattggctaagtttttggctaagttttaggtcaattctgtgcaactttaagcaaaacacgaacatttaggagtacaaaaaaatcccgtcatatcaacgttttaacgctgtatacaacgggatgaaataacagaaatggagtcggcgggagtcgaacccgcgtccaagcatgtcgccactgtaacctctacattcatatccatactatttaaattcgcgaattaagctgccgtatgtcagggcctcattaaaacgctagtctgtaaatcctcttcttaagcatccaggccaatccttaagcgcaagtccactctttttgagacccgttactagcccgtggacgagactaggcggatcacgctaagctactgtttaggcagctaaagcgtaagaattgttattattttttgcagttataattaaactgaacgtttttacgtagacgtaacctacgaaatgcagttacagttcgacccatacctgtcgaatccataacgaccccgaaatcatgttacataaatattataacatacgttctattttaccgacgtttcttgttattttcaatcggaatggggcggtaagccaattgttggccctgcaagttgcgtaaaaggcgttcaactaattctgaattctgtaaattcttcaatagataacctaaaagattgttttgtgttggtttcataaaaactccctcccgtctgccattatcatattacattccccaaaaaaatcaaacttctttgcctattgcttaaccaatccttaaatgtaacaattattctagaagatgaaaggaagggacgccatgagtcaaattgaagaactgcatcgggtgcagttgcagatgttgcaagtggttacggccatttgtgataaatatgatattgaatatatgttaattggcggtacgttgctgggcgcgattcgacacgatggatttattccgtgggacgacgatgtcgacttggggatgacccgggaaaattatgataaatttgcaaccgtggcgccggttgagttccaacatacccattactttatgcaaactgcggatacggatcctaattttgcgtttagttatatgaagattttagataccaatacttatattgaagagaaaaataacgtcaacgatgcgcggaagggaatctttattgatatttttccgtttgataaggttcctcgccaacctgaaattcgccaagcggtttataaccggttcaaaatcgcggatacggcaatcttactgcgcctagggtacaacgtcattaagacgccgtttcgtaaggatcctaaggataagagcttggacctcttcatgagcgttgcaaagttaaaggaacggcgagaaaacatcatgcggttgtataatcacgaaccgtttcaccattataagaactatgcttcccaatatgcctacgataaagaggttctaagccaacgggaactcaccgagttaaccaagcataagtttgaaaatcttgaggttgccatccccaagcattatgataaaattttaacccggatgtacggagactacatggaactgcctccagaaaaaaatcgcgtggcaaagcacatcgacgtggtgatcatcgatggcaaacacgtggaatagggatgaaaagagcaattgaaaaagttgaaggaacgaatggatgcgtttagtgatgcggtaatcgccattatcatcaccatcatggtgttggagctgccgttaccgcaacacgatgcgttaagtgaatatttacaatttgggaaaagcattggtattttcttcattagtttttgtttcgtagccaacatttggtaccaacacgccatgttgttcaaggatagtgataccatgaacgaccgcgttttcgttaaggagtttacctttttggcgttcttaagtctgacgccaatttttaccaaagtcattatttatgacactaatcggactaccgtaatggcgtacggggtgttgaccatgattgtcagcatcctgtttatgtggctcagctatgaagttatcaagcaaaagtacactagccaccacgaaatgagacggattttccataagatttatgataaccacaacaactttcttggcttcgcgagcgtgttaattttagtgttagcctatttctatccgaagtgggccgtagttatctacttggcaattccggtcttttcgtttatggtcacccggcacgattatacggacttccaagacgttacggaacttccggaagccgaacagaatcagttcttgagtgcgaataatgttgatttacatgagttaaggaagaaacaacgcgaaattatgaagaaataccggggacacgggcgtaagcgcaacgatcccgaactccaagctgagttgcgcaagctatttcaaagctatcccgacttggccaaacgaaatcgtcatcagcgcggacaatatggaaataactaaaaatcagttaaattttaattttcactgggcaaccaaaacgaggtcgtttaccaagttttggttacccagtttttttgtggcttgatttatgagcagtcaattgtggagattgcataagatgtgtcaactaagatggtgaatttggctttataaaagcgtgtcgagagtgcaatataagggatttgaagttccttttaccctggaaaagatttttaaagagcatcattgcaccgggcaacgagtctgaccggcaccacctacgcagaccatcaacgattaccgatatttttatttgtgtaagcgtttttgtggaacgcaattttccaccatgttatcttatagacataaggagggatgtgttatggtaaagtcgaggaaccgaattttacattatattttagtagctgttagtgttgtaattgttgtattaggttttagcgttatcaaggcttccgcgcacggatacgttactaatcctggaggccgggcttatttaggaagtagcgagtttcctggtaaaccattgaacgaaaatattggaccagtaatgtacgaaccgcaaagtatcgaagcgccgaaaaatacctttatcgatggtaaaattgcgagcgcggggcttgctaagttttctcaattagacgagcaaactgccgatcgttggtacaagacgccgattaagagtggtgcctttgatattacctggcacctaaccgctccacacagtaccagtacgtgggattactacattaccaaaccaggctgggacccgaataaaccgttaaaattcagtgatttcaagaaaattgctagttttgacgaccacggggcaaccccaggaaccgaagtaacgcacaaaattaacattccggaccaaaagggataccacgtgatcctaagcgtatggaatattgctaatacggcaaatgccttttaccaagtttcagatgttaatattcaataattcacggaagaagttacaaacagtgggaccaaagtcggatagtttgtgagcattaataaaaccccattaatcatggtttagatgattggtggggttttagttatgttgaaataaaccagttttcttagtgcggttgatgctaaagtcctaaatgtttttaaccgttttttattcggcgggcttgagcaccactaaaaaaaagcttcattaaaatgtatgtagaaaattgaaatgaatgaagactcaggatgtagaactgtttttagttagtttccagatacgtgattaggccaaacaaaaaaccgcaatttgcggttttttaattattcgtgatctttatcgtctttcttgtctaacttgtcttttaattcttccattgcgccggcagcggaatcctttacgtcagcaagtttgtctttaactttgcccgccatgttttgtgctttgcctttgctttcttccttcttgtcgccagttaatttaccagcaccttcgtgtactttacctgcaactttgtccttagtgttttccattctgtctttatccataaatattatccccctttgaatatttttggtacatctttattttagcaggggtcgcccttaaaagtgaatttatatgctcacggacttgtgtaagggggttaaaaggcgtattatgaaaccgaattcatattcaaataaaataatatctacactaggggtgttcttagaagaactgagatgcgcttgtgcagcgtgatccctttgaacctgtaagttgatacttgcgaaggaaagtgtttattgggcgaaaaccatccttctcaagggtggtttttttgttggttgccgatggaggatgttagtaaacgcggtcgtcaatctgcagcgatggttcgctggtagagaccgccttcggtacatcgcttggtggagatatgaatgaggagctgatcaaatggatttacaaggaattaagcgaattcgagaggttaacccggtggtagttaactacgccaattttgtgaccccgtttttagtggcaaacgggttaaacgcggtgggggcttccccaattatgagtgaagaggaaagcgaagccgaagaactggtccgcttggcgtccgcggtgactattaaccttggagcggtacgtcgagaaggctgggcagacatcgaaacgctgtgccaagcggcgaacgaccaacaaaaaccgctcgttttggatccggtagcggtcggagcaacccagtaccgccagcaattaaacttccggttgttgaaaaagtatcacttcgacataattcgtggtaatttaggcgagattgccgtattagctgggattgattggcaaactcgtggaattgacgcgggaaacggcgacggggatgcacatcaagtggtgaaagcttgcgcacaaaagtaccataacgtggtgattgcgagtggggcaaccgactacgttagtgacggaacccgggtggtcgagattcacaaccaaacccggcttttgccggcggtggtgggctcgggagatttactttcgagtttagcagccgcattttgtgcgatcggaccaacgccgttgcaggcggcaattaacgcaagtttgaccttgtcgtgcgccggtgaacggattgccgaaaaattgcacgaccagtatttgccagggagttttttgaacgggctgatggatgaattggcaaacatcacggttgtccaagttgaagaaagaatgaaagttgaggaatgattaacatggatacaaaaaagccagcgcaagttttaacgattgccggaacggatagcggcggcggagctggaatccaagcggatttgaaaacgatgcaggaacgccgggtttttggaacctgcgtggtggtcgcggtgaccgctcaaaatacgctgggggtgaccgacgtggcggtgatgccgcgccacattatcgaccatcagtttgcggcgttggccgaagatttagatattaaagctgcaaaaacggggatgttggctaattcggcagttgttgacgcggttgtggaaaactatcaaaagtatgattttggacctttagtggtggatccggtgatgattgcaaagggcggtgcgaaactactgagcgacgaagccattgaagcggtgcggacccggttgttgccactggcttacctaattaccccgaacctccccgaagctgaaaaattagcggggatgccaattaaaaataacgcagatgccaaagtggctgctgcccggttgcaggaactgggcgcacaaaacgtcttgattaagggtggtcattttagtgattcagcagaaagtcgcgattacgttctgttcgcggacggtagcgagttagagttagctagcccccgttacgaaaccagcaacacccacggcactggcgacacgatttcgtcagtaatcgtgtcggaaatcgcgaaggggaaatctttaaaacaagccctacaaattggcaaagcctttattaacgccgcgattagtgacggaattcaggtgggacacgggcacggcccgttaaaccattgggcatatcgggaggttgaaaatgaaatttaatccaacaatgctacaagcctactttattgccggtacccaggacgtggctagcaaggcggactttttaccgacggtggaacgaatcgtgcaatccggagccactgcctttcagtttcgtaacaagggggcggtgaaaaccgctagtcgtgacgaagtagttgaactagcccgggcttgtcaacagattacccaaaaataccagattccgctgtttattgatgacgacgtagacttagcgttggccgtgggggcggaggggattcacgtcggtcaaaaagacgaacggattacctcggtcttagaacgcgtcggcgaccaaatgatcgtggggctttcgtgcaataccgcggcgcaaatcaccgctgccaaccagttgaacggcgtagactacttgggaaccggaaccgtctacgaaactaactccaaagccgatgctgggaatgccctaggagtggataaattacgtgaattagtccagatgagtaactttccggtcgttgcgataggtggaatcacgctggagcgggttgctgaaacggtggcaactggcgtggctggaattgcggccatcagcatgtttattcaaatgactgatcctgcccagcaaattgctggaattaaagccacggtcgcccaagcaggaggtgcagcatgttctccgaagaaataaagcaagctgcccagccaattttacacgacattcaacagcatccgtttgtgcaggggattcaggcgggcaaagttccaagcgcagccttagcggtttacgtggagcaggacacctgctttttgaacgcctttgcgaaggtttttgctggagcgttggtaaaaagtcaaaccaaggaacggatgcgttttttcagcgaacaaattcaatattcacttgcggatgagtcagcggcccaccagattttatgcgacatcgccggcattgaattagccgagcaccagcacgctgaaccccggccattaactgcgttgtacacggagcatttattcacggcggttcgcgaaggagatttgttagacattgcagcggtcgtgttgccgtgcccgtggacgtacaatgaaatcagtcaagcgattgtggaaaacgccgcacctgacaaccccttcttgccgtggattgaattctaccaaggcgacgaagaaggtgctggcgacgattcggttacccagttatttgcgatgctggacgaggccgcgcctaaattaagtgcccagcgcaaagaagaaattacccaccgctttttgcgtagttgtgaattagagtatgatttctgggaacaggcgtattcgcaaaaggattggaagtatcggtggaaataaaaagactttaaaactagcatacttcaaaatgaaggcggaaatcatgcgttgcggatttccgcttttttggtgggggcgttctctgtggcatagccaaaatgaactccagccaccaatcttctccggttagtccaattttggaatcaaccgcccaacccgcgattaattccaaaattaaactaatcctcaaagattacccagtggctgccgttctctaatttaaaatgaactccagcccctagcttattccggttagccaaagccagtaatcaagcactaagcccgtgcttaatcactagcttctgctaatcctcacaagctacccaggggcttccgttctctcaaacgaaaacgagtttcagccctcaaggctctgcggttaacccaaaccagccatcaatcgccaaactcacgattaatggctggtttacgttaatcctcgatccttacccgagggctttcactctctcatctttcatactatacttaactactatcaacaaaaagaaagaggcattcgatggatccacaaaccgttttaaaatctaactttggctacgatacctttcggccggggcaagcgcgcgtcattgacgccgtgcttcaccggcaaaacgtcttggcaatcatgcccaccgggggcggcaagtcgctttgctaccaaattccggccctcatgcaatcgggattgaccctcgtggtttcaccgctcatttcgctaatgaaggatcaggtcgataccttggtggacaacggcatttccgcaaccttcattaatagtacgttagattacatggaaattaacgaacgctttgcggccgcacgtaatcgacaggtgaaattgttgtacatttcgccagaacggttagattccgactactttgaccagctggcttccttaccgatcgatctattggcaattgacgaggcccactgtatttcacaatggggccatgattttcggcccagttacctaaacctaaccgacctagtgcaacatttgccaactcgaccgacgattattgcactgacggcaacggcgactccgcgggtggccacggacatcaaggaacgtttaggaattaccgaacaggttcaaactggctttgcgcgcgaaaacttggcgtttaaagtggttaagaaccaggatagcgaccgcttcttaatggactacctcaagttaaaccaggaccagtccggaatcatctacgccagcacggttaaggaagtggaacgccttcatcgaattttaactaagaaaaagttcaacgtgacgatgtatcacggacaacttagtaaggcagagcgacgccaaaaccaagaggacttccttttcgaccgggtgccggtgatgattgccaccaacgcgtttgggatgggaattgacaagagtaacgtccgttttgtcatccatgaccagattcctggcagcattgaagcgtactaccaagaagcggggcgcgccggtcgggatggcctgcctagtgaagcaatcctgctatataagttacgggatgtgcaaattcaacattattacattgaaagctcggaacgggatgaggaaagtaaggaagtcgaataccagaagctccaggcaatgagtcagtacggcaacactcagatgtgtttgcaacgctacattttaaattatttccacgaagatggtccggattgtggatactgcgggaactgtttagacactcgcgaagcacaagacatcaccattgaaactcaacaagttttgtcgtgcatgcaccgaatgggcgagcggtttggaaaagaaatggtggcactcgtattgaccggttcgcaaaaccagcgcgtcaagcagtttcattttgaaaagttatcgacgtacggtctaatgaagcaaaagaccaaaaagcaggttaccgagttgatcgattacctagttgcttcgggaataatcgcgatggaaggcggccagtatcccgtcttgaaaaatactgcggccggactagatattttgcgtggtaagcagcgggtaacccgcaaagtggcggtcagagccgaaaaatcattgccaactaacgacgccttgtttgaagagttgcgtcagttgcggcgtgatttagccgaagaacaacacgttccgccatttgtaatcttttctgataaaaccctccgcgacatgtgtgcggtgcttccggaaacgttggatgaaatgttagacgttaagggaattggggaaaataaattagccaagtatggcgaacagttcctcaaagtattgcaaaattaccaagaagcttagttttttataaaggtgaggcaatttttggttagttaggacctaaatcgttttaaaatacaagaaggtaaaaatcttcaatcggattggaaagcgatgcgttatttaacttaaactaatcgcgctaggaggatgctttttgcgttttagaacattttggggatggcttttgattttcgggattgcggcgtggttgattaaaagcgacgtggtgacaattcctgccggcgttcagcaaaccttccgtacgggaattaataaagtggcgaccagcttagattcggtgattgattccaactggaactttaaccagaataaagcgactaaggcggaccaggcgagcggaaaagcaactccggttgagtcggtagtgaagggaaagaatttgtcgaagacctattactacagtttcgcgccgaatacgccagaaaacgttcagaaggtctttcaacaagcaatcaagcagtacaaccaaacgggaattgtggatctggaacccggaccaatgcacaactggctaaaccacgtgacgctcggtgtttaccaaaaggccatgccagaaaaccaagaccggactattgagctaggggtgggcggccccgacgtgattgaacaacagggggtcgttagccggattgctaaccacgcctcggcgaaactaaacatttattataaccgctcgatttctcaatcagttgcgcttcacgaactggggcatgcgttagggttagatcacagccaaagcttgacctcaatcatgtatccgattgaccggggacagcaaggcttaagtgaagaggacttaaacggcttgcgctcgatttatgggaagcaaacggatgaaaacgagtagttagcaagaaaattctaagagacttaacccttgatttagaggggtttttgcgcaattgataaacgactggatatgttcttccagtcgttttttgtgtataatggctatcgttgtctaaactagcttagggagtaggttgcgaggtgccaagtgaactagtttaagacgacaactgcgcactttatttttgttacaaaagattacaacggagttacaaaaccaagtaaattaagtgacattgtacccgactgggtgcgattcagttgaaacttaccctgttaaatgatagattaaattgtgacttattgaaaatggagagatactgtatgaaaaaaacgctaacgtggttaggggttacagtagggtctttagtcgtctttgcgggcgcgggctttgggttgaccttagtcaataaggattctctagctacgcactttatcgaaaagtacacggggtcaaaatccgactccgcaagtagttcaggtaccacatcatcttcgtccgatttgcttaaagtatcgaagagctctaacctcgattcgattttaaacaacggcgagtataatggttcagcagcattaaatacaggtaagaaaattatcgttagttcgcgtggctacggcaaccacgcaaataaaattacgatgacgcgagatagtcgttttgtgatggggaaaatacaagacgtggtcaataacgcggtcatcatgcacttgattgacactggcaaggtgaagttaaacgacaagctgtcgaagtacgataaggacgttgccggtgcggacttaatcaccgttaaggaagtcatgaatcagacttcggggctgtcagccgctgacttttcggcgaccggctcggcaaaggacttgattaagaaggtcaacgcggacgctgcgtacgattcagcaagtgaaggtacatattcggattcaagagttaacactattttacaagcagcaattattcaaaaggcgaccggccaaagttatcggtcggtcattcaagacttgctggatcagctcgaacttgatcagaccacgtttggtttgaagaataagacggttgactactacgagagtggcgattcgctcaatggcacgaaggtttcgttggacgacttggacactaaggcaatcaaccgccttggtaaagatcagctagttagttcgcctagcgacatggcgcagctcttcaattatctcttcaatagtgattacgttgctcctgcaaccttggacaaagttttcaaggatgctaagggcgaccacgcagcgggcttttcagttgatggaaactcactaagccttgcccaatcaattgcaggcgggcgtaaccgtgtggaatggaacttgaaggaccaaacgggaaccttcctatttagtaattacgttaatggggaagataatctcgcatcaatttcaacaaatatgtttgactacttaagataactttcggaggatttcatggaaactgcagaaacacaacagattagtattggccaaatcttagccatacttcgaaaacatattggattaatttttgctagcacgtttattattactttattggctgcgctaatgacgttctttgtgatgacgcctaagtacagcgcaactactcaaatcttggttaatcggaagctgtcggatgacatggcgggcgcacaattacaacaaacccaagccgatgtgcagatgattaatacatataaagatattattactagtccaacggttctacgtgaggcggacgaaaaattaaccggtcttccgggttacaagagcggcgttgataacctaaagagctccatttcaatcagtagtcaacaaaactcccaagttttctcgattaatgccaaaagcactaacccgaatacggcagctaagatggcaaacgaaactgctaaggtcttcaagcgtaaggttgtaaagatcatgagcatcaacaacgtttcgattgtttctaaagctactccagacgatgacccagttagtccacggacaaaacttaatatcgcagctggaatcgtaattggtttcttgctcggagttggattggcgttcttacgtgaatttagcgaccggacggttacttcagaagaattccttactgaggaactcggtttgaaggggcttgggattattagcgaaattgacgagaacgaaattcgtcgaaagattgcgcctaagattggtggcaataaccgtgatgatggcgaaactagaatgcgcagaagggtctaggtgataagcatgttttttaagaagaaaccaaagctagataatgaaagtctaaaaaatggagtcggattgattacctataatgatcctacttccacaattgctgaacaattccggacggtgcggacgaacatccaattctcgtcagtggataagcaattaaaatcgatcgtctttacctcttcggcaccatctgaaggaaagtcgaccgtcagcaacaacgtggcggtaacttgggctgaccaaggcaaaagtgttctaatcgttgacgcggatatgcgccgcccaaccgtgcaccggactttccggactagcaacgcggttggtttaagtaacctattggctggcactggtagcttggatgacgcaattcacagtacggtagtagaaaatctttccgtaatgcctagtggtccaattccacctaacccatccgaacttttaggttcatctaagatggttaaccttctaggggtgctcaccaccaagtttgacttggttattatcgatgcaccgcccgtcaatacggttaccgacgcacaagttttggctgcacgtgcggacgggactgttttagtagtgcctcaaggaatcgcggataaagcgggcgttcggcatgctaaacaaatgctcgaaacggttcaggcaaacattttgggtgccattttgaaccgtgcatctgctgaaaaatcaacgggttactatggtggctattacggtggctactatggtggttattatggaacggatgataagtaatcatgggtttaattgatttacattgtcacattctgccaggggttgacgacggcgcgaaagacctaccgatggcgctcgacatggcgcgcgaagcggttaaacaaggaatttcacacattttattaacgccgcatcacatggacggaatgtacaccaatcataaaaaagacgttattgctaaaacaaatgcttttcaagctgaattagacaaagcgggaattccgttgacggtttttcccgggcaagaagtgcatttgactggtgaattgttagacgcaattgaccaagacgacatcttatttatggatgaagcgggtaagtatctgttgctcgaatttccgcacagcggaattccagagtacgcagaagatatggtctttgagctaattgcccggggtatcactccggtgctggcccatcctgaacgaaatcacggatttcaaaaaaatccggatcggttatacgatttcatcgaaatgggttgcttatcgcaattgaccagtagcagctacctgggcgtgtttggcaatcacgtcgaagagctgacgcaacgcttcattgacgctaacttaggttttatctttgcgtccgacgcccataattttaagggacggcggttcttaatgcgggacgcatttaataagttaacgaagaaaactactgaaagaaaggcaacaagttttaactacaacgcaaaggcaatcgtaaatggggactcgattgctacggacgatatcctgcacgtatcggaagttaaaaaaagaaagaaaaagaggttctggttgttctaaaatggagattaaaatgacagaaaataaaaaaattgtgattgatgagcaatatcaaaatcgacgttttatttatcatttttttaagcgagcaatagacatcattgcaagtggtgcaggtttaattttgttatccccattatttttaataattagcctagcaattaaggccgaagatcggggaccaattttttattcacaaataagattgggaaaaggtcagcggccttttaaaatgtataaatttagatcaatgatcgtcgatgctgataaaaagcttgaagatttacttgaaaaaaatgaggtcgatggggccatgttcaagatgaaacacgatccccggattactaaggtggggaggttcacgcgcaaacatagtttggatgaactcccacaattatggaacgttttggttggtgacatgaccttagttggcccgcgtccaccgctggaacgggaagttgcggaatattcagaatacgatcgtcaacggctagccgtaaaacctggttgtacaggcttatggcaagttagtggtcgaaatgatgtggattttgatggaatggttgagctagatctgaattatatacaaaatagtggtgtttttttggatttgaatattcttcttagaacagtactaatagtttttaagccaaatggtgcgtattaagaaagtagggaagacattggttaaaatttcagcatctattgtgctatataacaatgatgtaacagaaattaaaaaattggtaagtaatttttttgaggttactacggatatagaagaagtaaaactttttttagtgaataattctccagataacgtcgatttatcaaaaaaattattagaaatttctaaaaataacaaacaaatttttacaatcctccctaccaaaaacaaaggttttggggctgggcataatttagtattagataagattaatagcgattttcactttgttttaaatcctgatataacaatacgcagtaaaaatgaaattaatgtaatgatcgactttatggaaaataatgagaagtatgggcttctttctccgttaattaagtatccagatggcagcattcagcatctattaaaaaaagagtctacacttttagatatggcactaaggtttattggaggtcccttttttaaaaaacgcaagcaatattttgtgaacttacctgatggatattcaaaaattcaccatgcagataatgttccgggatcttttatgatgtttagaactcaaatctttaaagagattaaggggtttgatgagaagtactttctctacatggaagatagtgatattacaaaaaaagttaatgaagtatcagatgttgttttttttcctgatgcagttgtttatcatgagtggcaaagacaaaataggaagtcaattaaagggattaagcaaatgctaaaaagtatgtatatttactttaataagtggggttggaaattatggtaatggattttaagattgattttgttgtgtcatgggtcaatggtcaagatccaaagtggttaaaaaaatatataaagtataaagatgacgatactttagatgtaaaaaatgctaggtttagagactacggtatctttaaatactggtttagagcagtagaacagaatgcaccgtgggtaaatcacatatatttagtaacagatagtcagaaaccaagttggttagaagataaaaattctaagattacggttattgaccatagtgaaattattaatgagcaatatagacctgtttttaactctaatgctatcgaacttaacttatataaaataaaaaatttagaagaacattttgtatattttaatgatgatatgtttttaaataagcctgttaagcctaccgatttcttctcgaaaagtgggttgcctaaagatacagcagggttaaatgctatccaaccactatatgattttgattatatacatactaacaacatgcgcattatcaatcaggaatttgacaaaaagaaagtcatgagaaaacaattttttaaatttattaatcccattaatttagagttaaatatttatacgatgttgctttttttctggcctaaattcacacgattctttgatttacattatccatactcttttttaaagtcaaacatgaagaatgttatagaagaaaataatgaggcttacaccaaaactatgaatgatcgttttagaaataaaaacgatatttcaatatggttggtcagatattattctttggtacaaggtgatttttctatcagaagcccacgagtaggaaaaatatatgatttgaaagacgactacagaaaagctttacttgatgtaaaaaaaagtaagcataaaatgatagttttaaacgatgattctaagatagatgaggcacttttcggaaaaatatcaaaggggttaatagatgtttttaatgtgaaatatccgttaaaatcatcttttgaaaagggagattagagtgaggacacttgacaagttttttattacgtttatgttgcttttgcaaattaatttttttgatttaataaatacacaaacaagttttttagccagtttcacgtcatattcgcagaaaaaactattattagtagtagcctttatatatatattcattagaagtattgcctatggtattgattttaggcgcaaaaaaaattatttcttatttgttgctttatttctgatatcttggttagctgtattattggctacggtttccacttatgggcaacctgtaattaagactttttttgttagctattattttttattaatagtattgtattttccattttcagaagcaatttcttctaaagagtcatggattaatttgatgaagatttttacaaattttgcttttatactttcattaatcaaaatctttcaatctattttcatatctaaatttggcaaagttatcttttttatgagcaataatgactataatactgcaacctctatgagatttgtaaaattaggttttactagaatgccatcgtcttctgactttatatttgttgctttgttactaataatattctcaattgtatccgggttgaacctgtttaatcgttggaagtatacattgtatattggagtatacgttgcttttattttcttagtgggtcaaactagatcgtacatagttatgactatgctagttttattgttatttatcctttggttcataaataggcattttggaagagacctcgtaatattaactctaggtattttaactattccggtgttgtattttatggtcaaatttattatcaatattatctttggtaattcttctcgtggaatttctttgtcaattcgccaagaagcgatgagatattatttacaaaacatatcactgcataaatggttttctataggttttgctagggatgatgtttttccaaatcttgtgcataataaacatgtagatattatcggtaacgtttattcgtataattatgatgatgttggtatgattggattaattgcacaatatggttggctaggggtttttaatatacttgtatattttgtgacgactgttagcctttttattaagtcacattcgaaatatttgtttttagttgtattcgttttaatatttggcagttggattagtacgtcactgtttgatccacagaggattttatacttaccattgctacttgttttaatggatagtatatcggatggtacgttggaagtagattttcatggaggaaacaggcgtgtctagattatgcaatatttatgattgttttggagttattgaaggaaataagtttattttaataaagttatgtgcattatttttgaaaaagtttttcatcaaaacaaacaaaaaatttttatctcttgggaaaatggcacgtaagttaacgactatcacagataaaatggtcgaaaaatatatctttcaagagtatgaggatatctataagaaatatgaaaatatgacttggcatgagggggaagttccggaagaaaaaataatatggacagcttggttacaggggttcaatgatatgccacagatagtaaagaagtgtatagagtctttaaagaagaattcaaatggctatgaagttaaagttattacattaaaaaatatacatgaatacattgaagttaatcctaaaatctattctgaatttaaaaagggaaacattaagcctgctcactttacagactacattcgaatgaaacttttaagagattatggtggtatttggcaagacgcgacccattttatgattaagcctttggacaataagatttggaacccgaaattactagtatggaataaaatttacgacgttactgataaaaagagtgaatatatcgccattccttttgtagaaggatttaataacagttttttagttggaaaaaagggagctactttttacgagtttgctttagaaattacagaaaagatattgcttgataaagtaataaaatttgattactttgctaattttaaagcttactttgcaggaaaaaataatattgcacaactaagtacttggtgggaagatatgccaataatcaacccttatggaatggtaggtatgcaattgtggaataaaccagtaaatgaacaaataaaaaaaattatagaaaataaaaaaaattatttttttaaattgacttataagaaagaatgggttcctacagtaaatagcaagataactactgaagagtttataatggagaatttttaaaagatgaaaattgctgttgttctaaattttaataattataaacaaagtatagaatgtgtggataatcttatacagaatggaatggataggatagtacttgtagacaatatgtctgctaatgactcttttgaagtcttaaaacaaaattacattgatgaagaaagagtttctgttgggcaaactaatgctaacttaggttatgcgagtggaaataactttggcttcagattgatcgaaaaactatatggggtgtcaaagaacaatataatctacgtagtcaatccagattcttttccagatttaaatgcagtaaatgctgtacataaatttattcaggaaaattttgatacaggcgccgtcacgacgaaaataaatggaactttaaaatctgcttggcaccatttaactccagtaacaggttttatgtttaattcctggatttttagatggatatccttaaagatgggtgttagagaaggtggtatgtatagaaatagcagaaatataatacctgttgatattgttatgggcgcattttttggaattagacaaactacttttaaaaaggttggttatttcgatagcaatacattcttgtattatgaagaagaaattctctttgtaagattaaaacgaataaacaaacaaaattatttattaactgattataattttaagcatataggcagagggtctacagaattaccgaaattgaaatttaaaaaaattaacgatagtagtagattatacttattatctaattactacggtatatcaaagagttataaaatgttctatagattggttaaccgcatagataattttttgttaagggtactgcatagagcttaaaacggaggaggaattttcgtgaaaggaataattttagctggcggttcgggtacaaggttatacccgataactaaagcgacaagtaagcagttagtgccaatttatgataaaccaatgatttattatccactatcggtgctaatgcttgctggaattaaggatattctgttgatttctacaccggatttcatcgatcaatttaaagatttatttggtgatggctcacaacttggaattaatatccaatataagattcaagaacaacctaacggtttagcggaagcatttattttaggcgaagattttattggtaatgattccgttgctttggttttaggcgataacattttttatggtgctggactttcaaagcttttacaagaagcaagtgaaaagacgtctggagcaacagttttcggatatcaagttaaagatccagagcgttttggggttgttgattttgatgacgatggtcacgcagtttccattgttgaaaagccaaagcatccaaaaagtaattttgctgtaactggcttatatttctacgataatgatgtggttgaaattgctaagcaaataaaaccttctgatcgtggagaactagaaatttcagatattaatgatacatatttgaaaaggggaaacttagatgtgcaagttatgggacgaggctacgcatggctagacacgggaacccatgactcattgttagaagcatcaagtttcattgccacaattcaaaaacaacaaaacttaaaggtcgcgtgtcttgaagagattgcttatcgaatgggatatatcgatcgggagcaagtatttaagttagcgcaacccttaaagaaaaatgactatggtaagtatttattaagattgattgaggggtaagaaataagctatgggaaaattaaaagtaacgacaacaaatctacaagatgtaaagattatcgagccagctgttttcggcgatcatcgtggtttctttactgaaacatattcagatcgtgatttcaaggatgctggaattgattttgactttgttcaagacaaccaatcgctttctgcacaagcaggtgttttacgtggattacattttcaacgcgggaaggctgctcaaactaaattaattcgggttgttaccggagctgttcttgacgtgattgttgacgtacggaagggctcccctacatacaaacaatgggaaggttacattatttcagaaagcaaccatcgtcagctactagttccaaagggctttgcgcatggctttgttacccttactgacaacgtaaactttttatacaaatgcgataattactacaatgctgaagcagatggtggaatttcattcaaggatccagagttaggtattaactggccaattgattttgacatggcaattacttctgaaaaagatgcagctcaaccaacatttgcagaatttgaaaaagataatccttttgtttacggtgaaatttaaggagtgctgagaatgaagaatattattgttaccggtggtgctgggttcatcggttctaactttgtccattatgtagtcgaaaatcatccggaagtgcacgttactgtactagataagttgacgtatgctgggaaccgcgctaacttagcgggattgccagaagagcgtgttgaattagtggtgggggatattgcggatgcagaactagttgataaactagttaaagatgtggacgcggttgttcattacgccgctgaaagccacaatgataactcactaattgatcctagtccattcatccaaacaaatatcgttggtacttatactttaatagaagcttgtcggaaatatggagttcgtttccaccatgtttctacagatgaagtttatggagatttaccattgcgtgaggatctccccggacatggtgaaggtgaaggggaaaagtttactccagaatctagatacaaaccaagtagtccttattcttcatcaaaagccagttctgacttattagttagagcttgggtaagatcttttgggttaaaagcaacaatttccaattgctctaataactatggtccttatcaacatattgaaaaatttattcctcgccagatcactaatattttgagtggtattaagcctaaattatatggtacaggaaaaaatgtgcgtgattggattcatactaacgatcattctcgggcagtttggacaattttaacaaaaggtaaaattggcgagacttacctaattggtgcagatggcgaaaagaataataaagaagtacttgagttaattttacaagaaatgggacaaccaaaagatgcatacgaacaagttaaagatcgtccaggacatgacttaaggtatgcaatcgattcaaccaagttacgtgaagaattaggttggaaacctaaatatacgaatttcgaagatggattgcgtcacacaattgaatggtataagaaccacgaagattggtggaaagatgagaaagcagctgtggaaaagaaatatgctgctaacggacaataataaatttaaattaatatagtaggcgtatgcctactttttttggaggttaacatggaaaatctagtaattggtgcaaatggacagctaggtacggaattaagaaatttattcgacgaaaaggatattaaatacacagctacagatgctaaagaattagatattaccaatcgtgacgttgtaatgaattattttgaagaaaacactccaaaatacgtatttcattgtgcagcgtttactgcagtagatgctgctgaagaagaacctggaaaatcaattaatcaaaaagttaatgttgacggaaccaagaatgtagcagaagctgccgaaaaggttggagcaactttaatttatattagtacagattatgtttttgatggtaataatggtggaatgtatacggaagatgaccaaccaaatccaaaaaacgaatacggtcgtactaagtatgaaggggaaaaaatagttgctgaaacaatgagtaagtactatattattcggacctcttgggtatttggacaatatggcaaaaactttgtattcacgatgttaaatttggctaagacgcatgacaagcttaccgtagttaacgatcaggttgggcgtccaacctggacaagaaccctagcagagtttatgctatatgcagttcaaaataacattgcgtatggactctatcaattatctaacgatggtgaatgttcgtggtttgaatttgcaaaagaaattttaaaagatactgaagtagaagtatcaccagtaacatcggcagaataccctcaaaaggcttaccgaccaaagcattcagttatggatttaagtaaaactaagggtactggttttaaagttatcgattggaaagaggcactttctaagtttttggaaaacgtggattagtgaggattgattaaatgaaagttgttaagaactatttgtacaacgccttctaccaaatatttgttcttttagttcctttggttactacaccatacctttcaagagctttaggaccccaaggcgtggggattaattcatatactaattcaattattcaatattttattctcgctggtagtattgggataaatatttatggtaacagacaaattgcttttgtcagagacaataaaaaagaaattacaaagactttttatgaaatattctttctgagaattattacgataaccgttgcgtatatattctttgtagcttttttatttttaacaaaagaatatagatcatattatatagcacaatcgatttctatcattgcagcagcttttgatatatcgtggttctttatgggtgtcgaaaattttgctgtaacagtacttagaaatttagtaataaagataatatcactgttctgcatatttacttttgtaaaagattttaatgatttgtttacgtatatactcattctgtcactatcattgttatttggaaatctgactttatttcctaatttaaaacgttatattggaaaacttgattttaaatcacttaatataataaagcattttagcccatctatagctttatttattccgcaagttgccattcaaatttacttagtagtaaataaaaccatgttgggaactctggatacggttgtggcagcgggattttttgatcaatctgataaggtaataaaattagtattggcggttgttaccgctacaggtacagtaatgttgccccatgtagcaaatgcatatatgcgaggcgatatacagaaaacaaaagaatcattatatagtagcttttcattcgtatcagcgctgtcaattccgatgatgtttggaatgattgcagtcacaagtaaatttgtacccttgtttttttcaaaaaaatttattgctgtgattccacttatgcaagtagaatcaatagtcataccaataattgcttggggcagtgctataggtgtgcagtatttgttacctacaaagcaaaataagagttatacagtttctgtagttttaggagctatagtaaatattgtgataaatattcctttgattttgtgcctaggagcttttggagcaagtattgctacagtctgttcagagatgacggtaagcggatatcaactttttgctattaggaaacaaattagttataaaaaattatttcatgattttggaaaatatttgtttgcaggatttttaatgtttgtggttgtattttttataaataaaaaattaaattactcatggggagcactaggaatagaagtcataataggtgctataacttatctaggaatgctatatattttaagaacagatattttaaaagaagccaaaagcattttaaagaaaagatgatagttttttcaaatttaattggaatcttagtgaagtatttaaacaattaaaatgctaatagaaaataatagcgcattaaaatacatgtgtagctaataacccttgttaacttaactaataaatggtaacatgtctattgatctatgaaatatatttatctaacaagaaaaagtcgtcaatcaccctgattgacgactttttttgttgcagtggatatatttaccaaatcacgtatttattttcatgaaatttcactaaaagtaattaacctaattatcaaaaaaatcattcaaatgtatgcgctttaatgatactgttatagctgacaaacagtatgttttaaaacataaaaaattaaagttaatgtggtaatgtatcgccattctaattgcaagtggagataaatatgctgttattaaaaaagtttatgtttccaatttttttgagagatattgatatttttacgggaaggggtaacacatgattaattctagtcttataaaaaaatgccttttaggcgtagtctgtgggctaagtatcggaattttactaagcgaaaacagatattttgttaaagctgacacggtagaagattacaaaaatgtcttagatataagtggcaatccgactgcaaatttctattcaaagaataagaaagtatctaccaataagtattcatctttttcggatcaaggtgcttggcatgcttattatttgccaaaagaaggggtatcttcgacgtatggtggtttcccgggacccatgatcattgctgaagaatatccagtcaatttgtcgcaccaaatttctaagctacatattatcaacgcaaaaacgaataaagaatttaactttgcggacgctaagagaagttttaactattatccaggtcgtttgaaccaggtttataagtttaaaaatatgacggtcactttggatctgatttttactgatagccgcacggcaatggttagaacaaacattcaaaatactggcaagactaatctaagtttaaaagcgtactggacgggagacattatcaataagttaaagacccgggaaaagaaaacggttaattttaaacagcagttagtgaaaggaactaacggggtaaaggtcaaattttcgaaggttagaaacgataactattatatgaccactgctggtaatcagtttaacgtggtttacagcgcgccagttaaaactagtatcaagggtgacaaatacaagagtagtttaaataaaactcttaccgttaaaccaggcgaaagtcaaaccttagaatctacccagtcttatacctttacaaaaaaagaggcggatgctgaagtagcaaaggccaataatgattttgcaaatgtagataccctcttccaacaaaacgaaaatcgttggaataactatatcactaaggcaacggagaatgataaaagtaagaaggaagttgctaacaaagccaagtatgatcgggcagcagttaaaggaatggaaactttagtaaccaattggataagcccagctggagaattaaaacatgatggaatcgttccttcgatgtctgaccaatggttcgaaggcttatgggcatgggattcatggaaacatgccgctgccgtggcagagtttgacccagagttagcggaaagttcaattaaggcgttattcgattaccaaattactaaaaaagataaggtgcgtccgcaagatgccgggatgattcccgatgccatcttctacaacaagaataaggaacgcggtggggatggaattaactggaatgaacgtaattctaagccaccattagtttcatgggcagtttggcaggtttataaatcaaatcaggataaagcttttttgaaggaaatgtatcctaagttggttgcctaccatgattggtggtactccaatagggattacaataaggacggtttagttgaatatggcgcaacggtcgatccattgcattacaagaagaataagcacaatcagaaagttgttaataaagaagaagtaattcttgcttccgcatgggaatctggaatggacaatgcggtaaggtttgatgctactggagtgggcaaggctgataaaggtgttaaagtttatccagataaggacagcaagggtaaggttgttggatattcagttaaccaagagtccgttgacttgaattcttacttgtacgctgataagggatttttagcggcgattgctaacgaactcggatataccgccgatgctgaaaaatataccgctgaagcctcacaattacaaaataagattcaatctaaaatgtttgataagaaaaccgggttcttctacgacttacaaagtaacaaagatggatcgactctgttgctttcaaatcgagggaagggtcctgaagggttgattccgctttgggcaagggttgcaacgactgatcaagcagctcaggtaaaacaagtattgatgaataaaaagatgtttaacacgtacatgcctttcccaactacttcgcgggataacaaaaaattcacggcaacccaatattggagaggcccagtttggttggaccaagcgatgtttggtattgaaggattacagaattataactacaattctgaggcacttaagcaaaccgaaaagctattcgaccacgccgaaggattaacgggaagcggaccaattcgtgaaaactataacccattaaatggagacggtttgaattcgtcaaacttctcttggtcttcaggggtattttacatgttgcaccacaatgttttaggtgatgaccaaacgtcgtcgcagcagtattttaagtaggacaggttaaatttactgaataggtttaataaaagccgtcaattatatagattgagggctttttagtatgcacaatttatccaaaaaaattagtcgtaatagtttagtgaccattgcaatggtcataagtctgtgtgtataaaaatgaaagcgttttaatatataagttgaagggagggaatgttacggataagaggggcaagcgcatcatctatttattgatgaatcaagaaaactacgtatcagctgaaaaattagcaaaaaagctggatgtttcccttaagacagtttatcgaacaatcaacgcaattaataaaaattatcgaaatgggccgcttattttatcagaacgaggacaaggatacaaacttgattattcaaaatatataagtactgacgaaggaaaaaagccaaattctataaatgatgaactaccaattcaacggcgtaatcaaattatgaaagtgttgctaaaagaagctccagctaaagtgcggataaagacgttgttcgataaatattatattagtgactcatcgaaaattagtgacgaaaaatttattaaacatgtgttaaataaatacaatcttgaggtgcatcgatcaaatgaatatcttagcgtttctggagcagaatttaatattcgacaagcaattaaggatttaactgatgaccgagatgtcattgatttaaaacaaattctcaaaaatgacaattttacgaggaaatatgatgttcggtttgtatttaagcagattgatttaattgaaagcagaataaaaagtacaatcccttacccatataatgtaaatctatttacgcatatgtacattttagttgaccgtacgagaaaccagggcaagcgacaagtggcggaatcgtccaaagaaattagcgaatatttcagaaaaattgagcctacaaacttattgaaaatagtttctgaagaagttatccaaaatattgagcactatgtgcataaaaagttatcacgaaacgaagcttactatctatatgaatatttaatttcctcgcgcttgccgggagtagcccaaaatattcgaaacgatggtaagacgattaattttactaattatttaatcgaaactgttgaaaacataagtggcaaaaaatttaccgattctagttttcataatcgattaatggaacatgttagaccaatgcttaatcgattggagaatggaatcaaaattaataacagcttattagtacagattcgaattgaatacggcgaaatgtttaattatataaaacaggcaactcaattaataacggataggttgaaagttcctcaaatagatgaaaatgaaatagggtttcttactttatattttgcaatggcgcttgaagaagagagtccacaaataccgaccttgataatgtgtgcgaccggggtgggaacctctgaattactaagagtaaaagttgaaaagaaatttcctgatttgaaaattgttgagactatttcgagttttaatttagcaatggcactaaaaaaacatccagagacaaggttaattatttctactattcgatcatcttcacaggtagacatacctgtggtggttgttagcgccatgcttacaaaagaagatgaagataacgttaaaaaagcggtgaggaacatacagtggaaagtttagtagatagttatgcaatttggaatttaaatagtcacagtaaagaagagctttttgaagaagtcgctaagtttttagaagaaaatcacctaattagtgaacggcaagatttatttagagaacttaaccaacgagaaaatctgggaagtactatgattgacgatttgattgcggctccgcatgctcaaagtaatattttcgttaaaaacgtagtaatatttgtttctttagaagatgcagtagaactatgggacggaagttcagcagcacaatattttattttttgctgtttacgagaagacattactcttccagcagccaaacaaatatctaaaatcttaaaaagttttattaaggacgaggtaaagaagtctctttacttaggcgatagggaattgattgaaaaaataattagcgggtaaaaggatgaataatgatggatttaggaattaatacagtaattgataagaagacaattgcaacgcatctaaaagtaaaggataaagcagaagcgttaaaaaagctggctacaatcctcttcaataacggttatctaaaaaacattgacggatatcttaaggacgtttatataagggagactcaaggttccactggtattggtgagtacgttgcaatccctcatggaaaaagtagcgatgtcgcaaaaatcggggtagcaattggcattctggacgacgagattcaatgggaaaccttagatgatcatggagttaaggtaattattctttttgcggtaagcgatgatcatgaaggggcaagagaacatttaaaaatgctgtctttatttgcaaagaaattaggaaaaagtgaagtaataaagaaattactaaaatctaataatgcaaaagatgtagtaatggcttttgaagattaaagttatgaagggagaactttagatatgaaaattgtaggggtggcagcttgtactgtaggaattgcacacacttatatcgcacaacaaaagattgaagaggctgcaaaaaaagctgggtttgaagcaaaaattgaaactcagggcactattggtattgaaaatgaattaacgcctgaagaaatcaataaagcagatatagtaattttggccgtagacgtgaaaatagctggtgaagaacgatttaaaggtaaaaaggttgttaaagtttcaactgaagtagctatcaaatcgccaaataagttaattgaaaaattgggcgaattagcaaagtagttcgcattgattaatttaaggagaagaaatccatgaaagaattaaccaagaaaatgaatttaaaagaacacctattaactgcaatttcctatatgattcccattgtttgtggagcaggtttcattatcgcgattggaatggcattaggcggtaaagcacaagatgcattagtaattggtaattttaatttttggcaagccttagcaaccatgggtggaaaagcacttggcatgttaccggtaattatatcaacaggaattgctttttcaattgctggaaaaccaggtattgctccaggatttgtaactggattggctgctaatactattggagctggctttattggcggaattgtaggcggttacattgcggggctctttgcagttttaatcatgcagcacgtaaaggtacctaactgggctaaagggctcatgccgactttaattattccatttttagcttctcttctaagtggtttaatcatgatttatatcattggaaccccagttgcttggttcacaggatggttaacagatttgctaaaaggtttaggttcaacatctaatttgatttttggtgcagcgattggggttttaagtattgttgattttggtggaccaattaataagacggtatttgcattcgtattaactcttcaggcacaaggaattaatggaccagtaacagctttgcaattagtaaacactgcaactccaattggatttgggttagcttttttaatcgccaaaatgttaaagaaaaacatatacacacaagaagaagtggaaacacttaaatctgcggtacctatgggagttgtaaacatcgtagaaggatcaataccaattgtaatgaatgatttagtacgaggaattgtagccgccgctattggtggtatgtgtggtggagcaactacgttagttttaggcgcggatgctacagtcccattcggtggatttttaatgcttccaactatgtcgcaacctttagcagggttagcatcattactcgttaatatttttgtaactggtttagtttatgcaattatcaaaaaagatgtgaaggtcgaaaaggctaacgataatgttgaggaagatatcagtttagacgatttggaaattaattaataagcaaggggtagaaatgaaaaaagctagattttcaccatcattaatgacgatggacttagataaatttaaagaacagattacgtttttgaacactaaagttgattcttatcatattgatattatggacggacattatgtacctaacattacgttatcaccatggtttatggaagaggtacggaaaattagtaaattacctttatcggctcatttaatggtaactaatccgtctttttgggttaaacaactgatcgatatcaaaagtgattatatatgtatgcatgtagaaaccttagatggtctagcttttcgattaattgatcaaattcacagtgctggtttaaaagcaggggtagttctaaatccagaaacaccaataacagtcattgagccatacattgatttactggataaagtcaccatcatgacagtagatccagggtttgcaggacaacgatttttagtttcgactttggaaaaaataaaaacgttaaagaaattaagagaagaatacgggtaccaatacttaatcgaaatggatggttcatcaaaccgggaacattttaaagttattgatgaagcaggaccggatatctatattgtgggacgcagtggactgtttggcttgagttctaatatcgaagaggcttgggatcaaatggttaaagattatgaagaaacaactaacaagtctttattatgattagacgggagattggagaatgagatttactaaaaaagatattgatgcggttaacgcaattcgttttctaagcgcagacatgattgaaaaggcgcaaagcggacacccaggtttgccgattgatgcggcacccatggcgtacacattgtgggagaagttcttacaatttaacccacaagatccaaaatggattaatcgggatcgctttgttctaagcgcgggtcatggatcggcaatgctttatagtttattgcatttgaatggctttgatttaccgctaactgaattgaaaaagttccggcagcttggttctagaactccgggacatccggaatatgggatgacggccggtgtagatgccaccaccggcccgttaggccaagggttagggatggcagttggaatggcaatggcagaacgccacttagcagcattggttaatcgcccaggttacccagttttcaaccacttcacgtacgctttagttggcgatggagatctaatggaaggggttagtcaggaagctattaacattgctggccaaaaacagctcaataaattaattgttttgtacgattctaatgacgtttcgcttgatggacctttgagtttaagtgccaacgaaaacgttgcgcagcgttttaaagctgctaactggaattatcaaaaagttaccgacggcaatgatctggctgggttgcaacaagcgttacagcaagcccaaactagcgaccgaccaaccttgattgaagttaaaacgataatcggatatggtaccccggaaagcgggacgaataaggtacatggaaatgccttaggaaaggctaatttggcagcgatgcgccaattttatcattggcaagcggcgccgtttgagattgccccagaaatttaccaacattatcaagaacaggtagctaaaaagcaaacggcctaccaagcctggcaaacaatgttccaagaatatcaaacagagtttccagaagtttaccgccaatttcaagatgcgcgcttagatacgaccaagcttaatttagatgacccggcatggcaggagcccatggcaactcgaacgagcaattctaaaattatgcaacaggttgccgaccagaacgtgcaattatggggcggctcagcagatttgtattcttcaaataatactcgccttgatgattcgaaggcgtttgatgcgttgcatcccgaacaacgcaacgtttatttcggagtgcgcgaatttggcatggcaactgcggttaacgggattaacttacatggcaacgcccgggcgtttgggagcacgttctttgtttttagtgattatctcaaagcagcgattcgcttagcggcgatccagcagattccagcaatatacattttcacgcacgactcgattgcggtcggcgaagacggaccaactcatgagccgattgaacagctagccggattacgatccattcctaacgtgacggtgattcgcccagccgatgcgcacgaagtactgggcgcttggcaaaagattggccaaattactgatcagccaacggtactagtgttgacccgacaaaaagtgccgttattagcgcaaacgcaggctgataaagtggccttcggcggctatacactctcgccagctgtcaccgccaatccggacggaatcttggttgcaacgggttcagaagtcgccttagccctacaggcgcaacaaaaactcgcccaggaaaaattgaacgtggcagtagtttccatgccgagcgtcgagcttttccaagctcaaagtccggattatcaagctcaagttcttccaccaaacgtgaaggtaaagctaggacttgaaatgggcagtcgcaatggtttagccacagtggcgagcgcggtaatcggaattgatcactttggggcaagcgggaacggcacggaagtagttcaacaagcaggtttcacggtagataacattgtggaacaatttaaagcaaaattagcagaggcggaagtgaaatgatggatgtaaatgatttaactattaaggtttatgaagacggcgcggaaattgagaaaatgcgagctgctagtcaacaggcgttcgttaagggctttactacgaacccttcgctattaaaacaagcgggagtgactgattatttagcttttgcccgccaagtggtggcagaatttccaaagcaggagttttctttcgaagtttttagtaacgaaccgcaagaaatgttgcgggaagctcaaattttacatgatttaggtccccgagtgtatgtaaaagtaccgattattactacaaccggagaatccactgcggacgtgattaaagagctatcggcagcgcatattaacttaaacattacggcaatcaccacggtagaacaggttgaagttgccgagcgtaatttagcaccaggcacccacaacttaatttccatttttgtgggacgggtagctgacgctggaattgatccgcatcatttgattgaaagcagtgtagaaattacgaagtctcacccagaagcatccttgttatgggcaagtacgcgagaagtgtacaacgtatttgaagcacaacaaatgggggtggatattattacggtgccaccagctttaattacgaagttaagtaaaacgggtaaagcagctttagaaatttcagtggatacggttaaaggtttccaacgggatattgaggaatcaggattgtcgattttataactagcggatgatttttattaatatgagtttgataacgaaattgtacacatcccgatttgtttaaataagcaaatagttttagtacgttctaacaacttaaattttcctagaagtatttaaaaaggtttagttcactttgtgaactaaacctttttagctagacgtaatgttgtgtgattttatgaagattttattatttagtatgcattgtttagtttttaattcagttacgataaggtgaattggtgataaacttacattatcaaaataaatactgatttaggagatttacgatggaaaaaccaatttatttaaaaaaagtgattatagaaggctttcgatcatttggtaaaaaaacagaaattaacattgacgactttaatacttttatcggaaataatggaaccggaaaaacaactactttacaagcactaaataaaattttttcaactaatccaaaagatagaattattgaagcaactgacttctttgtgtcaccccaagaagaaaacgagcagacaacaaatcgggatttaagtatagatgttatttttgggattagtacagaaaaacttgaaaatgatggacgtgcagcggctatttttttgaaaaatatgacaattaatagcccagaagatgaaccgtatcttcatattcgacttgaagctagttggacatctgaaggtggtgcaagcgggacagttgactataatacttactatgttgatagagaaaataattcaaccattgcttcacgtttgcaacttaatagtttaagaatgatttatgtgcctgcagtcagaaatccaacacgtatactaaaagatagttctcatagcttattatcaagtttaataaaaaatgtagtgtgggcagagcagacaaaagaaaaaattaataacgaaaacaaaaggctaaataatgatttcctaagtgaacgtggtatggcattaattaatgataaagtacgtaaaatttgggacgagttttgtcctgatgaaagatatggcggagcaaaattagaaatttcaccgactgatctagtagcgatgagtaaacagacgcaaattgtttttaattcttcgaacgtagaacataattatcaaattgatgaaatgggagatggatcacgttctttattttatatatcaaccgtgaaaacggctcttgaaattgaaaatgaacttattgatttagaagcagaaaatgatccgattataaacgatactcctccattgttaacgatggttgcaattgaggaacccgaaaatcacatttcaccacatctattaggaaaactaatgaacaggttgctcgaaattgctaaattaaaaaatgctcaagtactgctcacatctcattcaccggcaattgtaaaacgagtagacccactaaaaattcgtcattttagaataaaatctagagaaaaatatacagaagttcataagttatcgttgccaaacaaagaagacgaagcatataaatatattaaaagagcagtccagacatatccagagctatattttgcacaacttgtggttttaggtgaaggagatagtgaagaaatcattttgcctcgattttttgaggctaaaaataaaaatttagatgaagctggaatctctgttgtcccgcttgggggtagatttgttaatcatttatggcgattgctaaatcagttaggaataccatatataacgcttttagacttggataaagaaagaaaaggtggcgattggcaacgtattaagtacgtcattaaagaattaaagaagttaaaagaaaatgatgaagagctaaatgaaaaattatcagtatttgaaggccaaaaagttgtaagtagtgaaaaagatttaaaggaagcaatagatgctctagaaaataaaaacattttcttttctgcaccactagatattgacttcatgatgctaaaagcttatgggggcttttataaaggattacttaatgatgatgagggacctagatataaaaacaaacaaggtaaaaatgttaaggttcctaaaaagaatacaaaatctttagaagaagattttgtgaaaaagatagaggacgcagtagcagaaacattaaaaaaagatggtggtactggtgaatcatataatcaagaggaacgtgaattaatgatttggtacaattacttctttttaggaagaggaaaaccttctacacatatattggcactatcaagtattgatgatgaaactttaaatactaacatgccaaaagtaatagaacggttacttgttaaagcagaatacttactagaaggtgaaaatgaaaaatgataaaagaagtgtggaaccctcgaaatggaataaaattagaaaaaaatgctaaaaaggctgtattttcagaagaaaatactcttatattagctggtcctggcgccggaaaaactgaaatgttagcacaaagagcaagttacctacttgaaactggaaaatgtcaaaacccatatagaatcttagcaataagcttcaaaagagatgcagcaagtaatttaaaagagcgagtgaaagagcgtactgaaaagaaaaataatatacggctagattccataacttttgatagtttttctaaaagattagtagatcaatttataatggcaattccactaaaatggcgaccgtcaaaaggatatacaatagaagattcagaaataaaggaaacaatttataaaaatatagaaaaaccagtatataaatattcaagaacaacaataaataatttttttgacaaaataaaaaagccaactttagaagaagaacccgatggagtatggcaactttctctaaaaggaacagaaaatttaaaaccgaacttaacatttaaaatgatcaaccagctcgctattttcctacttcaaacgaatcctaatattaaacgtttaatacaaaatgcatacccatttgtttttttagatgagtttcaagatacaacagcacttcaatacgagttaataaccgaatgctttaaagatactactacggttataacagccgtaggtgatacaaagcagaggattatgggctgggctggcgctcttaaaacaatatttaaagattttaaaagggacttttcagctaacgagttgtctttgaaaatgaatcatcgctcagcacccgcattagttaaattgcaagaatcagtttgctttttattagaagaaggtattgaaaatattagaacttcagaaaaatggggaaaagaagacggggagataaaattattcaaatctacgagcgaagaaaatgaggctcaattagtaggtgatgatatattaaaaagattatcgaaaggattacggcctgaagatattgttattttgtgtaaacaaaaaccagacgtatatacaaagtgcttaaaaaattacttggaagaaaaggatgttcaaattagagttgaagatccatatcaaagtttactcaaggagcccgtagttgatttaatattaaaaactatttcagcagcggataatactttggaatcgaaagaatggcaagaatacattgatatagtgtgtaaaatcaagcaaattacaacaagtgaaaatgatcggcagtttggagagtgcttaaaatcgttaaatctttttttaaaaagtttcaaaaaaaaacttactggtgctttagattcagaacaagtcaaaaaaataaaaaatgaaattatgagttattttaagactgaaagtatacaagaagcttttccagaatatagaaataagtcttatcttgatagacagcttgaaaatttttgtgatctaattataaaaaccaaagataatgctacaaactggcaggatataattgataacttcaaaggaaaaaatacaatttctatcatgacaattcataagagtaaaggattggagtatgaagcagtttattttgtaggattagaagaccaagctttttggaactttaaaaaacaacgagatgaagatataagggccttttttgttgctatatcacgagcaaaaagaattctagcatgtacgttctgtcaaaaaagaaatatcgacaaggtaaagagaagacatgatgaaattagagagctttataaattattagatgacaatgcagaatttatttgtgattaaaataaaacacgaggttgtaattatgtaactattttatagtgatgattatctgaacagggtggtttatttttaattaaatgtttatagggatctagcttaaaataaaaatatgaattttttactttttataagtttgctattaactagtactgaaaggtaaccgttttttattatcaagtttcgtttgaatggtggtttctaattactctacaaggggttgaaagtgctttttggttgtggtattgattgttataatcaacataatcttttactttcaacagctatggaatctagcacgtacctatttaatttcagaaaagcaagagtaaatattatagtagtacgcttgttatcgtttaaaagaatgtacttttgggatggtgtaagcagacgctgagatatatttgcgcataaaaatattttgctatgatcgtttaaaacaatcataggtgttctaatttgttcatcaagtcagcgtgattattcattaatttattcgttatacttttaactttgggacgaactttttcaatatctttgaagtcgatttctctgccatcacgaggcatgttcttttcatcaatatttaaaaattcgcaatcacgttttaatatttttactttctgattcaacttttctggactagtcattgttctcccccctatatacataacatattattccagataagcataaccattaccttgttatttattgataaatttaatggaataaatagagattgatttgtgattgttacaaaaaagcagccacaccttaatgagtgtggctgctatgtttgaataggggctgttacttattgtgataaattgaatatttaaaaaatccagattctcaggaacaacctttcctaagcaatctggatttttcttatttctccaccgaactagtcccgtccgcgtaattcaacttcacgccgtcttgaacgttgaagatgaagacgttgaaatggatgtcgttgtcgtcgatggattgggcttccatttggacgccgcgggctaataagtcgtcgccgttgaaaatgggggtgacgcggtaacgaacgtagtgtttagggtcctgttttaggtagtaggcgatgtccatttcatgggcgagcatttctggcgaattcaatgaacgggttccggtcattaggttttttaagttattgttttggccggttaattggtagccaattaagtgactgcgattatataaccatcccgaagcaatccgcttattgtgccaaccggtggggtttacggttaacggttcgcgtttggcggtgggcatcaaggattggtttagcatggcattggcagccgtcacccggttgaggtggtcaaggttgccgtaacgttgccaagcccctttgtcgatagctagatcagccgtggaaaacttcggctgattgtggttaacgatgacttcttgttgcccagcataatttagcttggctaggttagcagtatcggtttgtttggcagccgccgattgatgaagttgtttcttcttgtggtttagttgtttggtgagccggtcatttttagcctgtgcttttgcaatcttttgcttcagctcccggttttccttctgaagtttacgggtggctttgcggtgcgggtgggtgtacttcaccacggtctttgcttgaaccgttggagtagggtggtaaaccacgctccccatcaaaaatggcacgactactaatagtaattttgcctttaatttcattatctcaacgcctttcgataacctgcagcttgggcttccgcttcggaatggaagtgaactgcgttagctgaattcatgtggtaaccagcttgcccagggacgtggtaaatgtgggaattaacgttaccaataatgtcctgggcggttccggtgtatgtatcgccttcgtcatcatttgcttgcgctgcggattgttgccgagcggcctggcgactttgttgggcagcggcccgactttgcgctgcggccgctttttgttgtgcttgggccgcctttttagatgaggccgcggctgccttactttcactctcggcgcgggctgcggctgctttgcttgccgcggccgagcgtgaggaagcttcttcgcgcttggctttggaagtggcgattgcggtggtggcctccgctttctcgctagctaaggttgcgttctcgtgcttaaccttttttagttgggcaacgagtgcggcgtgctttgccttagcggcttggtaatctttttggtcactgcgcgccaccttatggaccacgtgggtgctttctacttgagcagcggatgaactagactccgtatccgggataaactgcgctgcccccacaaataaaactgcactcaagattacgggaacaattgcgggccgggctgatttcttatgaaataaatcaataattagggcaattacaaacgaaatcaatccagcaaatcctagtaatgatacggcattggcaaaggatgtactttgggcgatcactaaaagcatcagccaaattgcccagacggtcaatcccgaaaagactcgcggataattactttttgcccaaaggtggtctttactccaccggtaggcataataactcaatgaaattggaaaaaagaggatgattaatccccattttaggtactttggcataaaagctcctccagttgttaaattttcccctttaatagaatactatagcgggtcatgagaagaaaggagcttttacgttgacaaatgtaaacctgccttttatactaatcatgaaggttacaaatgtaaacgtaaaagggaggaatgccacgatggaaaataccgcaacggaacttagcggtgccgaatgggaaattatgcggatcgtttggacgctcggtgaggcgaaaagcacggaaattgtccacttgatgcagcaatcaaaaaagtggacggcttccaccatcaaaacgctattacgccggttagtggccaagggcgcgttgcgtaccgaacggctgggtcggaagtttatttaccatcccaccattgccgaaaaacaggcgatggaggcgacgactaccgagctctttgaccacatgtgcaacatgaagaaggggcaggtaatcaccaatttagttgcccagactaccttaagtaagcaggatattagcaatttacaggagttattgcaacaaaaagcaaccaccgcgccagcaaaggtggaatgcaattgtcttccagaaacggattgtgacgaaacttgcaccatgaaagagggggattagatgatgacgagattgattgttttaatagtaggattagcgctaattggttttatcgtttggtggttcttcggtaaacacgaagcccaatcggaagtggcggaagttactggcgatacccagacggtcgatgtggaggttaacggaggttactctcccgaaaagattgtcttgaaaaagggcgttccggcagttctaaactttacccggaaggatccgtcaagctgtttggaccgggtggttttcgcggactttgggattaaccaagccttaccacaaaaccaaaccgtgccaatcaaaatcgataccagcaaggctggcgaatatccgtgggcatgcggaatggatatgttccatggcaaagtcgaagttaaatagctaagggaggtcatttaaatgaaagagcaaacgcaagtcgttaacgttacggtcgccggtggttatcaaccggccgaagtgcattttcaaaagggggtccctgcacaaattaactttcggcggaccagtccacaaggctgtttggacgtggtgcattcttcgcaactaggatttgcagaacagttaccgcttgacgaaaccaagtcggtcaccatcaatacggacaacgcgggagaattctcgtttagttgtggaatggacatgtttagcggaaaagtggtgattgagtaatgaaaattacaactcgtttttggatttcgttaattttttcgttgccaatgttggtcgaaatgatcttgaaaccgtggggattcatgcttcccggtggccactggacgatgttagccttaaccaccgtggtaatggcgttgtccgcgcgcccatttgcgcaaagtgcgtgggcttcgtttaaaaaacaccattccaacatggatacgctggtggcaattgggaccgcgacggcgtacttctacagtatttacgcgatgattaccggccaagcggtcttctttgaaagtgcagcattcgtcaccaccttcgtcttattgggccagttttttgaagaaaaaatgcggaacaatgcttcggaagcggtcgaaaagctggttaatttgcaagctaaggaagccgaagtgctccgcgacggaaagtacgtcaaggtgccgctcagcgaagtgaccgtgggcgaccagattcgggtacggccaggcgaaaaaattgccgttgacggagtgattgaatcgggttcctcaacgattgacgaatcaatggtgacgggggaaagcatgccggtaactaaaaaggctggcgatcacgtgattggctcgacgattaataacaccggaaccttcgtctttaaagctagcaaagttggcaacgacaccatgttggcgcaaattgttgaattggtgaaaaaggcccaaaatagccatgctccaatccagaatttgaccgaccgggtttccgatattttcgtgccggtggtcttgattttggcaatcgcgactttcttagtatggtacgtcttcctcggggctacgctagcacacgcgttaatctttgcggtttcggtcgtggtgattgcgtgtccatgtgcccttggtttggctacccccacggcgttaatggtcggtactggccggggtgctaagatgggaattttaatcaaaaacggtgaagttctggaaaaggtcaacgaagttaaaaccatcatctttgataagaccggcacggttactaacggaactccagaagtgaccgacgtggttggcgaccgtgaccaggttttacgggtggcagctagcctcgaacaatcttccgaacatcccttagcaaccgcaatcactaaggcggcgcaaaaagcggacatcgccccggcgacggtcactaactttacggccgtggaaggcaaaggggtaaaagcgcagctaaacggcaaaactgccttagtagggaacgaaaagttattggacgaccttgccatcgatgagcagtggcaagatgcgatgatggatttacaaaaagcggcgaaaacggtggtcgtggtggcgctagataaccaggtgatcggcttaattgccattcaagacgcacccaagcccacttctaaggcagccattgccgaattaaaggcccaagggttacaaccggtcatgctaaccggggataaccacgtggtggcgaaggcgattgcgcgacaggtcggaatcgacacggtaattgccgaagtccttccacgggataaggccgaacgggtaaagaatttccaaaaggccggtaaggttgccttcgttggggatggtatcaatgacgctcccgcattgagtaccgcagatgtaggaatcgcaatgggttctggaaccgacattgcaatcgaatccggtggcattgtgctagtgaaaaacgatttgcgcgacgttgcaaaagcattggaattgagccgcaagacctttaaccggattaagttaaacctcttctgggcgttcatttacaatgttttgggcattccagtggcggccggtgttttctacctcgctggaattatccttagtccggaattagcaggcttagcaatggcgtttagttcactatccgtagttacgagttcggtactcttgaaccgggcgaagattgcgccgaagtcggcgacggcataataaaagaagctgagaaaaaactaaaaattattttggcgttttgactttaataaagtcggaacgtgcgccaaaagttattttatttcgcttaaccaaaaaaagagcgttatgccaaatttaggcataacgctcttttttttagtgcttgcaaactaccaacttttgttccacgctctttttggtatcgagcaattaggcaaagctagtattcttcaaccacggacgaaccaagcagtaaaaggcaaggtagccaattaccactccagccgcgttagtgagaacgtcggtaatgtccacggtacgttggatgttaatgatcatgtccaaaattagttggttaccttcgttgaaaattccgactaggcctgcgcaaagaatgacagtcagccagtttaggtgccggtggaataaaattccgagataaacgccggctggaatcgtcattacgatgttcatgtacgaacccatcgagcgcaatgccgaagggtagtagataattttagcgtgatgccaatagaaatagcgagcgtaatacgcgtacgggtcaaagaagtattgtcccggggtaaataagagccacgctacacaaactaagtacacggctaaactaccgaaaactacggcccggtctaacgaagggcgccgctcgtaagcaatcaaacagccgatcaaaatgattaacgcgaggccaagaaaggggatgtacttgataataaacattagttagcctcctaatttagttatgcatttatcttaacgattagcgcgattggtagcaagaaatacggggattcctaacaaagttataataattccggtaattgctagaaccggttggttgatgatggtcatgaccaatacgaaagtcccgccgagaatcgccacaattggcaataacggataaagcggcacccggtatggccgttctaattcaggttgggtgcggcgcaatttaatcaccgcgtaaaagattaaaacgttaaaaatccacattacgaaaattaacatgtcggttaataagtcaaaggaaccgacactaatcatcaaaagggcgattactaattgtagtaatccggctacgtacggcacgctggtgcgggaaagccgttttaaagcccgactgaatggcagcgaattttctaaagccattgcgtaaggcacccgaattccagtcattgtgtatccattcagtgcgccgtatacggaaatcaaaattccaatggtaactagtttaccgcccaaattacctagcaggtgggtggctgccacggaggcggcgttaaggttgccagcaagttcgtggattggcagggtccgcaagaagatgaaattaatcactaagtagaccaccataattccggtgagccccaagccaattgctaaaggtaagtcgcgtttgggatttttcatttcgccggcaattgctccaattcctaaccaaccatcgtaagcaaatagggtggctagcaagccgccgctaaatccggttaaggtttgggaaaagtgactgtttgctggtagcaggctgaggtgtaccggactactggaacccagtccccaaattacgatcacgatcagcgggattaacttagcaatgagggcgaccgattgtaatcgcgccccgtacttagcgcccagcaggttgactccggtgaccgacgcgccacaaagcatggcgatgggcaccaaaagcccattggataagtgcaataaattgattaattgggtactaaagatgatcgaaagggcggcgatgttagccggaaaataaatcaaggtttgtgcccagcccattaaaaagccggtcagtttgccgtaactggcttcaagatacttaatcgcgcctccggtcaccgggatggctgcggcaagttcggcactggttaacccgccacaaatggtcaagattcctcccgctagccaagctagtaaactaagccccgcggattgggtactggcggtgacgctggctactttaaagaagacccccgcgccgattaccgtgcccattacggttgaaaaagctgcaaataaaccgatgtttttttgcagctgctttggttttgaattattcataaaaaccccctgaacgaacgttgccagaaacgttcgtgttttctgaaaatatttttaatgataattcgaatattataggggataagtgtacaatattcaacaatgaggaggcggcacgatgaaacaaaatctgcgcgcggctcagcgtccccggtttgctaaggcagccattaaacgtcaacgccgattgattttttccatcgtagtcgcgttggcgttactaattgcgggaggctggggaatcttttggcacgtccaacagcaagaacagcagaccctttcaccatattcaatccgcggatgcgtgattgatcaagcagatgggatcatcaattttcaagatttggctaagcaaaaagtaaaatttgtctatttaaatgcgacgacaggcgccacgtactttgatgattcgtttaacacgaactacgaccggttacgtgcaactaaccttaaggtcggggtggtgcataactttagttttgaaagaagtgcggtaaagcagcttcaatatattagtcgcaaagtgaaaagtaataccgggcagctcccggtggtaatccgggtgagctactacggtgaagatacggcggagaaggtggattggaagaagcagggccccatcttagccgatttagtccggcggttagctaattattatggacaaccggtcgtaatcaagactactccggaaattcggcaacgactgtatcccaaatacgttaaacaaagccggttttggttggaagccgagaaagttcaaaaggccgaccggcacgtagaatttgtggaatacgatgatcagcggacgctgaagaccgaccgccgggaaattgaattgccagtttcatattttaacggcggacgtcaggaatggcagaagtactagatgatgggcaactttcagtaaatgaaaaagagcctgaaaatcaatcctctttttcgggacgattttcaggctctttttctgcatcaacgattgcgtaagtttcattgttagcttcatcgtaaacgctgattgggcggtattcattggctttaaccacgaggtggtagccaaaacggtcaatgaaggtgattcggtaactatccaaatcttcgaccaccgttttcaataattttccatccaggtaaacgtcgtagttaggtaaaatttttaattcgtgttctcgattagtattgggctcgtgatataaccaggtcccggcaaagaaaaacggactgacggtttcttcagttttatcggtttttttagaatcgaaacgaattaatgaaaaaaggtcaccaagtgctgttttttgccagttcatacgcccatactccttctctttattgtccacttaaatataacattatttgggtaggcgaagtagtaaaacggcttagtttttagcacttgttaaaaaattgaagtaatcgaaatcgttttgtaatattgcaccccgcaacgattaatgaaagcgcttatcaagggcggtgatttttccgtggttaaatatctgtggcaaccaaaaattctttacgaatttaccagtcgagaaaacatttttgcaattctacgctgaataacttacctcaattaaggtagaatagagttagaaatttaaaggaggaaaacagcatgattaaatttggaattattggaactaattggattacccagcagtatgtggatgctgcccatgctagcaaagaatggaaattgacagcggtttattcacggactctcgaaaaggcacacgagtttggggataagaacggggcaactaagttctacgaccaaattgccgatttggttaacgatgacgaagttgatgctgtttacattgcctcacctaacagcttgcacttcgctcaagctaaacaagttttggaagctgataaggtagcggtagtggaaaagcccatcgttgccaatcctaccgaatggatggcattagacaaaattttaaaggcgcacccgcaagctaaactattcgaagcagctcggcatattcacgaacctaatttcaaagcaatcacccaaaagattgccgaaatggacgaaatccagggtgcaacgctaacttacgcgaagtattctagtcggtttgatagttatctatccggcaacgaaccaaacatcttctcgttgaaatttgccggaggcgcgctgcaagacctcggagtttaccttgcatacgacgcgatggtttggtttggaatgccagacgaagtggcttacttcaatcaaaaattgcgcactggcgccgatggtaagggcgtcgcaattttacgttacccagaatacgacgtggttctaaacgttggaaagaacgtcaattcagaaattggctcagaaatttacggtttgaaagataccattattatggacaacgcggctgaattaaaccgggttgaatatttgaatgcgtccggagacaaggaattgatcagcaccactccagacgaaaatccgatgattgctgaagcaactgactttgcgcgggtaattaacgatccggatgatccgcagaaccaaaaggattaccaagaatggctaactttgagtcgaaacgtcaataaattgctctataaccttcggcaaaatggtaagatatactttaccaatgaaaaagaagaggattaaactttcatgaacgatttatttcaacaacattttcaagaaaagggctttaagcaaccaaccttaattcaagaacgggttgccgaaccgctccgggcgggggaaactgtcttaggactttccccaaccggttctgggaaaaccttagcgtttgctttgccattactggaaaaagtgattccaggcaacggtccgcaattgctagtattggcgccttcccaagaattggcgatccaaactacggacgtttttcgcgagtgggcaagtttaattaacttgaagactacctcaatcaccggcggagcgaacgtgcaacgacagattgaacggttaaaaaagaagaaacccgagattatcgtgggaacccctggacgagtgcttaccttaattaatgagcgccgcctcaaggtgaaggaaattcagagtttagtaattgacgaagctgacgaaattttgacgggggaagctctcgaagacgttcgtcagattgaagatcaattaccgagtgacgttcaattgagcttcttttcagccactaacgaccttgcaatagatgatttgcaaacctggtttggcgtaacgccgcaagtaattgacgtccgggctgaagaccagacccggggggcggtgcaacacggttggctaactgcttcaccgaagaacaaaccacaaattttacgccaattaagtcgggtaaagaagttccaagggttggtattctttaaccacgtagcgacgatggaaaaaattaccgcccttttgaagcacgaaggcgttaaggtcggcaaaattgcgggacaccaggtacaaattgatcgggctgccgcaatgcgccggtttaagaagaaggaactttccttattaatggttaccgacgttgcggctcggggattggacattgaaaacctcccggccgtaattaactacgacattccgcgggacgccactacctacactcatcgggttggacggaccggacgcatgggccaggcgggctttgtgattagcctgggcgatgaccacgacatccgaaacttaaagaagatcttgcgagagctggaccaaccggcagaaaaattggcaattgctaaccgccagataatgaccgctactaaagctcggcaagttgccgaacaagcggcggacgaaaaacaagtgtctgcgccagttaccgaagaagcgccacaaaaagatcctttgcgggatgttaaaactcgtaaagcagcaactaaggtgagctccgttgcttcctcaaagcctaagaaaaaagggaagaagaagcatttgaaacggaaggggaagccccgcgcaaagaaatcaaattaaatattatttagttttgcttaattatcaattttttagttaaaaagggcctgaaatagtgtaatatagtcactgttgaaaggtgggtataattttatgcgtagagaacgtagaagagcgtcgcacacggtgcgcaatactattttaattgttatagcagttattttgcttggtggaatattctatggggtgcgcaagtaccagaacgtcaaaaatgcggttgatagtacctacagtagtgcaggtattaaaaaacaacggaataccgccgatttagttgctaataaaaagccaatttcgatcctattaatgggaacggataccggagcactcggtcgttcgtataagggacggaccgatagtatgatggtggttacgattaatccaaagacaaataaaacgacgattactagcatcccgcgggatttaggggttaccattccaggatacgaagaaaagtcgccgtctaaaattaacgctgcttacgcgtttggtaaggcaggaactgcgattcgcgcggtacaatcggttttcaacattccgattgattactacgtcttagttaacatgggcggcatgcaaaaggtcgttgacgaagttggtggagttgatattactccaacgctcagctttacgtatgatggttatacctttaaaaagggtgtcaagactcacatggacgggaagaaggcgctggcttactcccggatgcgttacgacgacccgcaaaacgattacgggcgtcagactagacaaagggcagtgttaactgctatccttggcaagagcagttcggtttcagcattgcttaacaaagattttatcgattcgattgctaacgaaacccagaccgactttacgtttggtaacctagtggacttggcaaagaattaccgggccgcatcgaagaacattgaagaaacccatgctcaaggcagtggtcaaatggtcaatggacaatcgatggaaattgtttcccacaccgagttacaacgggtgactgatttcataagaaaaggcctcggcttgaagcacgccgaaaccggaactgcggcgttatcagctaatggagctgctaacgtaagtaatagtcaggtagagagtgaaaacattaatgcagggaattaaaggagataataatggcggataaggaaaaagttgacgaaaagaaaccatttgatgtaggcgatgaagttacggtgaagaaaactgatcttctaccaactggttttgcaggaaccgttggaaaagtctatgaaaactcaattttaatcgaaattgacccagccagcgttgctaattcacgttcagaggaattgcacgatttacatggtcgggttgtagtacggatgagtgaagcaactaaaaaagcttaagcctcctctaggaactccaaatcgggtaaaaagagccggtttggagttttttattatatttattgttcttgatctttttctttgtggtaaaatacagtatgcccgtttttgtttattatcttgtgatacataggggggagtagctagtattttaaaaaagattaagtttgagcctattacaagccatacgacagtttttttgctaatataagtgtaaacaagatttaccatttagataacaagatattttgcgaatttgaatgcagagaaaagaggaatgagtatgtcaaaaaatttaaaaattgaccttaacacagatgaattaatcggaagtcgtgaagcaagcctaatgtggggcaagcaaaaggattacgtacgaacaatctacaacaagtatccagaacgcttcccaacgggcacaattcggaaatttggtaagcaattaatcgttacacgcgaaggcatggaaagtgtaacggggattaagtacgaagacttggataagaaaaacattgaaaaggcaaagcttcctagataattttttgaaatactaggttacaccagcttgaaaaattttcaaattcgagcattgttctgaacgaggtttcagaaatcacgaaccgtccatatttgttagacaaaaatctaataattactggggacggtttttttagttgtctagggactgaataaggatgccttttaggaatggcgttactaatctgacaggacaactttacagaatttaaaattcatgcaatactaaattgttaggtctccgtggctcaactggatagagcaatcgcctcctaagcgataggttgcgagttcgattctcgccggggacatttacttatggcttgaaacgctgataacaaagggattttggagaaaagtgccaaccaagtgccaaccaaacgtttaaaaattaaagcatctttccttaaatggtagatgctttttttggtttattcgtaaataatttgtccagtcctttgataataatttgatcatttttatctttatattcgtcaattaaataagcataaattctcgttgtagttgtgatatccgagtggcccaatctttgagcaattggataaatatcaataccttgcgatagtagataagccacgtgagagtgcctcagagaatggaaatggaacccaggtctttttatattcaatgcttttaaatgcgttcgtagtgctttatttacagcgttagaagaaggcacagttccacggttgtttctgaatactagatcagttggctttgaatcatcgtgcattaatccacctaaaatatcgcacaaagtattgttaattttgatgatgcgatttgagcttttgtttttagttggtttaaaggcatcattcgcatagtcatacgatttattgatattaatggttttaaaattaaaattaatatctccccacgtcaaaccggcaatttcagataaccgtgcaccagtcaatattgccgtaataatcatgtaatttgaagtgtatagtgggtttaacttggatgctaagtaagtcataagttgcttgatttctgtgatgttgaggtattcaacgttcatagctttatctctgttagcaattagctctatgttgtaagtgaaatccttactgatttcttcgtcgtagagcgcgttttttacacagggtttaatgctgttatttatcttacgcatagtatttggtgaatgattttgcccgtactttacaataaatttctggtatttagcgcgagtcacgtcttttaataacatagagccaaaatattcgtggataacattataaacgtagtcatatctttttaaagtgatttcacttattttgggctttttgtagaacgtgtaccaatttttgaaatattcggcaaaagtttcttctctttcagactgcaaacgattatcttcgttttcgtaagcgagccttagcttagattcgtataatgtggcttcagttttagtattaaaaccacgtttagctttataatgccttttcccgagattgtcataccaacttatactagcttcccattttccgttttttcttttatttactgacattatcgaacctccgttctcttttatggaggcagcccaacatgctaaaatagacagtgaaggggtactgcccctatgtagtagttcagttgatagccacatccatcttcttggcgggagtagggatgtggtttttgtgattagtagaatctattaaatgtatagagaggaataaaaatggataaattaatttatttaatgccggggttcatttcgtatatagcattaagaccatttggattgtttaattttcaaaatgataccgatcggcaactaacgttaataattttatcgttaattaattcgggactttcagcaatactgggcagttacttttcaaataaaattattgcaatgtttataagcgcaataattattactgctatctatttcttgatatttaatatatacaacaaatgttcacaaaaacttgctgacatatttaatgtgaatatttacgataatatgggtacaatggaacattcgttatcccaaaatttcaaaaataaacaacaactattaatttcctttgatttcgataataagtacattgtttctggtcaagtgaagaatgttgatgatcaaggaaatcaacaagtagaactgtatggaaaaaatgaacgtatatataccatagaagaagcccgctcactatacgaagaaaatgatttaaattctattattgtagattacaaaaatagaattaaatcttatgtgattattttttagttttgggtttaggagttggagccggctttacagaagttgttgttttaggcttagcaatgcttctattttcataatttggtgtgtcttgtgtacgcaatactctagtttctttgttactcataatcattacctccataacattctattaaggaatgttttttgttttctacacacatactttatttgtatttttccattaaagattggaaatatgacgacttacatattaatttccagcattttgcataccgttaaggtaagcgttcatcgtatcttggcctttttggtacatgctatcttcaaggtcttgttgtgcttcgcccggttttccatatttatcatcatcattgttagattgattcatccgggaaacttgcttttctaattctgcttcttcctttggggtatcagtctgactgtttggatcattatattgagaatacttaccagcaccaacactcaccatatcgctatccttgggttcagatgtgctattgctactagttgaagtagactgtgtcgaagaagtttcgggactttcagaatttgcagaagaactagtgttggcaagcgcttctttaattttgaaagtcttagtccccaactctttaccgccaacaccttgtgtagccttaagcgttactggtgttttattatcgtcgagttcgtaggctacagcgttttcaacggtgccattctttttaatattttcttgttgggtatcaaggaatttttgatcggggagggagccaacatttaatttattttcacgatttttattgttgtcttggtaggcttcaaaagttgccatccaagcggtattaggatcgatctctttgttagttaaattagtagcttcgtaccagattgcgagcaccggctttttaccatattcgtttccctcttcaccgactggaataaccttagactttgttatctttatttttaaatcatgtatttttagttcatcatttttaaagtagtatttttccatcttaggtttagcaacagttacggttttgttactagagctatctttttttgtattactgttaccgcaagcacctaaaacaagtgatgatatgaatactactcccaatgttagtgatttcttcattctgatttcctccaaaaaaattagtggttcgttatctagtaagtttttaacgctatttaagaattaatttatttccccaaataaatagtggcagaagttacattcccggaagagttggtagattcatcaatatggtaatattgcttttctttttttgaataataagtgtttcctgaacgataagccaaatcgttagcagtgtgttccttatagcttgctaacgctcctttatgagaaatagcttttccaccggcactgaaaggtattttaattgcaatgatttttccattgtcattagtggtaaaacgggcaccagaatcatcttcccagaagccgtaatcgcccttatctagatacttcttttcaatttttgtgccgactttatttgcattaacggaatcatcacggcaggcagacaatgttaataacgctagtaatgtagtagatataacaactatttttttcattcagtatctccaaatatgtgaagtttaaaaaatattattttagtccgttgatttctaaacgatttttataggcaatatttcctaaaaatttgtatagcgggctaaagtcaaaagattttggaaattcaaatttgacttggcgttgttcttcattgaatgacgtacgatggacattagctaaatatgtaattacaatttcagaatcatcaataccgaagcctgctgtttctgcttccacatcaatgatgctcataaagtaaattgatttaaatgctgcttttttcccagttacattttgtctatccataaagatgatcctaatgttagtaaaagcaatcatatcacgtacaagcttatagccactttttatttcttcactatcgagtaagtaggtgccgaattgattgtttaattcctcatcagttacttggctcatatttcccatcaacccgtttaatagttccattttatatctcctccaatatgtacaaaatttatagacattagatttttggtcttgttctaaattgtacaattatttacgttataaggctcgctgatatattctttaaaacccgacttaacagcttcttttgcacgcatcgggatgctaaagctatccataaaatcgataacattatcccattgaaatccatgtaaatcacagtattctagtaggatccttgtagcacgtttattggcgttaaattcttctttcgagtagaaagcaggtgccgcgaaattattagaacccgaatcaccattaagtacatggctaatttcatgtgcgaattgaaagggaatctcttgtttattgggccaattgttattcataaacaccatccgcaacgcagtaatagaccttggggatctatcaggatcgtgtttcgaactgaattcatatccgattttgttttcaaatgcgtaatcgcataagtatttcattaaatcttccgtaaaatcatccataacaaaacctactttttcttattatctaagtatgccttaataattccacgcatcacttcgcgctcttcatcagtaattggttgaccttggtaactacgcatggagttaagcgcttcttcaacttccaaatcgcgtgtttcttttttgggggtttcgatatctgttttaccgagtaagtagtcaactgatacatctaaaactttagcaacagcttgtaaattgttaaaactaggttctttggttttccaagagtatatagtatttgtacccaaatgagctttttcgttaacttgagtgagactatatcccctcttttttgaaatttttttgatacgctctaatactgtcataataagacttctcctaatttttgacgaatcaaattagactaagtatcaaaaataggttgactatttttagactaagacttattattaattcatcaagtaattaagcaataaaaaacaagcctatctacaaacaataactttggcgaggaattgtaaagaaggttatgtattgcttatttagtatgcctttatattagactaagtctaattgtaagtcaataacttgatgaataaaaaacaaaaaggaggggtaaaaaatgacggaagaagcaactttagaaaatcaagctttagaactccagctaaaaattgaagttgctcgtaagcgtaaggggatgacgcaggaacagttaactgctgccattggtgagaagtggccatcagtggtaagccgagctatccgaggtgaccaatcaccaaagtctaaacgtgtacgagaaaagatttataaagtgctagggctttaaggaggaaataaaaatgaacgaattagtaattatgaaaggccaacaagcagtaacaaccagcttacaggtagcagaagtgtttggaaagaatcacaaacacgttttagatgctattcaaaacaaaattgactcagccgaaaattcggctcagtacgattctatgtttgctcagggcgaatacaaagataagagcggtaaacgaaacaagatgtactacatgaatcgtgacggatttacattcattgcttttgggttcaccggtaagaaggcagacgaattcaaactgaagtacattgaagcttttaacaagatggaagaaaccattaaggaacatcggactgaattaccaactgatccaatggaagtgcttcgcttagttttcaatgcgacagaaaacaccaataaaaaagtagaccgaatcgacagcgacgttgattacttaaagaataatcagcgactagatccaacggaatatgggtacatttcgcgaagagtttcggagaaggtcaacgaatatatcaagattcacggactggcattaacagctgcgcaacgtagcaagttgttcaaagacatcaacagaggacttaacgaagtaactggaattaagacgcggtcgcaattacgtcagaaagactttgagaaagccaatgaattcatcaataactggcaaccatctaccgcaacaatccagatcattaaagagatgagcaaggttccagctggtcaaacaacgttaggagagtagtcatgaaagaatctgaaaatgtaaaagaagcattagcataagcgattgaaattgcagaaggtgaagaactaaaaatcaagattggtaaaaacaaatatcgaacagcaaccgctgaagatgtacaagaccttatcaaagaacgtctttacgaaatcgccgacttcctaggtatggaagatctttattaaagaaggaggcttaaccaatgcctttagacacgatgtttcagtctatttccaacgagctagttaatgaagttttggaaaaattaagaaatgaatcaatcgaaaagattgaagacggaataaacccgatgatcagcaaacatgggctagctaaagagcttcgcaaaagtgataaatgggtaaaagactatatcatcgaaaatccaagatactctaccgaaatccaatccatgattgatgcaggtctaatccagatgaagggctatggagaaaagacgcgggtaatgattaatcgaaaagccattaaagattttttgaacaaacattcggcagaattgccatggttggagggtaaataatgagaattttaatagcaatgatcgtaatcgcagggatgttttacttgtttggacgttatggtattaactcttttttcgaataaaaaagcccgctactggcatagcggaccgagaaaaatatttttacacaaggaagtataacacaaatgaataatcaacagttcgaacaaatagaacgagtttttgaaaaagaacgagaaaacaaagaaacagaagctttatttgaagggagcaaacatgatgaaaattgatgaattagaagctaaacgtagtgagctcgatcgtaaattgcgcaaacttaaacatgataaagaaggcatcaacattaagattgacgaacttcgcgaccagattagtgaggtagaacaagaggagctcaaactatttcaagggcgtgaattgcagaccgctacttggcgctatgttcgaaccgaaagcaatcctagcaagccaacgtggtggagggttactaaagcggacgacattaagcctaataaaatggttgaaattttgtctggagtagatgattcactcatcaagagagagccaaacctgacggctgttaagcgcttggttgccgatgggcgttttgtgccaactaaaacggggcaactcgtcgacacagaaaccggagttttactgccttatttggctgaacaaaagcccgacagattaacagtaaaggcggtggattaaatggcaacgactaaagcagaaccaaaagaagaggttaaacctaagacaccgacaaagaaagcaaaacctaaaacgctgtaccaaaaactacagacaatccatgctagtgcgaagtacgttcagaaatcgcaacgatcaacacagtacacctatgccggttcatcggacgtcttaggacagatccacgaattaatggaccaagaaggcgtgctactgatacctcgaatcacgggcaagaatgtaatgactagctcaaacaagaaaggtgcagtggtttactttaccgagctaattatgaccatgacgtgggtcaacagcgacaaccccgaagaaacaattgaatgcccatggtatgcgcaaggtgttgataccgccggtgaaaagggtgttggcaaggcactgacatacggtgaaaagtacttcttgctcaagtttttcaacatcgccaccgacgatatggacccggattcatttcaaaaaaatgttgaaagcaaaaaacaacctgacccagtttctagcgagcagaacgaaacgctaacggcattattcaagacaatggcgactgccactggtaagccagagaccgtagttaaatcggcgtatctaagtaaggcgcacgttgcccatatcaatgacttaaattacgagacagctaaccagatgattgtgctcgtaactaagcaactggaccacgtcagcaaaacacaggaggggcaccatgaatgaaaactatgaactaggttatgaaaacggacagattgcaatgctagatgcgttaaatcagaaattaactaatattagcgaaccgttatacagacggcttttaaaagatgggaagctagattcagcaggcaacgcacaattagatgtgcttaatagcattcgtgattggcaaatagaaaggatcgaggaactccatgattaatcgaacagtactaataggacgcctaactaaagatgttgaacttcgccacacgactaaaggcgatgcggtagctagttttaccgtggcagttaaccgacagtttaccaactcacagggtgaacgtgaagcggatttcatcaactgtgtaatgtggcgtaaggcggcggaaaactttgctaagtatacacaaaaaggttcgttggtaggcattgacggtcggattcagacccgttcgtatgagaatcaacaagggcaacgagtttatgttaccgaaattgtggcggagaacttctcactgctagattcgaaaccaaaaggcaaccagcaaaataacgcacggcaatctacaacgccaggagatccgttcgctaatggcggacagtcaattgatattggtgacgatagtttgcctttctaaggtgatgtaaatgcagagagcaagagcggaacaacgaggtagagacctagttattcatttagacaaaccgcttaaccaagaccatttagagacagtcagtggcagtcaaggcgagttctacgttgattttgaagtggcagacccaagaaaagtaagagtacaacaacgacgactgttcttcgcgttgctccatgatattgaaacgtattttgtggtgccagctgaatttctgaaatcgatgttctatacgcagtacgagttttataccgctggtaagtctatcagcttatcagaccacacagaatcgtctgtgagtgatgctaatcagttgctagacctagttatcgatttcatgttcgaatggcgagtgccgtttaagaaaggctatgagctacttccacgcgaagagcagtatttcatttatcaatgctgtagacatcgggtctgtctgatttgtggggaacacgctgatattcaccacgtcgacgtggtcgggcgaacgaatcgaaacaagattgaccattcaaaacggcatgtactgccactatgcagagtgcatcatggtgaaattgaaagtattacaccagctaagtttgccgctaagtatcacgtgcccgttgatggcatcaagttaagtattgaagatttaaaacgattaggaattaaaggagattacgggggtgagcaaaatgaacaatttactgattagtgagccaccactgcaagtattaccgtcattagcaaaaatagtcggactaaacgaagctatcgttttacaacaatttcactactggttggaaagatctaataatatccgagacggttataaatggatttataacagttattccaagtggaatgagcagtttccattttggagtaatgcaacgcttcgcagaacaatcaatagtttggaaaaacaaggattttttataacagcaaactacaataaagctggttttgacaaaacgaagtggtatcgaattgactacgaacgagtgagcaatgcatctgctcaaaatgagcaaacgagttgctcaaaatgcgcaagtgcatctgctcaaaatgagcaaaccaataccaatagactaccagagactactacagagactaacaataatacgtcggacaataagtccgaccatatccaatacaaacaaataatcgactacctaaatgaaaaagctggtaagcactttagaaacgtcgaatcaaacaagaaactgattcgtgctagatggcatgagggttatagactggacgattttaagaaggtaattgacaacaaggtactagacgcaaacgatgctaactcattttttacggataagtacttacagccaagtactttgtttggaaacaagttcgatcagtatttaaatcaacaaattaaaccaaaggtagagaaagggacacaatcttatggcggggttgaattttgagttactaaagcatgtgaagaaaacaagtgaatactgccaaatccatccagaacaacaactactaggactagctaaacatgaacccttctgtcctagatgcgttgaggagaatcgtaggcacaaaaataatgagctagtcacgataggcgctatgcggaactacaagcgtggctttcatgatgtgttacgaaaagattcgattattgatgatgaggacttgtggcaagcgagctttgataactatgaagtcgatgctggtagtgaagcggagagcaacttaaaaaaagctaagcaaatcgcatacaggtacatggatcgtagctaccaagccaacacaatcattacgggtaagccgggggttggtaagtcacacttagcaatctccatgcttaagggcgtcaatgagaacatcaagcctaacgcttcctgcttgttcatctcgataaacgagatgatgcgaaagattaaggattcgttcgaacacagagacagctattacaccgaatctcgcatggtggacttgcttggtaaggttagcttgcttgtattggacgatttgggcagtgaggcgtcgtttaagcgcgaatcaagagaagcgagtgaatatgtacagcaagtgcttttcggtgtcttaaacaagcggagccggacaattatcactactaatttgagtagtaaggaactatcggaaatatataacccaaaattattaagtcggatgtacaagggtgtcgttaagaataacgcgattatcaaatttgaaaaaacggaagataaaaggatggcgattttctaatgtgtcaactatgtgagggtacgcaagttatttaccaaacgaatggagcaattatgcaggtaaagccctgcccaaattgcaatgtagaataccgaaaagcaaaggagcgtgaagctaatgtggcaattggtcggggttaatagcaaggaagtatacggggaaagcaagcataagtcggacctgcacaagtggatgattaatacctacacaaaatatgacggtgaccgcaaggacagcatttatatggatatgccggaaccgatgcgctatgtaagggttggcacggctgttaagcaatccgatgttgaacaggaattattagaccgtggcgactacgaaggtttccgtaaagctcgtggattgagcatctcaaaaattaaaaagcgtaaatatattggtgaggttagcgtgatgaagcacaagatgaaggttgcccggcagagcctacttccagaaatgcttgacacaagccttagttatgctgacattgcatggcagctaggtgtagaggttcaaacgatttattcagacctaagggaactcggaattgaaatcgacaaaagtaaaagcaaaaagacgccgaaaagatggactaaaaaagaagatgcgtttctgattgccgaaagaagcaagggtgcaacgtttgatgaaattgccgaaaaattaggcatggtaagctataacgttgccagtcattggtacaaggtatgcaaaaagaaggtgtcctcaagtgatcaagttaataattgacggcgagccagtagccgctagtagaccaagggtgacgcggaaaggctgggcgtacattgccccgaaatataaagcctataaagatagagctcacttaattgttaaaaatcagtataaaggcgaaccattgatgggcgcgttgaaagttaagactacgttttatcgttccgttcagaaaagtgtgacaaaagccgaacgtaacagaaggctctctaacgagcatagacccatctttaagcctgacatagataatctatttaaagcagtcacagacgcgtgcacaggcgttgtctggcacgatgacaaccagatagtgagcgttgagatggaaaaaatgtatgccgaagagcctagagttgaaatggaggttgaagagttatgacggcagaggaaattgttagagaaatctacggcaacaattacacgattgatgatttaaaacgtattgaaaaagcagttacagaagaacaagaatgttggcgaaaaaagcaatttaaaaaggagattgaaaaaaaatgtatgtaattaagaacacggcaactaacacttattatcgtaggctaggaaaccaagtccaccaatatgtgggtattgaagatgccacagtattcagaaaatggaagcaagcaaaacagaaggcggacattttacatgctgcgattagcccgatcggtgagcaggtcaacttcgaagtgaagcaacacaatttttatgtgctgaaaaacaagcatgataaaggttatatgaatcaaatctcatggacagcaccgaaagaagaagctaaactgtttgctgaaaaagaagcagcgctgaaggaagccgaagaaattgcgattggcatggcgaaggtaggcattgatgtggaatttgaaccggaggaagtctaattatgttcatgctgtggtatttctcatgcgttttttggctattgccagcagtgttaatcgggcatgtgttgcatagtggattgattggcgtagcaatctttatagcggcgattattttacagacgtggattagcgggatcacttatctgattagggggataaaaaaatgattatcaaaattaacgaagattaccagattaaaatcgagagccacaacaatcacaccttgatgaagttcatcagagatgattctggagcgattaagttagacaaggacaatttacctgtcatgaagcaacttggtttctatccgagtgtcaggcacgctctcaacgccgctattcatttgatggttcgtgacaataatgatgtgatggaattgtcgcaatacctagacgaattagatcggttggaagagcaatttaaaccagtattaaagagatttaaggagggcgattaatagtggatattgaagaagttaaagaagaatctaagtatcgaattaagttgccagggttagcaggaagaaatgggcaacaatatattagtaaatcagcagacggtaaattatttgcttgcgcacgacgtgactacttgcaacaagaatttaccaacgatgaattaaaacaacttccagattgggtacgacggcttaaacttgagcaggtagaaggctaatggattgggaaacagaaatgcagagattacaggatgaacaggcaaagttaatgaacgagtttgaaatagtattgcctaacattaaccggcatagtgatgattacgcaaaagaattaaggcaaataacagaaaaattgattagtaataacgtaagcataaatgcaatgtaccgttaatttacaaccagcagaaaacctgtagaaaaacggaggaatagtaaatgactgaaataaatccgattacaaaattaaatgaattttcaaaatacgaaattcctaaaagtcgtgcaactgtggggttacaaaataaatatagatttcctaatgattatggtgcaagcctgatatacgctccgggtagttatggtttggaattagctgtgttaaattttagtgctaacccagagggcgatctagaatacaatacaccaattactaacgatgtacttggctatttgacctgggaacaagctgtggaagccctaattaaaattaaagaactaccaagcaataaaatggaggaacaaaaatgaaatatgaatatgaaaataagaatgaattaagagaaatcagcacagaaatagctatattagtgatgaaatttaacgtggctttttcaaataatgattcaaagatgcaagaagaggctctccacgatcttaaaaatattgaaaaacgggttggagattttaaaccaattatcaaaattaatgtggaggattagtaagttgaaacagctattgattaatttgttgtcttggattgaattcaaattaattctaattgaggaaaagctgaatggtaagcgaatcattatagctagacaatttaacgacacgtacgaagattgtaaaaaatataaaattgtcgtccacgatttgagcgaagattacgggattggcccccacgtcattaaatatgaatttgacggatattctaaaggtgatggcacatcgattcctagtgaaatagaagatggagactggattattaaggacaacaaaggaaacatgtatgcaattcagcagcatgaactggatccgtattaattgggtggtagtaatgttaaaaacttaccgaaaaactagtggaaatgacggaactattgttaaagccgagcaattaaatttaaacgaaaaagttgaggaaactttaaagaagtacccggaacttgaattcggagtggttgacgtcaagccttatccagatggcccatttgaggtgttgggtttctacttaggaaatgaagtggtaactaagagcacttggtttgtaacagatataaaaggtaaacattggctagttaacgatgaagaatttaaaaataattataagaaggtgttgtaatgattaaagaatatcgcaaaacggcgactattaaggctgaacggttcggcggtggacatgagcaagttaagaagtatggtatccaggataaggcaactctgggagaggtatatagcggaaaccggtggacaattctgaccaaggaaggtcccatgattgttaatgttggagattggattgctacaaatgatgacggtttacgttgggtaattaatgatgattggttcagaagtgagtatgaagaggtggaatcttaatgttaaatagttatgaccaaggctatcatagtggatttattaacgctttagacgaagtcattgataatatctgggcggatttgcaatacatgcaaaataatgaagacattgaaaacgattggtattgtcgaggacagttcgaagctggtcaacaaattatcactaagttaaaaaggattcgggatttaaaatctggttcgatgaatgataacgatgaagaggtggaataatgtttgaaaaattaaaaagaaagctttctggtgaatctacgaatgagggacaaacgtataagtatatttataactacaattatacttttaccactaactgtagctgtggttgtgagccagacattgagcaggctgaaaaactggtggatatggccaagcggaatgctgaaaaggagaaatgaagaaaggaggttcaatcatgacggtatatgtactttgttggcaggaatatgatgaagtgcaaattatgggtgtgtattccaaccgaaagaaagcggaagacgcgatttgcgacgacgaaatcgatgatagaggatatgaatggtttggctatcacattgaagaacatatattagattgttagcggaggaaaaatagatgtggtttgaagtcgcagtaacagtgtttctgttcattatgatgtgtctgttgggtgatatatcgcgcaccgctaaaatggtactaatccatatagtaatacgcgaccaagctattatgacaccgcaagaacgcaagaaaatgaagaatttgcggaaactatggaaaaagcttaacgataaataaatggtaacaaaaaagagcactccgtagacgtgccctcgatctaataatctcaacaacattattataacaggagtgacggggcatgacattattaccagagctagatgatgaaaagacaattcaaaatgttagattgtttttcgaaaaagactttgaaaaacttcaacgaatggcgcatattgcctacgttgatataggttcgcctgtaattagcggaatgcctgctacgcatagctccgataatgctaacgaatctaaatcaacgttgcatgtttatgctaaagacatgctagaaaaggtgaaaaaagcgtgttgtggcatggatcgcttgcaccgtgagttcatggagtatagatattttaaacgattaaaatggtatgaaatagaagctatcactggttatcatcgtagccggggcaacgagatattgaacgaagcatgcctacaatttgcgtgggcgtttgcggataccgaagattttagagtattcaaaattggacactctccggacaaaggggcgacactctccggacacgataggtgatatattggtagcgtggaaaagggtagatggttagcggattccgtttcaacaagttcattttaggaaatacgtgtacatccgtctggggttcgattcctcagtaccctgtttaacaatttgaacattctgtacaggttgtctttggtataatcatcctttaaggggtgattagtatgtttctgggattggaaataggttcatgggcggaatgggtcggagcttttggcacaatgctaacggtttggttatcaataagcttttatggcaaagataacagagtgagatttttggttagacaaacttcccatgttttaacgaaaaataaaaatggctcaatcgcatcccatgaaggtgtaacactgtccggatttaatgatagttcacaaacagcattgtttgcatttagtggattttatttacaaccatgtagattgctgcgaatatggcttcggttgctaaacggattgatagcttctcgaaggatgaatagatggctttataaattagttgatcttcgtggaaaagctagaccgcttggcgatataaacattaaaaatttactttttggaaatgattttgaaactgtagaaggacatagtcgaacaacagacgtcaaaataccccttgagtatcttttaaataacgtagtaaatatgctgaggcaagataaatataatttaaaaaggctaaaaaagggcaagaaagttattatagtttacgtctttcaaaaacacgatgggactgaataccattcaaggatggtaatagatgcagaattggtaaagaaaattaaagaaaagctatagggtaacaagtcttgatgattaatctcattaaggctttttattttgcttaaaggaggtgtggtgacatgtaatggtagacaaaagtagacaaaatgaagcgtttgattcattagacgaaagacatagaaaagctgttatattgctatttgaagatgaactaactgacgaacaaattgcaaagtctgtcaaccgatccagagcaacgctaagtaagtggaagaaggatccattgttccaacaagcacaacaagaatatcgcagaattgcgcttgattcttatgtgccggatgcaattaaacatcttaatgaattggcgctaaattctaagtcggatatggtccagttacaagccacacagacaatccttaatatggcaggatacgggactgttaatagcaacgttgaactggataaagctaaagttcgtaaggctaatgcggaagctgatatagccgaagcacgggctaaggaacttgaaccagaatctggcgcagacgacaacgatggttttattagggctttgaagaacagtgctagaaacgtttggggtgatgataatgaagcttaaaactaacgtgttccacttcactcccttctccaaaaagcaattgcaagtgttgacctggtgggtcaatcctagcaccaaggataacgaagccataatttgtgatggttcggttcgtgcgggtaagacggtcattatgtcgttgtcttacgtaatgtgggcaatgcatacgtttgacgggcaacagctaggcatggcgggcaaaaccattggttcgtttaggcgtaacgtactacgtccattaaaacagatgttggcaggtagaggctacaaagtaattgatcaccgaaccgacaacatgtttgaagttgtcaagaacggtaaggccaattacttttttattttcggtggcaaagacgaagctagtcaagacctggtacaagggttgactgctgcaggtttcttttttgacgaagtggcattgatgccacaatcatttgttaaccaagcaacggctcgtgtgtctgtgtctggtggtaagtattggtttaacatgaacccggaaggtccctatcactggtttaaactgaattggattgatgacttaaaaggtaagcgggcgttgcggatccattttagaatggaagacaatccctcacttagtgaggatgttatcgatcgttacaagcgtaactactctggtgtgttctaccaacgctatatcttaggcttatgggtaatgtccgagggcgttatctacgacaactttaatcgtgatacgatggttattgataagctgccagaacggtgtactaaatactatgtatcaattgattacggcacccagaaccctacggtattcttgctgtggggcttttttgatggcgtgtggtattgcttgaaagagtactactatgacggacgacacagctcgcgacagaagaccgatgaccagtatgccgatgacctggataattttgttggtgagttaaatgcaaaaatcatcattgacccttcagcagcttcatttattgccgtgttaagaagcaggcattaccgcattattcgtgctgataacgacgtgctaaacgggatacgtgagacgcaatcagcgatgaacaacggtctgattaagtttgcaccgaatttaaagaacgtgtttaaagaactctcatcgtatgtgtgggacgagaaggcatcgaaccgcggtgaagataaggtagtcaaggaacacgaccacgccatggacgcaatgcggtatttcgtttacatggtaatcagacgcaaagaagttaaagtaatcagaaacaattacatttaggaggtgatcgcaattcaaagcttaagtgaagatgtgtatgtgacagacaacaattcattggtgtatccagccgacaaagagctaactggtgaagccgttgagagctttatcattcagcatatgtacattgctaaccattataaggagctacgcaaagagtacatcggagaccacgacattctgcataaggatacacaccgtggcaatcgaccggacaatcggttagttggtaatatggcgcactatattgttgaaacattcaatggctttttcatcggtaatcccccaaagattacattggatgatgaaactgacaacgcgaaattgaagcaatggaatgacactaactcgctacaagacaagctatcagagattagccgtcaggtagacatatatggtcgttcgattgcttttttgtatcagaatgaggatagcgaaacgtgtgttcagtatgccagcccgatttcagcgttcattatctacgatgacacggtcgatatgaacccgctcgcattcgtcaactactattacatcaacaatgaactgcacggcacagttatcaccgacgaagctatctatgacctaacggattcattcaagatgaaagacggcgaggttaatccttacaaggcagtacctgcagttgagttcttccagaatgaagaacggcagggcattattgataacgttgagacgctaatcaatgcacttgacgacacgctaagccagaaagctaatcagaacgaatactttgacaatacctacatgtattcgttcggtgctcaattaccagaagatgagaatggtaatcctgttgttaatcttgacggtaaccagattatctattcaccggacgccagttcagtagatgctaagattggcttccttgacaagcccgatggagaccagatgcaagagaatttgctagatcgcttaactaatatgatttaccaggtaagtatggtagctaatatgaacgacgaggcatttgccggcaacagttccggagtggctctggaatacaagctattgccaatgaagaaccttgccatgaataaagagcgaaagtttactcagtcattgcgtaaactctacaagatcttattcagtgctggcactgtacttcaaaagagcaaagctgacgagtggcagaaccttagctttcaatttaaccgcaatctaccagttaacatggcggacgcggctaatacagcgaagtcgcttgagggcattgttagcaaggagacgcagctctctacattaccgttcgttgatgatgctaaggacgagattacacggatacagaaagaacaagcggagaacattaggaactcgctggacgtaaccggtaacctaaccgatcaacagaaagctggtatgaacaatgagccagaagcaactgaacaagaagaataggcagtactggaagaagcgcgaggcagaggaacgcaagtggattcaaggtaatatcaaaaccgataaggacttcgacagtctcatccaggaacattatgacactctgctagatagcattaacaaggacatcagcgagcagtacacacgttacgcaaaacgagaagggtacacgcttgccgaagctcgtaaaaaggtggctcaagaagacgtccaagcattttctaaccaagccaaaaagctggtagcaaaggcgagagatatcttcaaaaagaaaggcaaagtagaatatgccgacttttcagacgaagttaacacacgcttgcgcctatacaatgccacgatgcgtatcaatcggctagaaatgttaaaagcccagataggcttagaaatgattgataacaatatggatatatacagctcaatgactgaccgactcaacaatgagtatgttgaagaattaaaacgacaggctggtatcttatccgattcagctggagcagttaaagcggctgaaacgtctagcattgtaatggcgtctacgggcaatgctaattttagcgaacgattatgggctaatagcgacgtttttaaagctaagcttgaccaattgctaaccaaacagatggtgcagggattgaatccgagggtgattgcacgagatttgaagccttatcttaaagatgaggttaacaatgctagatatgtaactgaacgtttagcacgtacagaatccgctagagttgcagcaaccgctcaattaaagagttttacaaagtatggatataaatatgtcaagtggattgcagagccgtcagcttgcaagatatgccttgagatagcatcccataacgacggcgtttattcggtcgatgatgttccagatttacctgtgcatcccaattgtagatgcagcatttcggcttggcatgacaaaactaatagcgatgactaattacggttaccgctatttttatgctctttttcctgtttgcagagctaaaagaacaactgagtagcctcccaaggctttaaatgcgagcaaaaggagaaatcgttatgaaactagaagaaaaattaccaatgaacttacaattcttcgctgaacaatcagacgatggcggcaatgctactaatgataatcttgatcctaatgcagacaccgatgctagctcggaagatgcacaaggacaacaagaggaaaacgaagaagaaaatggcaaaaatgagaatatcgatggcgacaaaaccgttgataagctcaagaagcgtctagattctaaaacagctgaaaaccatgacttgaagcagaagtacgatgaacaatctcaattgcttgatgatttgaagtccggacgcaaatcaatcaaggagcttttttctgatgacaaaaagtcaaaggaagaaactgaaaaagataatgagattgctaagttaaaggctgaaatcgcccgtactaaagctatcaatgaaactaatgcagtctttaaagaccaaggcttagtagtgagtgatgacgtccttaacatggttgtaggcaatggtactgataatgacgctatttacgaaaacgtaaaggcgttgacaggcttgattaataacattaaggaagatactagaaaagagtttatgaaaggatcgacaccacgaatcagtggcaagaaatcagctaaggtttcgacaaaagattttgatcaaatgacattggctgaaaaggttcaactccttgcaaacgatcccgacaagtttaataaattaacaggaggaattaaataatggcagatacagccccaacaaaaattgcagatttaacaaacccagaggtattagcaccgattgtgtcctatgaattacagaaggcacttcgtttttcaccattagcaaatgtagatactactttacaaggtcaaccagggacaacattgaagtttcctaagtttacctacatcggcgatgcacaagatattggtgaaggcgaagctattccacttgataaattagggacagaaacgcaagaagcgaccattaagaaggctgctaaagggacttctattactgatgaagcagtactttcaggatatggagacccgcttggtgaatctactcgtcaattaggcttatcgcttgccaataaggttgatgacgacgtattggaagctgctaagacagcaactcaaacaatcacgttcgatccaacagttgatggcattcaagccgcgcttgatatctttgatgatgaagatgacaaggtagtagtggcaattatgagccctaaggatgcagctaaggttcgtaaagatgctatgacacaaaagcttggttcagaagtgggcgccaaccaattaatcaacggcacatatcttgacgtattgggtgttcaaattgtgcgttctaaaaagttaaaagaaggcgaagcagtatttatcaaggtagatccaactaagccagctctcaagttaatcatgaagcgtggtgtgcaagttgaaactgaccgagacattactcgtaagacaaccatcatgacagctgatgaacattacacagcttacgtttactacgataaaaaccttatctactcggccccaaaagcgtaaacccacctgctagtgggattaccgctagtcaaaaaacgttgtccgagaaggtgggggacgctaaagatattaccatcactagtgatccaacagatgcgaatgatgctgacgccgtagttaaggctacaactgccacatcaagtgacgaaaccgtagcaactgtttctaagaagagtaatggaacatttaccgttactggcgttaaggctggaacagcaactatcacgttcactagcggcaaattgaccacaacattagcggtaacaatcactgacgccgcctaggaggttgtcaaatggctgaaacagaagatttgaagaatcttaaaaagctactgatgctgaagaaagacgatgttagcaaagatgaattactacagttaatccttgataatacgtcggcatcattaaaaattaagctccataggaaagcaagcgagactgtccccgatgaactcaactacatcttgttagaagtggctgtacggcgtttcaatcgccttaaaaatgaaggaatggctaactattcccaagaaggtgaatcaatcacatttaacagtgatgatttcgacgatttcaaagatgacatcgtcgattggttagctgatcaagaagataagcctacatcgttaggtaaggttagcttcatttcaggctatcaagggaagtgatgagatgcgattcacggacagagttcaattctacaaatcaaatgaccattacgatccaagtaatcctagcggagagccagttatggttggtgaagtaattgctaacgtcacacatctaggcgttgaccgctcacaacaattatttggcgacatcggcgtagataggttggtcgtccgtttggtagagccgtttaacagcaactgggacttgttgactgtcaatgatggagaaacgtactacaagctccagacaggagtacatccgcttaagataatgggttatatcgtgggggaaacgcagaatgagtaactataatttttcagtcaaaggtcaagaccttttaattagaaaattgaagcaaaaagctcaaaaaggtgcagttaaagctattgttaaatcccatactgcaaacatggagagcaaagctcaagaattggcgccagttgatacgggtaatctaaaacgtggcattagttcgcaattgctaaaaggcggaatggcaggagcagttatttcttctgcagaatactcaggataccaagaatttggtactcgttttatggctgctcaaccatacatgggtccggcttggcgaaaggaacggccactatttttaagcgatttgcataatttagtaaggtaggtggttaatatcagaaaatcaccagcacaagacgtctacgatcgctacttcatgctttcccggaaaatgggatacgacacatacgactacttgccacctgacaaggtcaaatatccgttcgtcgtaatgagtagcgtcgaagataacaaaaataacaccaaaacagaattgactggatcaatcgtgctaaccattgattgttggggcataccgaaacagcgtttaaccattacagatatggttgagcgctttttttatgcctctgttggtcatatcaatacagaaaactactcgtattacgggcaagctcaacaacaatcaacccgcactttgattgacaccagcgtacctaattcaaccttattgcatggaattgtaacggttgaactacagattcaatagaaaggaaggaagaataaatgccagaaaccaaaaatgatagcgtgcttaagttctccggtgacgatgttgccggttacgttcgtaagctatccaatgccaaaacggaagcagcgcagttaatccctgggcaaacttcgtttgagattgacttcaagcgagatgccgacacggaagacacaaaagatggaggattccaaactagttcttcgttggaaacggacgtggaaatcgacttcattaataacacttcgaagattgctgaccaactaattgattcgatcatgaacaatgaagtaatggaaatctggggtgttaatcggaaacgtaaaaacaaagatggtaagtactatgcgtggtacatgcgcggagtagtctccgaagatgacaactctaatgatgctggtgataagtctgaacgtgacgtatcgttcgcaatccaaggagtcccacaacggggctggttaacgttgtctgctgaccaacaagctgaattggattatatcttccgtggtctggatcaggtcacagaaggcgatgatggcactgaaagtaacggcggaactccatgggaagatgcggacgctgggacaaacgtaccagacgcatcaccgtcaaaatagaagccccggtgggagtttctagtacacccactaatagcggggctattgtaaacgcactttaaaaaggaggccatattatggcagatagaactaatcaacatttggttatctatgacaagtctggtactaagaaatttgaaggcgaggttggagcaacaacggtcgcaatcacaggactagaagccggtacagctgttgcagaaggtgattatcagattgcttggagcgacggtactaacgaatcggataaggtcgatgtgccagcgttcacagttaatgccgaaactaaaccagaagtagcaaccaatgttacggcttcaccaacagatgatggggcaaaagttacagccgagtaaacaaatttagtcgccaattaaatgaacaatacctacgggggcggcaattaaaggagtaataagacatggaaattacaattggaaagcaaaaacaagaattgaattttggagtacgtttcgtaaatgaacttgataatgtaatcggagttaaacgcgatggaatttcgttgggctttggattgacaaagagtattccagctttacaagcctacgatacagcagtactggctcaagtcctatactgtgcgaccttccctaattcaccacgggcaagcctcgaatcaatctatgattttattgataatccagacactgatattgaaggactattcaaagaagttaacaaagaacttaaaaaggctaacgcagttaagttggcattaaaaaacatgaaagcctagatggcaaacgaaaaagatcaagcgatgaagaatatcgcgaaatcattctattttcgttagcttatctaggctttacttctatccaagaaattgagcgtatgacgatcagcgagtattacttgcgcttagaagcttaccagcttcgtaaagtagaagaacgtaccaatttagcattgcaagccttttttaatcagatggtccaaacacctaagagtaaaagcaatccgcatccgaagtacgaccaactcgataagttatacgacgctgaagctgaaatcagtgagattagacatcaattcgaagggctgccttctaaacgaattgaaaagcaagaacgtagccgcatgattgcggagcgctatgccgcttaccaaaagattaaggaaaggaggaagcagaatggcggaaagttataatgtaacggcgatattaagcgcaattgataaaaattttagtgcaaccatggcaaaggccgctgatcagactgcttccttctcgtctaaggttggcgccgttactagcggggttggtaagtcaatggctgttattggcggggcgaccactgctctaggtgttagctctgttaagtccttcggtgacttccaagcttccctaaataaggcagctgtaactgctggtggaacgtcaaaagacatttcaggattagcggatgttgctaataagatgggtgctgatctgcctttatcagcgcaagattcagcggacgccatgattgagatggctcaagcaggagcggatgtcggacagattaaagagcagttcccagccattgccgaagcatcaactgcggctggttctgatttaatccagaccgcgggggttgtgcagaatgcaatgaacatttggggcgatagcctagaatcgccaaagcaagccgcggcggcattaacattaactgcgaatgcaagtaatgcgtcaatcgaggacatgcaacaagcattagcaacgattggtggtactgcaaaagcgtctgacatgagtttgcagaccacatctacagccattgggttattaactaaccgtggttatagtgcggctcaagcttctcaagatttgaaccatgcgattctgcagatgcaggcgccaagtaagattgctaaggcggctatgcagaatttggggattagctttactgatgcccaaggaaatatgaagccattccctacaatccttcaagaaattagcaagtcaatggacgggatgacatcgtctgaaaagcaaaaaaatcttaaagcaatgtttggtactgccggaatgcaagcaattggaccgttacttgattcaattaatgataaatcaggctctgttaccaagtcgtgggacggcatgtttcaagaaattcaaaacggatcttatagtgccgcggcggcatcaaaaactttaagtacgcaagcatcagaaatgcagaaaaatgttggctctaaaattgagcaaataggcggtaactgggaagctttacgaaacaaggctatggatagcaaaaacggcgttgtcggtgccatgattgacatgatcaataatactattacgtgggcgacaacttctaattcatggattgcgaaagttattcgtggttttgttggactatctccagtcttaggacctgcattagttatttttggaggtttgttaattgcgacagtaaaagtggcatcggcagtcggaaagcttgctaagggcttctactcgataggtaaggcagtagttggcttagtcgctaagctatttggcgtagcaaccggaaacactgctgtaggtgctacttccgaaggtgctgctgttggtgaaaaagcagttggaaagaatgctgaaaaaagtgctggacagatgatcgcaatgggattcgctgcacttgagattgcggcaggattcgcgttggtgattgctagcctggctgtgttggtacttgcgattgcgcaattggctaagcaaggcatggacggcgtggttgccttagtagcgtttggcgcaacagtcgccgtgttggctggtgttttcgctctgctcggaccagtgttgacagctaacgctgtgggattaatcgcgttcggtgctgcggtagtagctgcaggtgccggtgttgcactttttggagccggtatccttgcgatgggagccgggttagtcctagctagcaaaggtgtcacggcactagttaatgcttttatcttgcttggtaacaacattggactagtaatcccaatgatgggagctatcggtgctggcatgagtgcattgttaagcgggatccttaatgcggtaattactaatgtaccattaattggacaagcatttatcacattaggagaaacaatccttaatgtgatcgttaccctgacacctcaaattatccaaactttcatgacgctattaatggcgttaattaatgcaattgtgacgtacgctccgcaaataacagaggcgtttgcacaattgataatcggaatcttgaacacgattaccacatacctaccacaactaattactgcaggttccaatttgatcgttgcgtttttaaatggaattgcgcaaaatctccctaacataataacggcagcagttaatgtaattgttgcttttattaacgggatcgcaaataacttaggcaggattatcgatgcaggtattaatttgctggctaagtttattttaggaatagctaatgcaatgcctaggcttgctagtgtcgctgttcaagctgttgagaaattcgtctatggtgttggtaatgctctaggacaagtacttgcatcaggaaccaagcttattggaattttcgttaaaggtattttggatggactgaccgggtctagaaattctggtactaaaaatgccaacgctgttaaagacggaattagtggcatttcattatttggtgccggtcaatctattattaatggttttctgaatggtatgaaatccgcttatggtgctgtacagagtttcgtaagtggtattgccagctggattaaacagcataaagggccaattagttacgatagacggttattaatccctgctggtaaatctatcatgcttggattcaatgaaggattgatgaagcagttcagcaatgtacagagcaacgttactgcaatggcaggacaggtagctgatagcatgcagtttacgatgccttcgattgatgcttcaaacatgaacaatagtctccgtagagttcagtcactatcatcgaacacctttggtgccaactttagtggcacggttgccttacaggattcgactgtaggacaacaaaacaacttgcttttgagaaaaatagctaacaagcaacaagctatctatcttgacggtgatgccctagttggtaggacttatacacgtacggattcggcactcggtaatcatgctgacttaaacgaaaggtgggggcgctaatgcaatatcggttcagagacttacaacctacgcttagagatacatttaacgatattccagaggaaggctttgcattcggtgattttgatagccgaaaagcagggctttttttagtcgaacgaactgcgcctacgccagaagaaaaagagatcaccgagagtgtgccatacatgcaaggcgtctacgatttttcaatgtatcagaatgaacggttctttgaaaaccgtgaaatcacgtacaagttagttatcccaatcggggtctatcacgatcgaaaaggcgttgagcaagatatcaagcgccaactaatgccattaggacggcaagcgttaattgacacacacgaggaagtctattactggattggtaagtgtaagagtgtggaagctgacgacgattcagagaaaggattattgaacgtcacggtagtattcgattgctatccatttgcgttcactaacaacctcgaaggtgcagacgtttgggatgacgtctatttcgatcactggatttggcaacccgtcaaatttaatgttaacggaaagcaagatatccagttagaaaatataggatcgcataaggtgatgagtaactttgaggtgactggcaaagttactattaaaggctcgtttggcacgaaaaccctcgacgagaagaccgatgaaaagtcgtcgatcccaattcaagtcggagttaacaaaatcatacttgatggcaatggaacaatatggttcaaatttagaagggaggaactgctgtaatgtatagaattattgcttacaatgagccgactgatacagcgggctttgttatccacgatcccgctgttaacgaatcggttagtgaaggcaagctaaatcttaagcagtccgatgttaacgatttatcgctaaccatcaatcaagataaccctctcttcggcaatgtgagaccaatgcacacgcacgttgaggtctacgacgatgataagcttatctttcgggggcgagcgttaaagcctacgcgagagatgaaagattccggacaatttctgcagacctatgtgtttgaagacatttcaagctacctaatcgacagcgttcagcgctttttagaagttagaaacgcaacgcctaagcaatttctggagaaggttattgaggagcacaatactcaagtaccggcttataagcagttcaatctaagaactgtaacggttgataatagcaaggataacgcactccgaacaattgactatgccacaacccaagaaaccattaagaagctactaacggattccgttggtggctttttgattactgaatataaggacggtaagaactacctggattaccttaaggcaccgggcaaggaccataacaacgacacaccaattcgcattaccgaaaacatgcaatcggcaagcgttacgattgacccgtctaaggtaattactagattgattccgctaggtgcacagatcgagacccagaacccggataaaaagaatgatgatagttcggacgatgggactaagttaagcggtccaatgcatgctgttaatggtgactgggggccagcgattaagtttgcggcacaatgtatgaacactaaggtgaccaacgcccaagttgctactatcaaaaatgttattcaacatgagtccggtggtagcgagacagtggttaataactgggattctaacgctgcagctgggcacccaagcaagggactactgcaattcattgacacgacttttaaggcgtacgctatcgaaggctataccgatattctcaaaggcttccaccaactgttggcgatgttcaatgattccaattgggctagtgatgtccatactggtggatgggggcccaccggtaagcgtcgttatgataaattaccagttgaaattgttgctagcggaggtggtaattgggggtctccgttcccttctgtcggacacgtagcattcgaaagcggacaacttttcggcgttcaccctggaggagaattccgacaaaatggcttccatgacggcttagactttgggacggctaagtatcccggcaccgacgtccacgccgtccatggcggtagagtaacgcataagggctacatgggtggattggcatactacttcgtcacccattccgatgatggctacaatgtggtctatcaggaagcattcggcagtagtagcaacatcaaggttaagattggagattacgttaagactggccaagtagtcggcagacggacaaccaatcaccttcatgttggtgtgacaaaaaaggacttcaactacgcagttgcacactcgtttactaataatggtacatggattgacccggagccgttaatttttggatcaaaaaagagaataatgttgcgggctaagcgggtagttgccgattcgccgttagctaagcgggtagttgccgattcgccgttagctaagcaagcacttgacattgaagctggggtaaagctgttcgaagcggcaaagtcttcacatttaaaatatgagaccaactacctccgcgcggacatcttgtctaatcaagcacacggcgattgttcatcgtttgtaagttattttctagagctggcagtacatgaaactgatagaacgctctacacaaccgacacgttgcacggatttttgaaaaaacatggctatgcactgcattacgagggcaacactaagacgctcccagcattgcaaactggcgatgtttttattttgggcaaaaaaggcgacaaaccaagccataccgcagtaatgaaagacgcggatacgttattagagtgcgcgcaaggttggagcaatggttatgaccaaggtggcgccgacatgttcgagcacggtaaatcgggtgatgagaatttagctgcttggtggaaacggaattcacaggggtggaacggtgaatggtactggtatctctatcgtttcggcggaaatattccagaacaagaatcgggtgaccaaaagggtggcacgattaagtctggcgttcgttacaccattgcgccagtcaatgacgggaaagactaccttaatattcctgattttcaaaaagaatttggagtcattaatggtactgtcacgtgggatgacgtcaaggacccgaacgagttgctaagcaaggctaaggcttggattaataatcagaaagcgtcgacgaattcgtggaacatctcggcactagagttgccggactacgatcactttaaagtctacgacaggtatttattcatcaacccgtacgtagctgatacgcagttactgacggttgttagtaaggagattgacattaccaatccgttcaagtccacactaacaattggtgataagacgccgaagttgaccgattaccagaatgaaaaccggaacatttccaaagtagtttctaagctggcaagcacggtgacaactatctctggtgatgtttcggctatgcgtggcggtgcgggtaactctagcagtcaattgcagacaatctacgaccaacttggcaataccaacgtgccacagttgcagaaggatgtagaaggtattcaggattttaaccaaaaagccgatgaacgattgactaacgctgaaacagacctgaaaactgtaaaagaagatgacgaatcaaccaagaaaacgctggatgagtataggcaaacaatcgcaaacttagatgcaagattaagaaggttggaaggagcaaatggataatgactgaagtgtataaagacaatgttgagacgtctagcataccgaataatattgcggaagttgctaagaaaattcgcacaactaaatatggcaaagatatgcgcgaatcaatcgcacaagggttcgaactaatcgacgaacttcttaaaagggaagatttgattaaattcgagactcatttcccagaaatcacaaacaaagccaataaagtatcaagcgtaatcaacgctaattacgatacagacataccagtgttagacacgccagtttttaacgctggatactttgatgtagattttaggcaacaattagttgatgcctacggtaagacgatagacggggtatcggctttaatctcaggcatgaagaaaatgggacttgggaaaacaatttcagacactgaaattagtgtcccgcaaaaaatcgagtttaacagcctagagataacagccgtacggcaatatatatcgcgacaagaagccgaaattaataggagtttagaagtcgttaataatattattgaggaacaaggattggaggattctaatgaaagttaaagcggaagaaaagggacgttatgttgtcatcaacactttgttaagtaccacagacgtgaccgtagttgaccggcttaacggtcgcttaggtgatagtggtagaaaagttttttttgctctgaaagatggaatgaaaaatcatgacctaaccgggcaggatgcttttattcgcgctaaggattccgagggcaagattaaacaagttacgggcattgctgatttgatttctgcatccaaaggattatttagtatgtatattccgcctgaattttaccaagcgacgggtgattttgaagaggcttatttagcgattacggattccagtggagttttaattagttcagtgcccttaacgttcagagtgctagaaaacaatatgattatcacgtctaacggtagtcaagattatatcgatcaaatcgataattttatcgacgaaatgcgcgatagaattgatgacttaagcgattctatcaatgcacagaatagatcgttcctatccttaaaagatgccttagcagtctacacagacttaatcaataagaatgcagtagcaacgttaggcgccgataatcaatttacaggaaataacacttttgaaaaaacaattaacggaacaatcacgtctgctgaaaaagctgacatggcttctgaagcagatacagctaagattgctcacaaaactgatgatgacacgggttggatggacatttccaaaaactttttgccaggagctgcgggtactgcaaaaattagaaaacgcaatggagtggtccaattaattatccaagctgttactggttattacgaaggaaataagcttaacaatggtaaccaattattgaaattgccgtggaagggctccgcggggcctaattatcccggtgaatatagtttcatttacaacggtgcatcagctgctctatcaattatggatgacgtcctaattgtgcattgggtgacgaatccatcaacagacaaaggtatacatttatatgccactttaacttatattgctaatgattagaggaggaagttatgagatttgttaaagttttaaataaaaccctgacgaaggaaaatgatacggcggctacttataggattaatctatatgacgatttagatattactaatttggataacaagacagttgatatttcagtcgcaaatgacgacgggtttattggattgattgtgccagaagtcgataacccgaatgtaattatcgatctaggtaatacagttttaaatggattacccgctggatcttatttcttagaaattaatgtcaaggacgaaaatgggaatgtagctaagtatccaacagctggctatattacgcttgacgtctcaccagacctagttaagaccattgattcgctcgtgccacaggtaacgttagattcaatcctcaaagccgttgatgataaggtagcggaactaaaagctcaaggcttaaagggagataagggtgatccaggtaaagatggtcgtgatggccgcgatggtctggacggcgaagacggtaaggatggccgtaatgggattgatggtaaggacggtaaagatggtgaaaacggcttgacaccgttcttggcttgggctgatagtatggacggttcaaccaatttcagcactacaaattacaatttaacctacgtaggaattgcctattcgactgacgatatgccaccaacagacccacatgcttataattggacacttaatgcagaacccaccgtgttatctaataatgtggttggagcgttcgattatttgttgattcaatccgcagatggcacagtctggcgcgaaattatcgacaacgatggcaatgtaacgtttaataagcaataggaggtgattagatgcaaatgtcacaggattacttctttaatccacacaagccattcgacgagaaggtcggtatctttgctcatcatcacggttcagcagtccagaagacagttactttagacaactacaagagttacattgacaatgaacttgatttagtggaggagatgggttatcaacacattgagacaccctttacccatgtcgatgattacaattctgaatttgttacggttgttcagtacctcgttgataaagcattaaaacgcggaataagcgtgatggtcattgctcagggaattcaaaataatgctttaactgaagctgagattaaggttgattcggaacgctatttgagagtcatgactgaattcgttatccgtaacgctggtaaggggattatctacgagggcattaacgagcctgatagtagtgactggtacggccagaacaacatggagggctaccgcaaagcgattgaatgggataacaaacttaaggcggtaattaagcaatatgacccaaaagccacctttgtggaagctgtattagatcctatctacggtgtgcctttaatcaaagaaggactaattgatagtggtgcttatgcgcgtcattcttataccaaaaatatcggaaccaagggtaacaacgttccagaaaatcagttattaaatccgctagaaacaagcagctacgacggtgataaatttgcgatgaccgagtttggtttcgctgtcgagcacgctggcaatgatcaagagaacaattggcagggactagtttctgaagacgaatcagcagcactaacagttcgacaaatgataatccatgatgctcttggagcaccgatgatgtacaacttcattttgggttacttatatgtatttaagcaataccaatattttgacctgaacaagaacatcacgcctaccgggacggcggttaaaaatgtgctaaaagaattaaagggttactattttgattcatgggtctgggctgatgtaggtgaacatcgaagctttatcgctaaatatattaaagatggcacgactaaatatgcttattggaacgcagacggagttagtgctgatattacggtcggtactaacacgctccatgccactagtgcaccgcaatttacaattgctaatctagaagcatcagtgaacacattagtagtgcagacgccagtggggcttagcacaattgacgtcaagcacctaccagttaaccaatcggtaccactacaattaccatacgtagagggctatcagcataacgaggttaatgctaccttagatggcactggtaagctgactctagagggtgatatcatctaccgaaaagctgatgaatcagggttaaaagtacaggctaagaaactgaatggttctttcaaaaatctaaaattaaagtcaccggatggcagtatctggcaagcgtcaatttcagaggatggaaaactaagctggattaaaaactatggtgaccaattataaacgcctagattataggcgttttttattttgaaaaattaaggggaagaaggtgtaaggttgcatacgctgttgggactgtcttggggggaatgggcatctattacaactgtagttatttttatggcaggcatggttagcctgctttttaagtacgtcgtttttggtccatttcaggaagatataaaagatttaaacaagaattttaagatgcttaataataatctaagcgagttaaggagtgatatcgcaaaactagataaacgagcggacgaacatgaccgaagattagataggcatcatgaacgaattaaggacttgcatgacaaaataatgggaggaagttactaatggaaaaagtaaaaaacatcaattgtcacgatggaaagctatgggcaggattgattagtctaggaattgtgttgattcagcaattcatgatagcctttggctacaattatccaatcgactggcaaaatattgtaggcattattaacacagtattaacaatcctaggaatgctgggagtggttagtgacgttacggctgttgatactgaaggaggtaaggctgacaatgaagctaaaaaataaattaattgctggattggtcgctggagcagcggccttttttgttggactgaatcaacaggtgagcgctgcaacgattaacaatgactatgctttaagcgctagtgaaggctcatcattacgtaccagcaataacgtaattattgcgcacgccactggtacttatgctccagctgtcaacaacgctatttttgaaaaacgtacgtggtatagcaacggtgcgtacgttcaatacatcgttggcgatggtggtaagatttaccgcgtcggcgccgaaggctatcaagcgtggggcgctggtagctgggctaatgcaaatgctccggtgcaaattgaactggcacagacgtatgatcaagctgagttccgtaaggactacgtgacgtacgttaacttactacgttccagcgctatcaaatacggaattccaactactgtagatgattcttcgtggcgtggcgttaagtctcatctctgggttactaataacgtctggggagatcataccgacccttacggctatctagcgagccacggaattagtaagtctcaatttgcccacgatgtaaaatatggaatcgatacaaaggattctgatactgataatacaattaaaccaagtaagcctaccaagccgactgataaaaagcaggtagatgtaacctacgcgcttcatcaaagaggaggcagttggtacccggacgttaagaacttcggatcaggtagcaacggctatgctggggcaccttatcaagcaaacgatttgctttacatcaaggtaaatcacggctcaattaagtatcgggtgcacactatggaagatggctggttaccatggattcacaaagcaaacaagaacgacacagtcaatggtgtagctggtattaagggccacaccatcgacggagttcagatgtactacacaactccaaaaggtgagacctaccagcaagcttactaccgttcacagactacgcaacgtgctaattaccttgccacctgtgccgataatggttctgtggctggttatgatagttgggctggaatgttaggtgaaccactggatcggttgcagattagtattaacgatcatagtaatttttaggattaacaattagccccagatgttgaagacgttggctcatggcaatttaccgacaattggaacggcatgggaattgatatgagttatgacttctttggtttttatactgaatagaattatgtgaagcaaaagccctctagttattgaactagggggctttttttaatgtagtcaaagtactacaatggaattgcaagccaggttcctccaaagaatatcaggcttgccaggaaatcaccagcttagaaataggctgcgtgattttttgtttgtgtaatttattttgatatctgaaaaagacaggtttatatagttaaggggtaaaattcatcgttaatacaaaacaaaaacacgaaattaatattaaagcaaatctagcagcattgcaagcaacatgcatggctaatatattacgattgatgacacgatttactgattcaaaataaaaagccgttcgaaaataatcgaatggcttttttactgtctattttttatggaactacctcagttttatatacaatttttttaaagtataaaaagtgccaaccaaagtgccaaccaaaatcaaaacttagtagataatgatatataatttgtaaaaacgaattataaaagaaatgcctataaatcaacattctggctaaaaatatgcaatagcaaacaactaaggttttctcgccggggacatttacttatggcttgaaacgctaataacaaagggattttggagaaaagtgccaaccaaatgcctttcaagaagcatccaacgatttaaaagttgggtgcttttttgtttacggatcaattacactagaatcgcgggagaaatggtgaatgattcgcataatgacattatcactagatgataagaaatatattaacgatttattaggtgagaaaacgaactttttaaacttgttttgttgataaagttagtgtatattattgcttggtggcgattggccattaatttaatcaattcgaggggaccagaatgaaagtatttgattatgaagacattcaactaattccagctaagtgtgttgttcgcagccgtagtgaatgtgatccaacagttgaattgggaaaacatacgtttaagctaccggtagtgccggctaatatgcagaccattatcaacgaagaaattgcggaaaagttagcggcagatggctatttttacatcatgcaccgttttgaaccagaaactcggttagcttttgtcaaaaaaatgaaggctaaaggattgatttcttctattagtgtgggtgttaaagacggcgaatacgactttattgacgaattagctgctaagaatttagtccctgactacattacgattgacgtggcccatgggcatgcgcaaaccgtaattgatatgattcattacattaaagaaaaattaccagaaagtttcgtgattgctggaaacgtcgggactcctgaaggggttcgtgaactagaaagtgccggcgcggacgcaactaaaattggaattgggccaggaaaggtctgcattactaagctaaagactggctttggaaccggcggctggcagctatcagctttacgctggtgtgcaaaagttgctcgtaagccactgattgccgatggcggaatccggaaccacggggacattgcaaaatcaattcgctttggggcaaccatggtgatgattggttcgttatttgcaggacatatcgaatcaccaggggaaaccaaggtggcagatggtgtcacctataaggaatacttcggtagtgcttctcaataccaaaagggagaggcgaaaaacgtcgaaggaaagaagatttggattcatcaacgcggacatttagcggatacgttgaaggcaatgcgagaagatttgcagtcggcgatttcatatgcgggaggacgcgatttggaatcgattagaaaggtcgactacgtaattgtgaagaattcgatttttaatggggatatattataagagtgcttcctgccccgggtagcttctgaggattaaaaaaatagggcattaatcgcgttttttggcgattgatgccctattttagttaaccggaagaagctaggttccagagcacgtttcggctacgcagcgactcaaaagcccaccaaacagaacaaaaaaacggggccagaatttcagcaatgaaatcctggtcccatttttaaaagaaactaatcagaaattattttttgtcgtcaggggcaacttcaatcttgtcgtccttgatgcgagcaattaattgtttttcacttgggtgatcgaggtagaagtccgcgatccgatcttcaatttgctcttgaatgacccgccgcaatggccgagcacccatcttaggatcgtatccaagttcgacaaggcgttcttccactggtttggtaacgttcacgtgcaagccttgggttgctagcatcttgttaacgtcggcaatcatcaagtccacgatttgcattaggttatccttagtcaacgcgtggaattcaacgatgtcgtcaaaccggttaaggaattcaggcttgaagtagttgccaagtttgtcgagtacggaatgggtcttaccttgcattgccgcaccgaaaccaacgtcggcttcaacgtcgcctgatccagcattagaagtcatgatgatgatcgtatccttgaagctgaccgtccgaccttgtgaatcagtcagacgaccgtcgtcaagaatttgtaagaacatgtgcatcacgtctggatgagctttttctacttcatcaagcaaaatcaagctgtaagggtgccgccgaacttgttcggttaattggccagcttcttcgtagcccacgtaccctggaggcgaaccgatcaatttagatattgaatgtggctccatatattcactcatgtcaaaacgaatcatggcatctttggaaccaaagagttgatcagctaattgtttagccaattcagtcttaccaactccggtaggaccaacgaagaggaacgaaccgattggccgtccggttccgttaagtccgatccggtttcgccgaattgctcgagaaatcttatcaactgcttcgtcttgaccaataacatgcgcttttaggttgctagcaaggttttgcaactgttcttgctcttgtttttgcaagtcgccgaccggaatgtccgtctttgattcgatgatcttttccatatcctctgcggtaatggttggttcatcttccttattagttgcgccatccttgttcttttctaacttagaaacttggtcacggtagtaggctgctttttcgtagtcttccgattccagagccttcttcttttcagcttcggcttcgtcaattttcttttgaatggtttccggatccgctacgttgatggttaagttcttctttgaaccggcttcatcaagaaggtcgattgccttatctggcaagtaccggtcttgaatataccgtttagacaacttaaccgccgccgcgattgcgtcgtcagtgtagtgaacgtggtggtaatcttcgtacttcttttggatacctttcaaaatcttgattgcttcttcttcactaggttcgtcgacttgaacgggttgcaaccggcgagcaagcgccgcatccttttcaatgtcccggaactctttcaaagtggtggctccgaccagttggaagtcaccccgtgcaagggcaggcttcaaaacgtttccggcgtccatgccgccttccgcatttccggcacctacaatttcgtgaatttcatcaatgaagacgattaagtccggattattttgaacttccttcattaattcctgcatccgttgttcgaattgaccacgaattccggtgccttgaactaatgaaacgacgtccaaacgaataatttgcttattcaataatttttgtggtactgagccttccacaatccgttgtgccagaccttcaactaccgcagttttaccaactccggcttcaccaattaaaaccgggttgttcttggtccgtcgattcaaaatttcaataacgcgttcaatttctttatcacgaccgatcacggggtcgatctttccttgttttgctaaatctgttaagtttaaaccgtattggcctagaagagagcttccgttaccgccgttagggttgtttccaccgccgcggcctgcttgagtagggggaacttgttgtccgtacatatcttccggacgacttacgttgccaccttgcattgcacggaaaatgtcgtctaagttaccaaatccaaatggatcttgtgccatacgcgcacctccatttccattattgttattaagttgttggttcttcaaaagttgatagcaattttgacaaaggttaacctctgtccttcgaccattcacgttagtatatagatgaatggttgcttcgttcttatgacaattttgacaaagcatgtgctgtctcccttctataatgaagttatgaaagaaactaatcagccattacgtcaaaaatgtttgaccaatattgaccataactaaattatacacgctcttttaaattgtgcaaggagtttgattcaaaattggaaaaagttattgtggaggcgccagtattgtaaaaattagtataaaggtatagaataaataagttaaatgaggtgttaaaatgcgtgattatttgaagcttttaaatgatttaaaagatggggtactcgatgagttaacgatcactgctgaagagtttcaagacttccaaccggtttttatggattttccggaacgcaagcagctgatcggtgaagcccagcgtggcggaacaattacttaccgctacgagaataacaaaaaacaataaggtagttgatttttgttttatgtaagggcttgctttaaggctcgtaaattgatattatcttgtcaaaggcttgtaaatggatgacgcgacaagcaacttcatttatagcaaaatttagtgttactaaggagagaaatatattatggaaaaacgcgactttcatgtaattgcagaaacaggtattcatgctcgtccagcaacattgttggtacaagcagcaagcaagttcaactcagacattcaattaacatacaaggacaagtctgttaacttgaagtcaatcatgggtgtaatgtcacttggtgttggccaaggcgcagacgttacaatctctgctgacggtgacgacgaagctgatgcaatcgctgcacttgaagacacaatgaagaaagaaggactttccgaataatgactgggatattaaagggtatagcagctagtgatggaattgccatcgctaaagcttacttaatggtggatcccgatctttctttcgaaaagaagactattacggatgtcgatgctgaaattaatcgtctccatgatgctttagaacagtctaaaaaggaactaacccttattaaagctaaagctgctgaaaatcttggagctgaagaagcagaagtttttgaagctcatctaacgattctttcagatccagagttgattggtaacattgaagataagatcaaaaatgataccatcaacgctgaagaagctacaaaagaagtgactgacaatttcatcgcgatgtttgaagcaatgaccgacaatgcttacatgcaagaacgggctgcagatattcgtgacgttactaaacggttgatgagtcacttacttggtgttgaattgccaaatccagctttgatcgactccgaagtcatcattgttgctcacgatttaacacctagtgacacggcccaattggatcgtcgttacgttaaaggtttcatcactgatattggtggacggacttcacattcggccattatgtcgcggaccttggaaattcctgcggtagtgggttctgaaaaggctactactagcgttaagcaaggcgatatgatgattgtcgatggtttaactggggatgcgctaatcaatccttccgatgatgaaatcaaagaatacgaacaaaagagtgcagatttcaaagctcaaaaagctgaatgggaaaagttaaagaatgaacggaccgtttctaaagacggcgttcactttgacttagctgctaacgttggtactccagatgacttacaaggtgttctggataacggcggtgaagcagttggtttattccgttctgaattcttgtacatgaatgcttctgaattaccttctgaagatcaacaatttgaagcttacaaaaaagttgttgaaggaatgaatggtaagcaagttgtagttcggactatggatattggtggagataaggaccttccttacttaccattacctgaagaaatgaatccgttcttaggctaccgggcaatccggattagtttagaccgcacggatttgttccggacccaattacgggctcttcttcgtgcttcagcatacggtaagctagcaattatgtttccaatgattgctacggtagctgaattcaagaaggctcgggcaatttacgacgacgagcgtcaaaaaatgatcgatgcaggtactaaggttggcgaaatccaagtcggaatgatgatggaaatcccagcagctgcaatgatcgctgataagctcgctaagtatgttgatttcttcagtatcggtacaaatgatttgattcaatactcatttgctgcagaccgtggtaacgaaaaggtttcatatctttatcaaccatacaacccatcactgcttcgtttgattaagcaaacgatcgatgcttcccatgcggaaggcaagtggaccgggatgtgtggtgaaatggctggcgatcaaatcgctgtaccaattctaatgggtcttggtttggatgaattctcaatgagtgctacttcaattttgaagactcgttcattgatgaagaagctaagcacggacgatatgaagaagttagctgaaaaggctatcacagaagcggaaactaacgaagatgtaattaagttagttgaagaaactgttaataacaagtaagctgaataagttaactgggaaccgttgaccattgggtcgcggttcctttttgttttatataaggagcgacgtatggaatttatactaaaaactggagaaaccatctattacgaagaccaaggagaagggatccccatcctgtttttaacgggctttggtggaaacacggaaatttggtcgggacaagttaatttcttcttacaacatggttaccgggtgattcggttggactaccttaaccatggtcgttcggaccgggttgactatgatttgaagattggcgatttggctgacgaagtacttcaattagtggatgccttagagattaaagaaccaattggaattggcaattcgatgggggccgctgttttatggaatattttatcgatccggggctgggattttgttagcaaggctatcttcgttgatcaatcgcctagaatgatgaacgatgatcaatggcattacggttttaaaaatttaagcgaagctaactttgaacaactgatgagcgagcctattttacggccagcttaccgccgaattgaggggtacgtttataagaattctaaggccattgattctaaatatcctttttcacagcctaaaaatcgttctttagtgaagggacacgcgagaaaggattggcgtccggttttgcgagcagccacaaaaccagtattgtttatcttaggggaaaagagtccgttctttaatccccagatgggggatgcacttaaacagctcaattcccgtattcaagtggaggtaatgccaaacgttggccacattccgatggcagaagagcccgcccaattcaaccaactagttttacgttttttataaggtagaggcagctgtttgcatatcgcattttaaaccaatataattagagaaagtagtttaattaggacaaagagggagattcgctgtgaatattggactgtttactgacacctattttccacaagttagtggggtagcaacgtcaattaaaacgctgcgtgatcagttagaaaaacagggacatcaagtttatattttcacgacgacggatccgaaagttgatacaaacgtctatgaacggaacgtatttcgttttactagcattccgtttgtgtcatttaccgaccgtcgaattgcaatcagtgggtttattcgtgctactcagattgctaaggaacttaaccttgatattgtccacacccagacggagttttccttaggttggatgggaaagtttgttgctaaagctttgaaaatcccagtaatccatacgtaccacacgatgtatgaggattatttacactatgtggccaacgggaaattactcaagccgtaccacgttaagcagatgacgcgggcgttttgttatcacattgacggaattgttgctccaagcgaacgggtgcagcgaacaattcaacgttacgggattcaagttcccacgcgcatcattccaacgggggttaatttggagcagtaccaaaaagatagcaatccccaacaatgtcgtgaagcgttagggtatgatgcaaagacaccagttttgctatccttaagtcgcttggcgtacgaaaagaatatccaagaagtgattgattgcttccccgcaatcttaaaggaagttccggatgcccagttgttgatagtgggggatggtcctgcgcggactagcctggaaaaccaggttcatgatttaggcttggaaaagcacgttaaatttacgggcgaaattaataatgatcaagtttaccgttattatcaagcggccgacctatttgtttcggcttctgattcggaatcgcaggggttaacgtatattgaagcaatggcttcgcatttaaaagtggtggccaaatcagggccgtatacggatgagttgctagatgatccttcgttagggaaggtttttgataccgaagcgcagctcgtgcaagcaattaagcggtatattgaacatccggatgaatttaatgatccacgtcctcgggaaaagaagctctatgaaatttccgcggattattttggaaagcggattgtagattactataatagtgcaatcagcgctcatgccgatttagaacatggctcaaagaaagagtctgaactagaataattttgtttaacgttaggggttagttaggttatgccaattaaggtgaacatgttttcgtccgccagtaaggttaagggacagggagttggtagtgcgtatgaagaattgattcgtttgctgaagacgcattttcctaaagaaattgatttatcaattaatcgttatacgcaagcggatatcagtcattaccatacgattgatccccaatttttcgcgtccacttttactaaaaagcggggcgtaaaggtgggatacgtccattttctcccagaaactatcgaggggagtcttaagattccacaaccctttcgttggttattctataaatacattatcgcgttctataaacgaatggatcagattgtagtagtgaacccaacttttattgatcagttagttaagtacggaattaaacgggaaattattacttacatacctaattttgttcggaaggacgagttttaccagtatgatgccgaacagcgccgccaagttagggaacgactaggtgtgcaaaaccgttttaccatcctaggaattggtcaagtgcaagaacgaaaaggcgtaaaggattttatcaagcttgctcaacaacacccagagatgtactttatctgggcaggcggattttcgtttggtaggttaacggatgggtatgctgatttaaaaaaggtagttgataatcctccagcaaacttaaaatttactggaattgtggaccgaaataagttagtggaatactataatgccgcggacttatttttattgccttcttataatgaactgtttccgatgtcggttctcgaggccttcagttgcggaaccccggtgatgttacgtgatttagacttgtatcattcaattattaagggatattacattgcggcggacaattacgctgaaatggatcaaaaattgagtgcgttagtcaaaaatccggcacaactgagggattatcagcagcgtgcagaccaagcttcggcagaatattcagaagatcatttagcagagatttggctaaaatattattcatctttgcttaaataggggggaatcattattacaaggaaaaacaagattgtccttgtcgtgatgattttggccggattggtaatttttggctattcgttgcgtggggttaatttgcaccaagtctcgcatgatattttgaatctaaacgtgggctggcttttagtggccctattatgtattatcttgtatctaggcttcgaagccgttgcaactaaagtattggtagaaagtaatggtgaccgactgtcttggaaagatgcaattcgaattccgttgattgagcagctctttaatggactgacgccgttttcttccgggggacagccagctcagttagtggctttaatgcagagtggtattgaaggcggccgagctagttcagtactattaatgaagttcgtggtttttcaatcaatggttgtattgaactttatttttagcctgttgattggcttccagtatttggaagataagattaaatttctttcttggtttgtgctatttggttttttgattcatttagcagtaattatcgggttattgatgattatgtactggcataactttaccaagaaaatgtttgaccttatctttattccgattaaacgattcactaaaccagagcgttatttaaggtggaagacgtcgattgatgcaaaggtagatactttctacttagaaagcgtacggatgaagtcgcaatggcggttattagccaaggtagcgttattaacctttttgcaactactgttttattatctaattccatatttcatcctattagcgttaggaaagattcacgtgcatctgattatggtgacgtgcttgcacgtgctgatcttcatggtaatttcactatttcccattcctggaggtgcaggaggggcggagtatggatttagtgttatctttgcccaatttgtaggtaatagtagcaagctggttttagccatgataatttggcgtttgctcacttactattttggaatgtttgcgggaatgtttgcaacggtaataaaaccaaatcggattaatcggatagcacctaaaaaaacgagcgaataagctcgtttttttattttttttaaaaaaagccttgacctgatttagtaatcttgatactatatttaagtgctcttcgataagggcgcaccaaggcattgagcgatttaaaaaaatcttaattcaaaaaaagttgttgacagattttgatgtttgatgttaagatatatgagctggtgtttttcgccagttagtgagattttaaattaaaacaattctccttcaatttcacgttctgatttcaatgtaatcattttatccacccgtttcttaattaacctaactactatggtatcacaactttggtgaccaaattaacccaattgccttgcttcccgtataggttcccacgtacggaccaattggacaagattctacgtgtaagcccgggtgttggaccttcagttcactttgccattgcatgctgcgatccgcatcatcagcatcgaccactgtcaccgtcaaatggcgataatcaaccacttgttgcgcaaaaatttcactaatcgcttccatagcgttttttatcttacgctctttaccgaccatttctaagcggccttgccgattaatcgttaaaattgggcgcatcccaaaaaacgagcttaccaacgaagtccgactggcaatgttccccgaaatctgaagttctttaacgttgttgaccgctaagtacacttccgtttgactacgatacttacgcaactgccgcaaaacttcgtggatgtccacgccactatctaacaggttggccgccaaaatggccgcattgctttgtccagccagaattgagcccgaatcataagggtaaacttgtagttccttaattaccggcacggaagctgaaagactattgatgaacccgctcaagcctcccgacaacccgatgcacaaggctgctttataacctttcgcagcaagttcagcaaaaaccctttgcatttccttaatcggaatctgcgaagtggtgggatggtacttttctaatttcaacatgcgataaaattcatccgcatcaatatcaacattttcgtgatagacgtgcttgccaaacataattggctggttaaccaccgtaatgttgtacttccgcgctatcgcaggatcaaggttagccgaactatcaatcacaattgccgttttactttgattcattttcattaatcttcttctctatatatttcgctaattttgcttcgggataaacgccggtaaccttttcgattgccttgccatccttaaacaaaactaatgaaggaatactcattaccttaaatgattgggccaattcttggttatggtcaacgttaagcttgccaaaatgaacttggtccccgtaactttgctccagattttctaaaataggttccatcatcttgcaaggtccgcaccaaggggcccagaaatcaacgatggtcaatccatctttaattacttcagctaaattttcacttgttaccgtagctgccatgaggagtctcctttttatttatagtatatagattatagcattatttgcgtacgctttttctgaggtagtgaattgcgatcgtaatcaagaatgccagcactacgattccggcaaaaattcccgaattaatttcaatatcaatcgcgggaatcgacaagaataatttaagggcaataatcccaatcagcacgtaggccattgtctctagttcaggaatccggtgcattaatttcataatcacctcggcaattccccgcatcgctaaaattccaattaagccccccagtaacacaatgaccgggttagaagaaatcgccagcgaagctaataccgaatcgattgaaaagacaatgtccataaattcgatttggattaccacccgccaaaaaagcgaaattttaccccgtggtttcaccaatttacgagtccgacgcccccgtttccgtttgtcaaaatagcgaaacactaggtatgctagataaagtgctccaatgattttaatttcccataggtgaatgaggtaagtcccaatcccgattactaaaaaccgaaataggtacgcgccccacaaaccgtaaaataaggatttttcccgttcgaccttatctcccaacacttgggtttgggttgcaagaactacggcattatccaccgatagtaaacattcgatcatcaccagtgataaaatcactaaccagtccgaactagactctaataccgtcttccaattgttgagatcgaagaagggaccgtataaatttgttaaaatattcaatataaatttctccccttaaactccaaataatatattttaatcgatttagtatattttttcacccattaagggttacacttaggttaatacaaacaacgaggtccagattatgttaaaagtaagcaaaaccgtgaatgatttttcgctaattcaagtctcgaacccgagtactttagaattacagaccctagtaaaaacttaccacgccacttccgaaacgttgagttacgcaattgaccctaacgaacgtgctcgggcagaaatcgacgaagaaaataacagctttttgattattttccatgctttaagctcgctatataatgccggtattcagaccgaaccggccgcttttctgtttctacctaaggcgctggtaatttttactcacgattctacccactacgttaataaaattatggatcgcaatttaaaaactttattacgcaaaactttaaataaaccggttcagttaaatagttcgctgatggttaacgccgttttcaacacgatttacgaacttacgatgcggtttaatgacgcggtctctcgaattaattatgatcgtcaggcaattcaggataaatttaaaacccgcctgaaccacagcggcatccaaagcatgttgcaattagaaaccagtttaatctacttactgacttctctaaagtcgaatacgtcgttgcttaacagcatgatgcgcctccccaacctaaacctgaccaaggcccaacgtaatcggctggaggagatcattattgaatcagagcagagtcaagaaatggcccagctatcttcagacattatcgaacaagtttctaaatcctattcggatattttagacaataacttgaataataccatgaaattcctgacaattctttcaattgttttagcagttcctaacattgtttttggtttcttcggtcaaaacgttaaattaccgcttgccgatcaaggctggagttggctcgttaccctagaaatttcgtccctattaattctaattgtctatctaatcgttaactggagtaacttttttaaaaaatgatcccacaaaaatacagcatttcaaaccggcattgagtaaaaccgcaccggcttgaaatactgtattttttattatagtttgctgttgcctgccgaaacgtgcaaaaaaactcagtcttctccggctaaccaaattaaggcatcaatcgcacaaaccgcgattaatgccttaattctgttagtcctcaaagactacccgagttttttcgcactcttaattgcgttacccatgccgtcaacggcaccgtgctaattaccccgatgaaaccaatcaaaatcatcgaaaattctgccgcaaaaatcttattattaaagaattcgctaaagcggtaattcaacttcacgtaccaaataaataaacccagaaaacttccaaagaagccaaaaaataaggtgttcaaagcagtcccgataatttcttttccaatttcgtagccgtgactaaaaagcttggtcaaatctaaatccggcgttgtttcgatcagttcctgaatccccgtcgatacggcaatcgaagcttccgcaaccgcccccaacgaactaatgatcattgtcgacgtaattacgtcactaaatttaatcccaattaacaacgacatcccttcaaggtcctcgttgttttcattaccgaatccttgaatcattaagtggggatgaatgatcagaatcagcccaatcaaaactaccaatactaataccgaactgtaaaatgcattctgtgtaatctggtcgtcgtcactgcccatgaaaattgtaatggctaaaatcaccaaactgctgataatggtcaccgtcaacgccggaaagccccacgaaattaaagcaatgtttacgaacaataccgcaaaattcaaaataatgcttaaaaaggcccgcaatccggtcgctccccccacgataaccattaaaaccgccaagatgatcattaaaattaacgtcgcgctaaccattagtcggtacccccttatttttgaaaaagacgcccgtcagccaacttgcaatcggtaccgtcaacacgattccaattccactgattaagctttgcacaaaacctaactgcatgttcatttcaaaggcgtactgccaactgttcccgttgcgtaaataaagcaccatcatggaaaaggtgtcggccataaaaatcatgaacaacacgtttaaaaggggacccataatggttttaccgatgttccgtcccgaaatccacagctgtttcattgaaatctgcgggttttcttttcgcagcttagccaaactgacaatgatgtcggtagactcatccattacggcccctaacgaacctagcaccgtttctgctaaaaagagcggttcgggattttgggtcacgtactccatggtttcaaaatgaagcccaccgttgcccgtcaaactaaatacaagtccgccaatcaacattgcgctaaaggttcctgctaaagtcgttaacagactaaccatcattttcttgttccatcctaaaactaaggtaagggtgatggcgctaaacaacaccgcgaccacgctaaaaattgccaatactgcatatccagattcttgcacgtcaatttccacggcaataaaaaagagcaccatgtttaataacacactgacaattgcgtgaattccggttcgtcgcattaaaatcagcagtcctacggcaatcactaccaatatcgtgatggcgacgtcccgcttcaaatctaatatcgtcgctcccttcacccgctgcccggtgccattaaaatgtaacagtaccgtttggcccgggcgatattttaaatcggtcgcttgggaaccactatattcgttcttcacggacaccgtttgcccccggtgttttccgtttaaaattttaatctggaggcgttgcttggcacgataatcgtgattattaaaattgtcggtttgcggaaccttttttaaattagtaacccgttcaattcgacctaacggggtccggtaaatcacgtcgtcatgctgtactaagcccaccacgagtaggccagtcaatataactaccaatattaacccaatttgagatttccaacgcattagagttttttctccatccagtaatgtaataggcccgcttccatttctggaccgccagtgcgctcgtaattcaacgcaaagtagaagggttccgcagttgcttgggcgtgtaaccggatcttttcaatgcccgcttggcgtccttgggtttcaatgtattcaaaaagttcttgggcaaggccgtgacgccgcgattccttggcagttgccacccgttgtactgtccaggtattgggctccgtccgccgggtccgagccgtcacgaccggcgtatcgtcttcgtaacccacaaagtatgtataaaaatcttcgtcagcaccaaattcaagtgcaggatcaatcccctgctcctccacaaaaacttgtcgccggagtgctaacgcgtccatgtaaattgggcccgtcgctcccttaaccattttagcttccatcgtgaccttcctttccaaatccaaattattaagcccatcttacaacaatttcttcatagatttgaaaatttattaaaattttattttattctttctttagtaccgaccccttaagatttctttaaacaatctatggtaaaattgcatttatatttgtaaagaacgtacttttgaaaggtctttgaaaatgaaatctcttaaatcaagaattgacacgcggttcgggttctttatcctgatcagcgtcctattttggttaaaaactttattcgcttactttaccgacatttccttaggagtgtccggtatttttcagtggattattttattaatcaatcccattgccaccactatgctaatcttcgggctagccctctacgttcgtcctaaacgagctttttactggacggcgatgcttctagatttagctaatacgattttactttacttaaacgtaatttactttcgggaattttccgattttatgaccgttaacacgatgctcggatattccaaggtaaaccaaggactcagcgcgagttccatgtcgctaaccaactttcacgacatcttttattggttggatctactggtcatctttttactattagtcttgaaaaaaattaagatggatccccatccgttaccgaaaaaattcggttttcaaattacttcggtagggattttattctttgcgtttaacctcatgcttgccgaaatggaccgtccccaattaatcacccggacttttgaccgctcctacgtggttaaatacatgggcattgacgcctttacggcttacgacggcgttcaactggagcgcaacattaaaatgcgttccgaagctaaaaaaagtgagcttacctcgattgaaaaatacgttaaacaacactatgctaagccatccgacgttagttttgggaaggctaagggcaaaaacgtcattattattcatttagaaagtttccaacagtttttaattgacgataaggttgaaggacagacggtaaccccatttttaaacagtatttaccatagtaaatcaacctattccttcagcaatttcttccaccaagtgggccaaggaaaaactagcgacgcggaaaacatgctggaaaccagtacgtttggaaccccgcaaggttccctgtttgcccaactaggttcggaccaaactttccaagcggctccggcaattttaaaacagcacggtaactatacttccgccgttttccacggaaataccgcatcgttctggaaccgcaataacacttataaaaacatgggttatgaaaacttcttctccgctagcgactttgacgtttctggggataaatcgactacttacggactaaaagataagctgttgtttaaagactcagtgaagtacttacaacatctccaacagccgttttacgctaagtacattaccgtaagtaatcacattccgtacacgttggacgcagaagacagcgacttcaaaactcccgacactggcgatgcaaccgtggacggttacttcaaaaccgctaactatctcgaccagtccattgaagaattcttcaacttcttgaagaaatcgggattgtatgataactcaatgattgtgctgtatggtgaccattatgggatttcgaactcgtctaacaaagctttagcgaagacttttgctcaagatccaaatcactttaaacagttcggcgacaatcccaccgaaaactggaatagttgggataacgcccagttacaacgggttcccctaatgattcacatcccaggaatgaaagatggcggaattcaaaaccaatatgggggcgaaattgacgtattgccaaccctccttcatttactaggaatttcaaacaagaactatatccaatttggtacagacttgttgtccaaacaacatagccaaatcgtagcgttccgcaacaacgacttcgtgacgcctacgtatagttcgattggcaacaccctgtacgaccaaaacggtaacgagattaccgatcctagcgatactttcttaaagaaggtcaagaaggatcgtaaagccgcccataaacaattagagatgtcggattccttgaacgaaaagaaccttttacgcttttacaagaatcccgactttaagaaggtcaattccgcagattacaactattctgacagtttagacaaagctatcaagattgaggacaaactaaaattaaaatctacttcaatgtattcgcgtaatcaagataagtcgttggaagacctttataaaactgacgcgcctgaagtaaaccataagtcaaccagtgaaaatcgaattaagattactaatccggattcaaatggtagctgattttaaaatttaaaagaggattttcattgcgtgatgcaactgaaaatcctctttttttgtggtttgatttagttaattttggcattctactgctatgtagtcgaaacgcgtgaaaaaaactagctctctccggctaactaaattaaggcatcaatcgcaaaccgcgattaatgccttaattctgttagtcctcaagagctacccagtttttttcacgctctatcatttaaacatcgaagtactatgtaccgggcccctctttcccggatacaactttttcataatttgatctaccgcaatcggtccctctccaaacgccgtggctatcaatcttaattttccttgatactcaattccatcaccaattgcatatacgttcggcaaatttgttttcatcaagttgttcaccgcgaacatccggtgcgcttgttctaattctacatcccattgcttaataatcttattgctcgacgtaaatccgtagttaaccactacttggttaaacttccgggtcgttagctcctcggtgccgacttcctttaagtccaccgctacgcccacggcttcttcccgaacgtcatgaatcaaaaacggcgttaggatttctaccgaagaatccttcaatctttgcacacttagttcaagcccgcggaattgttcccgccggtgaactaggctaacttgatgtgcgaccttctccaacattaacgccacgtcgatcgcggaatctccgccgccagcaaccaacacgtcttgatccttaaactgagctaattctggaacgtgataaaaaatcttgtcgccttccaatttttcaaggcccttcaccgctagtttacgcggattgaacgctccgtttccggtggccaacagaattgcccgcgactgatactttgccttcgtggtttccacgtcgtatagttccccgttaggcgtaatgttcacaaccgtttcgttaagccggatcggcacgttaaccaagcgagtctgcttttccaatgactttgctaaatcagcagccttcacgcctgcgtaaccgcccacgtcgtaaattactttttctgggtataaagcagctgcttgtccacccacttgggccaaactttcaataatctgcgtttttgcagtccgcattcctgcgtaaaatccggcaaacaaacccgcaggaccgccccccacaatcgtaatgtcgtatatttcagtcatgatttctgcatcctctttaatacaataattttttagtttactaaatatcttaacagtttcttcagcaaaaaagaaagccaagcattgttttttaacaacgagtttcgtatgattaatttgtaatacagtacataaacgtttatttaacggaggggttcttttggcaagtaaaaaaatgattctagatcttgatactggtattgacgacgcaatggccatcgcctacgcgttagctgctccagacgtcgatttgattggtattatttccacatatggtaacgtactaacacccgatgcaggaattaacagcttaaaaattctcgaattgctcgggcacaccgacatccccgttttcttgggcgatgaacattcgcaaacaaccgaccattttgaagtaatgccaattagcgcacaaatccacggaaaaaatgggattggcgaagtggacctacctactccgcaacgtaaattagaagaacaatctgggatcgacttcctgatcgaagctgcctaccaatataactcagatttaatcttagttcctactggtccactgactaacctcgcggccgcaattcggaaggatccggaaattacggacttgattggcaaggtaacgctaatgggaggcgccctcaccgtaccaggcaatgtgtccccagtggctgaagctaacatcaaccaagatccgcacgcggctaacgaagtctttactcgtcaaaagaaccttaccatggttggcctagacgttaccctaagaacgttgcttactaaaaaagaaacccaacaatggcgtgatttaggcaccaacgccggacagaaatttgctgacatcgttgactactacattgatgtttataaaattaccagtccgcacttaggcggctgtgcgctccacgatccgctagcagtcggcgtgtccttagatcctagcctagttcaaacgctggccttaaacatgtttgtagatactactgacgccatgtggggccgtaccattggtgatcctgctcgtttaaccgatccagaacccaacgtcaacgtagcaattaacgtagacgccgaccgttatctacaacgtttcatggaatatttaactaacttattcagtaaataactaaattactattaataaaaacgcgaaaatcgatttttccgcgtttttttgttacgctaattaacataaaacaaagaaaggaggacccgtattgaacgttttatttttcattttaactttaatgttggcagttattgttgctaacattttggattctcgaattaagttcctacctcgagcaattgtgcaaatcttagtgggtttgctgctatcatttgtcccaaactttaatcactttgttctggaacccgaaatattcatgctggcaatcattgcaccgctgatgtttcatgacggtgccaataccgatattaacaaattaaagctaaccctcggaaacacgttctcgttagccgtcggtttagccttaaccaccatcttaggtgtgggttacctaagttacttaatgcttccccacatcccgctcgcactagcatttgccttggcagcaatcatcaccccaactgatgcggttgccgtttcatccgtaaccgacaacttagaaatccccccagacgcaatgcttaacctaaaaaatgaatctctttttaacgacgctagcggaatcgtggcctttgacttagcactcaccgcttttcaaactgggcacttttcacctttaataagcattttcgactacttatacgtattcttaggcgggttgataattggttggataattggctgggcatttctgcgactccaatttttactgattgaatctaatattgacgacgctaacattgtcgtccccattaacttgatcaagcccttcgccatctatttagctgccgaactttgtggtacttcaggaattttagccgcggttgccgccgggttagtccaaagtacgcaaaccccatttttacgcttaacttccactaagattcaaatcgtttctaagaccactaccgaaaatctaaacgaactattaaatggttttgtttttatccttttaggagtttcgctacctaccgtaatttacgacattgttaataacagtcgtcaggtggcctcgttaacagatttagtattgatcggtatcgtgctgtacgtcaccatgatcgtgattcgttacgtttgggtgagcttgcgacttgctagcatccggattcgtccccaagaacgacttctcaaccgtttcttaatcgccatcaatggcattcacgggacgattaccctagcaatggccttctcaatccctttggtcttcaaaaaggccgcttttccgtttcgtaacgacctaatttttatcgccgctacggtaattgtcctcagtctatgcgtgcctagcattattttgccactcgtcttacctaaaaaaacggtttcgtatagtgccgacgacattagcaaataccggcagcaaatgattaattacgctattcaacaggttaaggacgctaacgaagatccgattgaaacccaagcggtcattgcaaccttgcaaagccaagaatcgatgttccagcgtccaaagagacgaacgatttttaaactgttgcaaaagtgcttcagcttagaagaacaactgttacaagaaatggtggaccagggcgaaattagctccaagttgcaaactttgtacgaacgaatgacctttttccaaagctaccagctgcgtcaatcgctgttctaccaaattttataccgaattaagtactccttaattcgtttgaaacaccgtctccgacataaggcggttcacgttaataatcaagccattaaacgcaaaatcaaaattgcgcgggatgacattgcgaacgtggaagctaaaatcatcccccggatcctagaagaattgcacaaccaaattaccgaagaaaatcaagctgaagttcattggattgaaagctattaccgcgaacgtcaccgccgtttgcagaataataaacaggctaaccggattcaagacgaactcttcattagcgcgtttcaaaatgaatacaattttattcaaaaccaattaagtaagcaaaatatttctcgtgagctagctaacctgctatatgaacaggtagctaacgacgaatggatttacatgcaaaacgattacatttacgcgtaaaaaaagtcttaaaaggattgtcgtttaaaacgattcttttaagactttttttctttttacaaatttattcacactttgtctgggtgcgtagttttcaacatcccttgttgaaaaatctgctaaacgtttttttctaaaaatttcttaactcggtcgcggtattgctgatagtccgtttgcatagccttcgcgtgccccgcgtccttcaccacgtacttttctttaggccccttcgtggcagcgtacagctggtcaatcattttggtaggaacaaagtcatcttttccaccgtgaatgaacatcatcggttgatgattttttgccaactgcttcatggcactagcttcgccataactgtagcccgcccgaatcttcgaaattaaactaaccgtcggtaccagtggccacttcgggaggtggtacattgatttggcttggtaagtaatttcatcttccacgctcgtataaccacaatcctcgatgtacgccttcacctggtgcggaacgtcaggctccccactgatcatcatcgtggttgcaccacccatgctaaccccgtacatcaccagcttttgatgttcgcccttctcacgcaatagtttgttcatccatttgatatagtcacgccggtctaaccaaccgtatccaattagcttcccctcgctattaccgtgagcccggtcatccggagccagtacgttatagcctaaatcatgaaacatggctgctggggcgccttcaccgtctttattttgtagaaaaccatgcgctaaaatgaccgttttatttgtgggatgggccgctggaatgtaataagcttccagcttcaagttaccggacgccgatttcatcgtccacttttccttttttacccgttgataccataatttttgggtccgcaacggatcgtttttagtgatttttccgtcgttcttaataaaacttttggtaccgcgaacttccgcaacgtggaaaaaatacatccccgcgcctaagtccaccacgagcaaaaacgctagtaccaccaaaagccatttccaaaattttttcatcgtattcctcctaaaccaacttttttagtatagcgtttttttactgcccttggcggaaaattacgctaatcccgaatttggccccaatttgcttgtgacatttactttaatttgtcgcataccctcgaactgtattaaaataggtctagaatattattcacaggaggacggtctatgtttccagaacgtttgcgcgctttacgccacggtaaacacatcactttggaggtgcttgctcaagaattaaatgaattatttccggatgaaaatccaaacaccgctaatcaaattgggaattgggaacggggaatccgcaccccatcctatctggaagtgaaaaaattagccgaatatttcgacgtaagcatggactatctgtgtggtcgctccgcgcttaatgcctatgatttaagcaaactattcctatctggccgtcaattaagctttgatcataaaacgttgagtagtgacgaccgctacgaagtttttcaattaatcaacggctatttccacggtaagaaacgacgcccaattaactcttccacggaacaagaagagcttgatttaaattggcagaaaaggaacgatgactaagtaatgaacccgaaaaaattgaaaaagcttcggcgacaattaaaaaaggcgcaaacaacgcaatcgtctgatcgttaccttcgccaattaaccaattatcgcaatttatttaaagattatggttcaattgtttttttgattaaccaagtattggaaagcgagcgtttaattcgacaaaatctattgccccagcaattgccgcttttagaattgcccgacgacgttcaagaacaaatttttaaccgcctcaaagaacgctttccgttaggtgatccgcggggagatcggctttgggaaaaattaactcgcgaactacccaagttagataaacttttgcgttcgtaccgggatttcttggaagaaaggtacggaatgtgggcttacatttccgcaccgttaattaacgatctaaccgcctatttagccggacgtcccaccctagaaatcatggctggcaacggctatattagtcacggattgcggatgaaagaccagcccgtaattgctacagactcgcttgcttggcaatccgaaaatgaaactggtcgacatttggtgaccgaagtggagcctttggatgccctcgctgccatcgaaaagtatggcccgcaagttgattacgtaattatggcttgggctcccgatgggctggacattgatgtccaagttttgaaaaaactgcgcagtttgcctaaccagcccctattaatctgcattggcgaacaaaacggcgccaccaacagtaacgagttttggcaaattgctcaattggttgaaccaaaagccgctgctaagttaaaccaacattttcagccgtttgatttaattcatgaccaagtatacctaatcaaataaactaaaaaagcggacaaaaaaagaccatgacgtaaccgaaattacgtcatggtcttttataaaccggtcatcagcaaaattgctgaattggtcgttgagtggctcacacacccaaattgacccacacctacaaaatccggtagttaatgtgtgccggtgaaatggtcactagtcgccgcagcgaaacagccgaagctgcctgacccatctcgactcatcgcacgtaactaatgtatcacaaaaatggttgcacaacaaccagcttgaacctaaaaattgcaatctcgcccaaaaaactctatcatgagactaccataaaaacgataaggaggtgtacgatgctaaatttaatttggggatttctagttcatccgttatcctacctaacccccttaacaacccaattaaatcagtgggtttacttgatcttgtttatctggatattcttggaaactgcctttattttcttctcttttttgccagggcaatccgttttattcttaactggaacgattgcttctacggccccagcacatttaaatatttttctactgctgctaactttcatcgctgccgcaactaccggagccatggttaagtattggtacggtgtgaatttggaatcgaaaaataaaatcgctcaaaaaatcagcgattctccgcagttagatcaaacccaaaagctgtttgataagaacactaaaaaatcgctggtcttttcccggttcatccccttcgtgggattgttcgttcccattattgcgggaacgacccagatggattggcgccgtttcaataagctcaactttgctggcgtgttactgtgggtattgacttgctgctttgccggctacttcttcggccgcaccgcttttgttcgccaatacttcaccttaattttcctaatgctaattttcgttccgttcatgatcgaattagtttggcgcaaaataaaaggacgggttcaaaccgatgccacctaacaattactcaggtggttccgggaacccgtcttttttatttgcgtaatttaatttctaaagcacgtaagccaaaaataattactaggtaaagtaccatcacgccaaggatggtaccaaagccaatgaaggtagtgtgcaaaactaaacgaccaatgattttcaccactaacagcagtcctaacaaaagtcctaggccccaccctacttctacaataaaatgtcggggccggtgtagccattcttgaatcatcttaatgtatttcaactttcataccctccggaacgttcttataaatccattttgcatctggaaccgataaccttacacagccatgtgattgggcttccttacccagttgttgcgcttctttagggataaatttaccgttcttatctgtaggaacggtgtggaaaaggtaaatcccgtgatccttaaacgatacccagtacttagccccttccttagaagccgcgttatagaagaagtcgccccgttctttttggatgtggaaagttccggttggtgtcggactatccttggatccggtggatgcatacatggtgtataagaccttttttccgtccatcacgtaaacccgttgcttggcaatggaaaccttcaagtaagcctggggatgcttatctaaatcagggtattcatttttttgcgaggactttttccaatttacggggttcattttcgtcttggtagaagctttcgccgtttctgccgtgggggcttcatccccagctagtccggtatccttggccgaacttttgggtaaagccttttgcttagctgatttttgtagttcaactttagcatcgtgacgaacttgtttttggtatgctcgtgcactagtaaaaaccgcccccacaaataagacgattgccaaaccaataatcaattcaaatcttcttttcataatctccctcctgctattcggtagtcgattttgcagctggttgatctaagcgttcaaactgttctttaacccagtcccgaaaatttaaacgtaagtccgggttgtcatttagcagatcatccgccgttccaatttgatcaattcgtaaatgtgaagaattaatcttctcagcttcgatgactgcatatacgttcaaatcgtattcttggtcagcctcggttaatttttcgacggctgcggggtataatagcggtaggttaattacgtttgattgtaacttaatcaccacgtctttgttaacgttgatgaccgcttcggcaattccgtgctggttaaccgccgtttttaagtagttaaacgcctcatctgcgccggtcccgtcagcttttttaagcgttgcttttccgattttaaacgtttgactggcaaagtcgcccgcttttaaggtttgaatcacgtcgttggctagaattttcattttatccctcactagttaagtttctaaataaaagtttaacattcataactctttttttacatacatacattgttttcccattgcgctgatttaatgcgcttgatttaagacaggaggaagttcacatgaaaattggatttatcggtactggagtaatgggtacgggaattattaataatttgttaaagcaccatcatcaggtatttgtctacaaccggactaaggcccacgcccaagaagtaattgaccacggggcgatttgggttgactcgcccgttcagttgaccacccaagcacccatcatcattaccatggttggtttcccgcaagacgttaaggaaatttactttggggaaaacggtatttttacaacgttgaaagctgaccagttagttgttgatatgaccaccagttcaccaaccctcgctgaagaaattggtcaccgggctgaagaaatcggggcgttggcactcgatgctcccgtttctggtggtgacattggtgctaaaaacgctaccttaaccgtcatggctggcgggcaccaggaggcgtttaaaaaaatggaacccctcttccccgaaatttcacaagcggcgaattactttggggactttggtaccggacaacacgctaagatggctaaccaaatcatgattgccggcacgatgaccggcttaactgaaatgctggtttacgcgaaggccgctaatttagatttacaaaaagtcttagataccgtttcccacggaagcgccgataactggagcctggataattacgtaccgcggattctggaagatgattacacgccgggattctttgctaaacactttttaaaggacctcaacatcaccttaactgaagctaagcgaatgcacattgatttgccagccactcgcttagccacccagctttacgacaatttagttaatgctcaaggtcttggcgacgacggtacccaagctttaatcaaactatggtggaaataacccggagctccttaaattaaacaaccctcacaactaggtggacaccttgctgtgagggttattttttacctgctattcttttgcttgctcaatttcccgttttgcaaagtcccaaaacagattaaccactggtgcagtccggtcccttctttttaagaagactaggcgactacagatttcaggaaccagtggtacggccttgacgttatcaaatcccgtcaaatcaaacgacttgttcatcactaccgaaacgcccatcccttggtttaacatttctaaaatcaaatcaattcgctgtccttcataaacaatccgcggagtaactaacgaacgtttcaaaacttcgtttaaggggttcgcaacggtaattgtgttccggagtaaaaggagttgttggtccttgatcatctcaatgcttagttgtttagcttgcgccaatggactattcttcggcaccaacaccacgtaatggtccgtttcgttaacgattgtgtcataacgcggatcgtgatcctcgtaaattcgagtaaaaatcacgtcaacgtcctgccgttttaaatcctcatttaggtccggcacctcggcttcactgaacttcagctttacgttcggatactggctagtaaatttagtaatgatgttaaaagcttggtactgagcaatggaagcaattccgtgaataactagcgtctgggcgtggttggcgtttgcgattgccaccgtggtttgtaattctttttcctgccgcaataattgttgaaccgcgggcaaaatcttttgtcctgccgcggttaactgtacttgccggtgagcgcgcgaaaaaagcttaacgtcccattccttttctaaagccataatgtgttttgacacggtcgattgcgacaaaaataacctttccgcagtctcgctgtaactttgggtttctgccaagtcaaccaacgtcgttaatttttttgtatccattgctttctcccgacctattcctatttggaatattttagcacataaaaaggaattgcgcttttccgagtcaatgactaaactaatcttttgtgagtaaaaaaagagggaggatttaatttgccaattggaatcatagttaacgtttcagcaattttctttgggggaatcattggggccttaagtggcggcgcgatgtccgaacggttcaaagaaggtctaaacatggcctttgggatttgttccatgaccatgggaatttacgcaattgcccccatgaaaaacttagccgcggtaattttcgcggtaatcatcggaactggattgggtctcctattccgactcggcgtgttaattaaccggggtgcagaaaatatgcaacgtctcatttcacgcttgctcccctccaataaaacgggtaacggtagtttggacaagatcacttacgacgctaatttagttacagtaatcgtccttttctgtgcgagcggaaccggtatttacggttctttgattgaaggaatgagtggtgatccgtcgattttaatttccaaagcaattttggatttctttacggcattgatttttgcggccaatttaggatacgtggtttccttaattgcggtcccgcttttaatcattctaaccgccctattcctcgctgctcacgtgattttccccctcaccaccccagatatgattctggactttaaagctggaggcggagttttaatgttagcgagcggtttccgaattatccaagtcaagatgttcccaactgccgacatgatcccgattatgatcgttatcatgccaatttcttggttatggaccaacgtgattttaccgctgctataggaattttttgaacgatatcccacactcagtactaaaaaataatagtcgcctagctactgcacaatcaagcggtagctaagcgactatttttatttcaagtcgttgcgatgcgttgtttaagtcgtaaaaccaatttgatcagtctgtccctagcaaaaaagcttattaaacttctaataatttttcagctaacgcaaagttacccagggtggctgaaccattattggcaacttccggcatcacgaggtacttatcaagatccggaacttgtacgtagccgttcaagagttctttaaatgatttgcgaaccttctccaagaaatccgggttggttaccccgccaccaaaaacgatctttcccggacgtagcgtaagggtcgtttgaatagcggcttgtgccgtatagtaagccataatgtcccagacgggatctgaatgcggaacttctgcgcccttaacgcctaagcgagcctcaaacgttggcccagcaaccaatccttctaaacagtccccatggtacgggcaaacacccttaaaatctagatcgtcagggtgccgctttactaaaacgtggcccatttcaggatgaccgattcccccgatcaagtggccgttcacgattgctcccgcacccacaccggtaccaattgtataatacgttaacgaattgattttttcgttagcgagggtggccattacgtattccccgtacgccgaaccattgacgtcggtagtccaaaaaatcggaatatcaaattcctttttaatgtaccctacaaaatccgtatccgcccaacctggctttggcgtagtggttacatagccatactttggcgaactgtgccgaatttcaattggtccaaacgacgcaatgcttaacgccgcaatgtcaaattttttaaagtaatcgaccgttcgttgtaaggtttcctccggagtagtcgttggaaattgcgtttgatcctgtacttgataattttcgtttcccacggcacacacaaatttggtaccgccggcttcaatactacccaataacattatgtatcgctcctaatttaaattaacatggggaaccattccccgttgcccgtttaccataccaatataccactgtttcgggcgttataataaaccgatttcattttttattttttagcctctgataaagcgaaaatatccagaatttaaaggtaaaaaggcttacaattcattttgaaaatgatattattagtataagaaatgatgattggatggtgggaacatgctacaacaatacaaaaatatcttggcacctgttgacggttcaaaaatgacagaggttgtcgtggaccgggcaattgaagttgctaaacggaataacactcatctagatatcctaaatgtcttagaagttaaccaatttagtgacacctatggtggagcggttagtggagatgtaatctacaagctttctgaagacgtccaacatcgcttagaagaactaaagaaaagagctgaagatgctggggttaccgacgttagcattcatatccgctttggtaatcctaagccggtaattgctcgtgaatttccaaaggatcacaaaaacgaattgattatgattggttctactggtttaaacgcgctagaacgcttaatggttggttcagttgctacttacgtaagtcggaacgcggtttgtgacgtgttagtagttaaacctgaaaagaaggccaaaaaataattaagtatgtaaaaaagcggtccataattttatggatcgtttttttatggcaaaaaggagtgcttatgacctggacgtaccatattaaactagaccaatcttaccctccccaaactttacgagaactactgcaaaaaacttggtggctttctcggaaggtcgtccattttttacgcacggaacgccgagttttggtaaaccagcggtaccaaccggttatcaccgttgtccgtagcggagacttgatttcgttaaccttcaaagaaagcgactttgctaccccgcttccgccatttgacccggattcttcccaaagtcctgacgttttgtttgaaaatgacgaccttcttgtggttaataaacccgcggggattaaaacgcacgctaaccaaccacacgagttgggaagcatgattaacttcttgcaggcgtactttgccaagaaagatgccaacgcatataacgttcatcgtttagatcaatggaccagtggtgcccttttggtagccaaaaatccggttgttgtcccagtgcttagtcggcaaatcagtcaaaaattaattcaacggacgtacttgtgcatggtagaaggtcacttgaaaagccgtagcggaaccatcacgcttcccattggacttgaccctcacgaccagcgtaaacgacaaatcaacggtccgggagcgcaaccggccactactcactaccaagtggttcgtgaatttgctgaacggagcctactactcgttcagttagcaaccggccgtacccaccaaattcgggttcaccttgcagctttagggcatcccatcgtgggagaccctttgtataattcacttgctgacggagctcccatgcggctgcactcttggcaagtcaaatttcccttgccctttagccaaagctggcaaacggtaactgcaccggtacccgattactttggaatttcgttggctgagccagcttttgatgttggagattaatttgtaagtaaaggtggcatctattttggaagaactttttttcattcgtcgaatattagcaattagcgaagctggattagcttatgcaagcgatcgctttgatatcgaacgttatcaagatctccgtcagcttgcgatgcaacgtttgagtgagcttggaaatgtgcaagtaaccaccgtggcagaactctttaaggacgaggcgggatatccaactcccaaagtggacgtgcgagcctttattcgccaaaaaaatcaggtattgctcgtggaaaactcccacggtgaatgggctctccctggcggttttgcagaaattggctggaccctaaaagaaaacgtcattaaagaagtgcacgaagaaactgggctgaccgtaaacacggctacccttcgcgctgtctatgacacctccctaagaaaagacgtcccgcaaacttttcagtattataaatttattttcgcttgtacagtggaaagtggtgaattcgttaagaacagtgaaacggttgcgatgcaatggtttgataaagaccagcttccaccgctttccatgaagcgaaccactcctgaacaaattgcacaattatttgactctgtagatttacacgtggattaacttctctaagctcttgtttgcaatagttacttccattattactacaacgcaaaaaagctgaaagcagccgcccgtaagggcctttgctttcagcttttattgtttaatctttaagctttaattatttaacgtctttccatacccagtctttaacttctggaaggtcgtcaccatggtcacgaatgtattcgtgatggcgagcaaggatattgtccatttcttgggcaaagtctgcacccttttcgttaaattctggaattgagttgattacgtcttgagccaagtggaagcggtcaagttcgttaagaactcgcatatcaaatggagtagtaatgtccccttcttcacggtaaccatgaacgtgtaagttatggttgtgacggtcaaagaagattgaacgaatcaagtcttcgaaaccatggaaggcgaagattactggtttgtccttagtgaagtagcgatcgaattcttcgtcactcaagccgttagggttaacctttggactttgtaacttcaataggtcaataacgttgataaagcgaatcttcaattctgggaagcggtcgtgcaagatgttaattgcagccaagctttccatatttggttcagtaccagcagcagcgataactacgtctggttcttcaccattcgtggtgcttgcccagtcgatgattcccaaaccgttgttagcaagcatttctgcttcagccattgagtagaattgtggacgtggttgcttagatgcaatgatcaagttaactttaccacgatcgttcattactaatgggctgattgctaacaatgagtttgcgtcagctggcaaatattcgcgaatgaattctggtttcttttcagctaagtgagttaagatacctgggtcttggtgagtgtaaccattatgatcttgttggaaacttgttgaagttgaaacaatgttcaatgatgggtaatcacgacgccagtctaattcagaagctttccgtaaccacttgaagtgttgggtaagcattgagtcaactacccgaaggaatgcttcataactagtgaagattccgtgacgaccagttaaggtgtatgcttcaagccagccttctgcagagtgttcggaaagttgtgcatcaagaatgcgaccttctggagcaactgcttcatcccagtccttcttgactgaatccatccattgacggttagttacttcgaataggccatagagacggtttgacatcgtttcgtcaggaccaaacattctgaagttctttggattcttagtaaccacgtcacgcaagtagtcggaccataccaacatatcttgcttcatgttaagaccacgcttgcttgtgtcaaccgcgtattgacggaagtcaggcaagttcaagtcagttgggtgaaccccaccattagtgattgggttagcagccatccgcttgtcaccctttggcacgaagtcaaggatgtcttggtcgatgtgaccatcttcgtcaaacaattcttctggtttgtatgacttcatccagtcaactagtgcatcaacgtgttccatgttgttttggtcaacaggaattggaatttggtgagcacggaaagtaccttcgataaccttaccgtcccaagtctttggaccagtccagccctttggtgaacggaagacgattactggccagtatggcaatgattcgtcatggttttcacgagcattcttttgaatttcttggatcttttcgattgccttgtccattacttcagccatcttaggatccattgcttcggaatcgtcgccttcaacgaagtatgggtcccaatgttggctgtggaagaattcagctaattcttcgtccgtcatccgggaagtaagggttgggttactcaacttgtaaccgttgatgtccaagattggtaataccgcaccgtcagtaattgggttgatgaaacggttgtggttccatgatgttgccaaaggaccagtttcagcttccccatcaccaattactactgcagcaatttggtctgggttatctaagatagcacccacaccgtgagaaagtgagtaaccaagttcgccaccttcgtggattgaacctggtgttacaggagcggcatgagaagcaaccccgcctggccaagagaattgtttgaagagtttcttcattccttcttcgtcttgggtaattgctgggtaagcttcggtgtatgaaccgtcaaggtatgaagtagaaaccattacttgtccaccatgacctggtccttcgatatagaacatgttaacgccgtacttgttaataacccggttcaagtgagcgtaaatgtagttttgaccaggaatcgttccccagtgtccgattgggtgaaccttaacgtcggaggccttaacgtcacgcttcaataatgggttgtcttttaaatacaattgaccaactgagaggtagttagctgcgcgccaaaacttttcaagtttgtcaaagtaagctttagatgaatagtctgtcatcgtaatcttcctttcgtgagcgaaaaactgattaattaatttacgagataagtataaccgctttctcgaaaaaggtcaatcattttataaattgatacggtccaatttttcaaaaataaaaatagccgcgtacaaacagcgccgttacaacgattgtggaggttctaaaaacctcctttgtgctgcatactcggttaaaaatggtaatttatcgttatttatttttaaaaattaaacctaatctactgatacaaacgtgctgtaattcatatgccggtaatgaattcgcatatttgaaatttcaaagggggttccgtcatccatgaaaaaaattccggacataatgccgaccggttcgttagcagttaatcctagtaattcttggtcctcttggttagaaggagctacttgaatcgacatatatgaacgggttacttgttgtcccttcgcgtcttccaagtaattaaaaattgatttttccacaatggccttggataattctggcgcgattttaatggggatgtagcccgtttcaatcatgatcggctcctcatctaacaagcgcaggcgccgaattttatagacaaaatccccgtcatttaagaacaggtcggtcttcatgcttttggtggctggaatcacggaaaaatctagcaccttaatcccctgcttttttccgttggatttcaaactatcggtaattccgatgttggaaccttcgtaattaaacgatgactggctctttaagtacagcggattgataaaggttcccgatccccgttttttaaacacaatcccctcttgcgccatcgagctaagcgcccgttttacggaactgcggctaacgttatattctgtcgttagagagcgttcgtccggcaaacgcattgacggaaattcattattaaagatacgttttttcaaatcatggatgatttttcggtaaatcagatctttcattaaattatctcctgtagattagttgctatatcattatagcaaacttaccactttcattttgtgagggattcgctcaatgtgctaaaatacattgctgggtgatagattatgtcgaagaaaaagaaaaaaggaaaactttccaaaaccttagtagaacaaattttagataagcataaaattgagtaccaacaattcgtttttccaacgtaccaagatggggacgttaagcaactcaacgtcgaccacatcggaatcgacgaccacgtcatttataaaaccctcgctttaaccggcagccaaaccggtccgctggttggggtaatccccgtggacgaacaccttagctataaaaaattagcgaagctgtccggaaataaaaaagtcggtatgattccgctaaagaacttggtggcaacgactgggtacgaacacggcgccaacaccccgattggcatttacgaaaccaagggattcccaatttacatttcggaaatcgctaaggaacaaggaactattatcgtttcttcgggtaaaattggccgttccgttcagttaaaagctacggacctcgctgacttggttcatggtacctttggtgatattactgaataaaataatcccccgaaccgttggcaaattgccggttggtccgggggattatttttttattggagggccgcagtaatgctttgttgcaagcgttccaagccatcttgaaccttcgtcttcgggcatccgacgttaagccgtaaaaactgcttaccatttccgccataaatgccgccacccataatggcaacctttcccacttctacacaatacttttgaatcgtttccatggaaagcggcaggtcggttacgtctaaccacaacagatacgttgcttccgattctaccagcttaacttggggcaagtattgttttaaatacgtacgaaccagttccacgttagcttccacgtactcatttaactcgtccacccacgctgatccatttttgtacgcagccatcgtagcttccattcctaaaatactacatgaagacaggccgtccttattctttaaggcgtagttaaactgggttcttaattctggatctgggattaacaaatatgaaaaaatcaatcctggaaagttaaaagttttagttcccgaagtaagtaacgcggcgttttgctccacatactttagaatattttggtgacgcacattttttcgcacgacgtccatgtgaatttcatccgcgatgataaaaacgtggtacttttcgcatagttgaaccattttttgtaattctgtcgtggtccagacgcgaccagtcggattatgtggcgaacaaagcaacataatttgattattaggatcggctagcttttcttccaaatccgcaaaatcaatcgtgtactgcccattttgataccgcaacggattctcaaccaattttcgttggttagcacgaatagtcttaaaaaaagcatcatacgcgggagtttgcattaccactccctcacctggttttgactttatttgtaatagttgggaaatcgaataaattaccgacggactatacacaatccactcgccgttcacccgcaatccaaagcgcttttgaaaccaatgctgcgtggcttgcttaaaatcagcgtggttccaccgggtgtaaccataaatcgggtgttgaatcctcttttgaatcgcctcatttacgctaggtggcaccgcaaagtcggtatctgaaatggtaaacggcaataagtctgccttgccaaatcggtcctgcacataatcccattgcgtgcaataagtaccttttcgattaatcacttcatcaaaatttatcaaaatttcacgaccttctcttttcaatctctgcttttacaacttaggcactttcaacctcaatgattggcgtgtttttctttaccattcccttagcaatcatcccgacgttagtgtactcagcaaaattagtaaccaccactggcgtaaccgtagctagccccgcatccgctaccatttgccagtctgccgtagctaatagatcaccggccttaacctgttcgtcaacggcaaccttggtctcaaacggctttccgtctagtttgacggtatcaattcccaaatgaattaaaatttccattccgttagttgctttaattccaattgcgtgtttagtaggaaagaccgtcgtgaccaccccgtctactggggcaaccacttgaccgtccgtaggctggattgccgcaccttgtccaatcatgccggttgaaaaaacggcatccggaacttccgttaatggcaccgctttgccagttaatggcgctccaatttggaactttttagcttcgggttcgccaccttctaaaagggcgtctaatccgttacgcacggtagtaaccttagttccaatgattacttggacacttgtatcatctaaatgaactactcctaaagcacctaatttgtgaagctcctcgtcattgatgattgagccgtccttaacaatcaatctcaaacgggtgatgcagttatccaaggtgacaatattgctttttccaccaagcgctttgagaattcccggaatgtcgtatccaccagcgttaccactcgtccgaatttcagcatccgtatattctggttccgtagcaacttcccgacccggcgtttttaaatcgcgccagaggataaatttcttgaaagtgaaatagtatgccaaaaaccaaaagatccccacaattggaattaagtaccacttagtttgggtgccttgcataaccccaaaaattaagaaatcgaggactccaccgtcagtattgccaatgttaacccctaacaagctgaccactaaggctccaaaaccagtcataaagacgtggaaaagccagagaaacggactgatgaagaggaacaaaaattcaattggttccgtgattccagtaataaaggtcgcaatgaacccggaaattaatagaccctttattttggcccgattttcaggtttggcagtatggtacatcgctaaggctgcgccagggagcccaaacataaaggtcggcatctttccttgagataaaaattgggtcgcactatgcgaaattggcaaatgattttgtaattccgagtagaaaatgttgagggcccccgaaacttggtgaccatcgatcaacatggtgccacctgcttgggtaaaccggatggtggcaacgagaatgtgatgtagtccaaatggtaacagcaatcgttcacccgagaagaacaacattggtccaaatggtccggcaccgtgaatcaaggcccctactccgttaattaaaaaggcgaataccggccagataattggcaaaatgattcccacgacggccatcactaacgacgtaatgatcggtacgaaacgcgcaccgccaaagaaagcgaaactatccggcaattgaatcgtgcaatattttttattcaagttatacacaattattccggttataattccgcccagcacgcccatttcgatggtttgaacacctaaaactagcgattgccccgccttttgcattgcatccgcgtcggcaagttggttagttaaacctaaataaaaattaattgctaaattcattaccatgtaaccaacgaacccggaaaatgcagcaactcccttttcctttttggcaagtcccagaggaatcgccatcgcaaacattaccgctaagttattaaaagcaaaaccgccgatggccgacatgtatttaaaaaccacttggagaatgctatttcctaaaaatggaaatgcatcaatagtggttggactagaaaaagaacttccaagccctaataacaaccccataaatgccattaaagcaactggtagcataaatgtttttcctagttcttgaaaaaatcctcctaaagcgattcttttctttccctttgacataaaggtaacctcctatgtaatcgttttattgatctaaggttaccatcgaaaggacagttagacggtaaaactagaaaaaaagaccgaaactataacgtttcgggcttttttggtgtaattttacacaattttaaatagcgctggaacaaggactgtaaaatcacaaacatcggagttttatcagtaacttcgattcctgcaatataagtgacctccgtcaagcaataaatagcaacgtccgcgattgccgctaacgaattattcgacagattagttaagctaaccacctgatgtccccgctccttggctttttttgctaaattaacaatcgcaggtgtttcacctgaaattgaaatgaaaaagaagacgtcccctgctccattgttaatccggctcaacacctctttttcataacctaagagctgaaatttgctatctaaaacttgaaaacattctacccctaattcagcaattaaatgggtttgatcttgcgcgtaaaagttaactaaccgtgctttttggagtaacttagctaattttatttcccgcttttcatcaactaatccgaaattttcctcaattaaggccagttgttgattgccggtttgcttttcgaggagttcgtggcgcagttccacttttaattcggtaaatccgccataacctaacttacggcaaaatctggtaatggtattgggcacggtaaaaaagcgttgcgccaaggtaacgattttcatgttaactacctcagcttggtgtaccaaaatatactcgacaatattttcttcagtttccgtgagcttatattcgagattttgcgcgcgaatggcaaacttcatttctttaaacttcctttgggtagatattatttacgtccgcaaatattgatatcctattatttccaaaactaattttacatgctttggctagtttaacaaggttctgtgtaaacattcaccctaaaaaaattacccatccaactgacagttttaaatgctgcatagtcgaaacgcgttatggaccccagctctctgcgactaaccaaattaggaaccaatcgcctaacccgcgatcagtccctaattctgttagtcctcaagagctacccgggctccagaacgctctattttattttcgtcggttcgtgcgactttgaattctttactatttttactagttggttggtttccaactggtccaccaccatatctgatgctgcttccagtagttggtccgttaggttttctgcatggcgatctggtcttgatttaccaatcaaactaattttcttatttagtaaatcaataaaccggtcataggcctgctttggatactcacttgcagttacccggtcaattcccgaacgaatctcttgaatcgaaaaggattgctttagcaacgtcaacaagaggatgtccgcgatttgcattacctgatacttcttcttcgctggtgcgacaatcactttatttttcacgtagttgttgatcattgccggcgtcactgcttccaggcctaaaggtcccgtgtattccgtcatcaacgccaccacttggtccatatacaaatcaaaatttggtaaatcatcccagtgtggtaattccacccggctgactagttccaaccaccgttgatattctttataattactcattgctaaaacctccttatttgtatttgttttcttttattgtaacatcattacctagttttataaactagattacctcgtgtaataaacaataattatcaaaagtcatcttttatggtaatctattcatattattcacaggtggaggaaagtaaaatgtttgatccaactaaaaaaagaaaagttgctgaagaagttaaggaacagttcccaagcgaagtaattaaaggcttgtgggatacgttgaaacaaatgaaaaaggaccaaattctggttactcccgtaattgcgtttgcctttagtgatgattttaccgatgacgaaatttacgttatgggcctgcaaaactcgggcgccgttgctaaggaatacactatcaaatacagcggttcgaaggactttcttggcaagggaaccatcgtggtcgtccaagacaaacctaaaaacattaccatgaagattagtgacgtcaataagcaatagttgctaaaaaagagtgtgggacaaaagtcgagtagtttgtgagcactaactaaaaagcgatcattatgcctaaattgggcatgatggtcgcttttgggttaagcagaacaaactgacttttgacttcatttaaaagacaaaatcctaaaatgattttttaactgcttttttcatcgcctacggtaaatcgttgcccgcagcgtaataaatgtcgtaccattcttgtccggtaagctccacgtcgctaccagctgccgattctttaatccgttgcggattcatggtccctaataatacttggaattgagcgggatgacgtaaaatccatgccgtggcaatggcattcttggttaccccataaatatccgcaatttcttgcattttcttattcaattcggggaacttcggattatcaatgaagactccttcaaagaacccatattggtaaggtgaccacgcttgaatcgtcatgtcatgaatccgggaatattcaagaatctgaccatcgtggttgacactccggtcgtcagtcatgttggtgtgcatgccaaagtcaatcatccccgtatgcataatgccaaattggagctggttaatgattagcttttgttgcaaatatttttgtaatagttctacttgcatcgggttaaagttggacaccccgaaatgccgtactttgcccgccgtttgtaattcatcaaaagcttccgcgatttctgcaggttccattaacggatctggtcggtgaagtaaaaatgaatctaagtaatccactcccaagcgctgtagttcaccatctaccgcggcaatcaaatgttgcttgctaaagttgtagcggttgccgtacggaatgtccccatcattttcactgacaatgccacccttggattggatgtacagttcatcgcgactagccttagctagcttaagaccagccttaaattttgcacttgatgctccatgcccgtataaatctgccgagtcaatatagttaatccccgcatctacagccgcatcaattacttccgcggccttttcgtcggagagcgcatccatccgcatgattcctaacgctacgttggaagcgtgcatgccgcccacgttaatttgcttcatttccatacctccagataaatctaaagtttcttaaacaacatcatcataccaccaataaaagcgattacaattatcacatttttcaaatcgttttaatttttattaatgattccttgaaatatcccgttagtttcggtaaagtacggttcttggcatactaatttgaattttaacgttgtataatataacaataacgagaaaaaagaaatggggaattatttttggatagcggtcagatagtctctaacctgattgtgatacttatcacttttatattagcttacttcttcgttgccgccgaatttgcccttgtgcaaacccggcctagtgccttagaagaagccgaaaaagaagcaactagcgcacgcaagcaaaagaaatatcgattggcaatgcggatggttagtcgcctaaacgaatatctttcaactactcaggttggtacctcaatctgtgggatcatcctcggttggattggtgagtcaacggttgaatatttcgtggtcgaactatttggggctacacacatgattaacagtgcctcgctgcacattgtgggggcagtaatcggggttctactactaacttacttagaagtggtaatcaccgaaattgttcccaagaacatcagtatcgacattccgttgaaggttttgatgtgggtggtaactccgcttcactatttccacactgctttttatccattcgtgtggttactgaacgcttcggcaaacggaattgtccggttaatgggaatgcagcctgccgacgagaactcagaaatcttctcccaagcagaaattttaaacctttctaaaaacgcggttagcggcggagaattagacaaaaacgactacgtttatatgcaacgagcctttgattttaatgataaggtcgccaaagacatcatgatcgaccgaactcaattagtagttttagatgtcgacagcacggtagacgatgcgttacgccaatacttacaaagtcgctttagccgtttcccagtagttgctaataacgataaggataaaattctcggttacatctacaactacgacattattcggcaaagccaagtggacggtaatattaaggtcagcaagttattacgtaacatcattaccgtgcctgaaacgctggcgttgcaagatgtcctagaacaaatgattaaaaaacaagttccgatttccgtagtggttgacgaatacggcggaacaagtggaatcatcaccgataaggatatctacgaagaagttttcggcaacatcaatgacgaaattgacgacgtttctggagactacattcataaagaagctgacggttacttcaaggttagcggaaaaatgacggtgtacgattttgaacggtactttggcattgacgtacccgactttgaagaagaagacgtggttacccttggtggttacgtcatcgatcacaacccggaaatcaaagtgcatgaacacgttcgaattcaaaactatgatttcgaagtgcttgataacgaaaacgcccatatcgactggttcttggtccacaaactaaaacctgaagagctcgccgatgtgccgccggtcgttccggaagtagatcactttaccgattaagctaggtacacaaaaagcagggattatctccctgctttttattttggctaaaaatcgcttctaagcgaggtcgcgccggttaaatccccaataaccaatgatcattaaaagtaacccgagcgctatcaaaacaaacacataactgtaattaaccttgtctaaaggaaccatcttggtccatcctaatccggtaagttgcttagtccaggctggtagtttaagtagaccgccaagataactagtaaagaatgcgtaccccagatacaaccaggtaattccgtttaacttcggcgcaattccgttaaaacagactgccaggccaacggtcaagataattgtgggagcaaaggcaatgaaagtttttacgtatgctgcaaagctaatgtcaccctgggtcagcacccaatttcccgcaacgtcaactcccaacagtcctaccgcaaaacctagaacaccaattcccactccgttggccacgtacccagtcaacaagcggttgcgcgaaaccgccttagcatacacgttttcaagataaccgcgttgttggtcaccatggagtttattaacgctcatcactgctggaatcgttcctaaaacagccataatcatgccaataattgaaatgaaattaagtaaaatttggtgactagcactgtggattgccgatttttgcataacgagttgcatggtcgggttagattttaaaatatctcccaccgtatcaaaaattgaaccgagcattccgcctaggataaatagtgaaaataaccaaatccaattactatgacgttgtaatttttcgattaacgtaatgggtccttgtaaggtacgtgctgcgcgggcccgtcccgcagatccctgaaacatgcccgcgcccacgtctcggctttggttaaccgccaagactgctaaaccaatcagcatccctaagctgaacgttagaaaaacgggcgtccagttattgtcatgaaaagcttcaattttttcaatccatcctaagggaacccaccaagtctggtcaggatttttaaggtcggtaaacatccgggcaacgtacatcacccccaaaatcatgtaactagcaatcgtcgccgaacgagcgttatcaaaaacttgagccattaataaaccaaccatgccaaacagtaatcctccggctgctaaactcaagccaattaaccacgctccattcgcgttaacccccgccatagaactaaattggattgctaaactatatagcactcccgtgaccgcattgattgtgaatagttccgtgagcgctgccataattatcgaccagttaccaacgtcgtgagcgaccaccaattccgtaagaccttgatcctcctcgccacgagtagcacgaattgcaaaataaatgttcattgcaatcatcgcaattgccataaataccaacatctcggttgcaaacaggtctccgctagtttttaacggggtatcaaacgtcccgaaaaaggcttgcattgccggtgtgttgagggtcgctttgatggacgcaattgcttggcgagttccgtacagcgtttcaaacttgaacgccacgctagccatcagccctgctaatactaagacccaaacgccaatgtttaaacgatcacgacgtaaatttaacgcagtcaacagtccgtaacccttcattttatttttcatgatcaatcaccttacgttggtttgcgtcctgtttgtagtatctgagaaatagatcttctaaagttggcggagtgctttggatcgctaaaatatttttctccgtcaaaattttcatcacttcgctaatcgcgtccgtatcgacagaaaaactaatttttttcgggttccgttgatcaacctcaaatgcgtgcaccccaggtatatttttaaccgtttcagcatcgtctttagtagtcacggtaatttgtgtgcgggttaagtgccgcatttcatctaacgttccctgctcaataatgattccttcacgaataatggcaattcgatcacacatccgctccacttcagataatatgtggctagacaatagaattgcccttccttcgttcttaagttttaacacttcctcctgaaaaacctcttccatcaggggatctagccccgaagtgggttcatcaaaaatgtaacactccgcattttgggaaaaagccgcaattagcgccactttttgccgatttccttttgaataagttcgcgcctttttcttcgggtccaaatcaaaacgttcaattaattcatcagtccgcttagaatgcttttctccgttcatttttaggaataaatcaataatttcgccaccagtcagattaggccacaaatatacatcacctggtacgtaagcaagtctgcgatggattgccacccgattttgccaaacatcttgatcaaacatagtggcttttcctgcacttgctttaataatccccagtatcacccgaattgtcgtcgtttttcccgcaccattgggcccaataaatccaaaaacttcaccacggtttacttgaaaagtaacgtttcgcaatgcctgaactttaccaaagttcttttggatttgttgcacgtctaataccttttttggattcatcatcagcgcctccctgctaggacctctttaattccaacatagaatacgctctgcgggtatataagtcaacgtaaatatatggggatttttcctttgaaaatcccttattttcggggttctttgttgcatagtcaaaacgtgctatcaggaccagcttcttccggttaattaaatagaaaagaccaatcgcctaaaaccgcgattagtctttagattccgttaatcctcgagggttctctgctgcctagtcaaaatgagttccagcccctaacttcttccggttaaccaatataaggactaatcacccaacccgcgattagtccttatattttattaatccttgagggttctttgctgcatagtcaaaacgtgctatcaggaccagcttcttccggttaaccaaatctaaagaccaatcgcccaacccgcgattagtctttagattccgttaatcctcggaagctaccagtcctgagagcactctaattaaaatacctctccaaaaattttccgattccattttccaaattactttccgtcaccgcatccgcttccttttttagcagttccgggctatttcccattgctaccccggtccctaccgcgcgaatcatttccaaatcattcatatcgttaccgaatgccaacgttctttccaccgggatttgatacttatccataatcgcgcgaaccgccgtagccttcgaaattcttcttggaatcaattccagattgtttggcgacgatgacgataccgctagcaatttggttgccatcaaacgttccttcgcctcttgcaaacgtgcggaaggctcatcatcaattgtgatcccattaataatttggctgctcaattgttggagatggtccaaatcttgaatcttttcaaatccccgatttcccattttatccgccatcacgcgaacccgtgctaagcgacttaggcgccacggctttttgttagtatagtaggtcatctcggtggtgaaaaagttcgtcgaaagtcctaagtccatcgtaatttggtaaatttccttcaacgcgttccatcctagatgctcctgatgaatatggtttcctttttggtataccgatccgtttgacgcaatgatttcaacatcatcgttgatttttttctgaattaacttcgctagcgacagcatccgccccgtggcaatgtaaaaaagtacaccttctcgttggagtcgttcaattgcctgtttggttgctggtaaaacattttggtgattatcaattaacgttccgtcaatgtccatgaatactaaatgtggtttcactaccttcaccccttacattactgcctattattgtactacattctggtagcgtttccatctttatcggcagtttaagtgagtttgttattaacccgtggtatcattttatttaagaggagcgtaaaattaactgtaacagcaaatatagtaaggagttctaaccatgaaaaatgaaattcaccttttgtacatctcgattgcgggtaatacgcaatctttcgtcgacgatttaagtgactacgccgaaaaaatgcaccaacaagacccgaaaaacccgctaattttcgctaaggaaatcacggacgaaacggaatttgctgatgaagagattccttattttgccttcgttcccacctacttggacggtggtaacggcattgacaacggcgttaaggaactaatgactaacgtgttgggtgaatacattgcctaccaccacaaccgcgaattatgcctcggcgtggtggggagcggcaaccgcaactttaacgaacagtattgtctaactgcgcgccgctacgctcgggattatggttttgaaatgatcgacgattatgaactccgcggaactaccaaagactgtgaacgtatttacgctaacatggcagaacgtgtcgaagaagaaattaacgtataaagagaggaattaagatggaacgtgcaagactcttaccaatcgcaactggattaaacttccgcgaacttggcggctataaaacccttgatggcaaaacgattaagtggaataaaatcgttcgttcgggacgtctatccggtttatcccaaacggacctagattttttagctaactatcccatcaaatacgacgtggacttccgctccccggaagaaaaaagtcaggcacctgaccaagtccctgctggtgcaaaatacacttttgatccggtattcccggtcgacgaaacccaaagtactaagcaaactagtgatctacaacgtaaaatgaattacgatcccaccagcggactagttgaaatgcgccgagtttatcgcgacgtgatcaaccaatcccacgcacaaaaggcgtaccggaaattttttgatgttttactagctaatagcgacgaagactccgctttacttttccattgtacggcaggaaaagaccggaccggcatgggcgccattttcttcctttccgctctgaatgttgacgaagatacgatccgggccgattatttacttactaatcgagcaattaagcctcgaattgacaacctagtaatggacttgaagttacaaaataaaaattcggccttcattcaaagtgccaaggcgctccaatctgtgaacatctcgtactataattccgcaatggaagctattaagaaactttctggttccactcagaattaccttaaagaataccttcatttaacggatcacgacttagcggaccttagaaaaatttatttagagtaattaacaaatcttaataaactttgatatttttaaaagactaagttaacaaaaaattcacatttaccatttatgatatagaatgtggatgaggaggtagggattaccgtttctcatccgaaaatttattctgattactcctccaaaaagtacagaatgtagttttcaataacctactccccaagggcgccctaaacggcgtccttttttgttgatccggtaaatgttttcccttagctgcgttataataggcttaaaaccacagttaggagtgccctcgaattatgaagcctgaacgaattttagaccttccccacgccgtgaacctgcgggagctcggcggttaccaaaacattaataatcaaactatcaaatggcgaaaacttttgcgctctggggaattatcccgcctcaacaagcacgatggcgctgttttagcagattacgggttaaagtatgatattgacttacgctcgccgtccgaagtgacctggagcccagaccgcgttcctacagacatcatcgtccgttcatacccggtttatccgattcatgatggtgaaacctcggatatcccagctaaccagcatttacaataccaatcccacgtagaagccatgtacgatccctacttggtgatggtacttaacgaacacgcacgtctagcgttccgccaaatgtttattgatttattagctaacgaccaagaaaacgagtcccttctatttcactgtgcagctggcaaagatcgcactggagtggcaggaatgctaattatggccgcactccaagtgccatatagtaccatccgggaagattatttattgactaacttagtctatagccggcgcgaccctgacgaattgcgcaaacaaattgccaaccggcacgctaaccaactaatccaaaggatgaacagcgtcttttccgttgccgcctctagtttggaccgggctcatcagttaattattgaccgatttggcaattgggaccactattttaaggaagccttagagttgagtgaaaccgacttacaggatcttcgacggctttatctcgagtaaactaattcagttgcggaaacgtttccaagatggtaggatatgggcagcaacgataagataacgggaaggacctgatacaatggcaacaccagttgaagcaatttggcaagcatttaccgaacaaagcggcgttaagggggatcgttttcaaacacgatggtttggcccccaagaccagcccgcagagatcgaccgcctaaataatttgattctcaaagggcaaaaacgcgcaaccactaaaccgttagcttattattccgctgaacaggaagccattcctcaagcgggagactatttcgtactgctagacggtcagatgaaacccgtcgcggtaattcagaccgtggtttcggaactgattcccttcttacgggtttctgctgaacacgcttataacgaaggcgaaggagatcgcagcctcgaagactggcgcgagcgtagtttgcacaaatttgaaagattaatggctaattacgataatcaattttcaaccgacgatccggttgtaaccgaattgttcgaagtggtttatcgtcgttaaagcataattaaaaacagtgtggcaagggacaacttttactcaagttgttaacctacttttccacactgttttttatttatgaatgttaattttatattttccaaccactttacgcagacttccggcggtttcgatgattttaccttcgcgcaattcttgccacgtagcgttcagtactccaccaaacatgatgatcattgccgaaaaattaagccagaacatgatggcaataaaggtacccaaagtcttgtaacttgtaacggatcgcgcgaaaatccttaaataaaaggaaaagacttgggacaacaccatcgtgccaatcgttgcaaacaccgtcccgggaattacgtacttgaaccggattttagcgttaggcactaggtaataaagcaatgatagccccacgaacaggcccacaatggtaactggccactttaattgaccgaccaacgcaaataaatgggttggtaaatttagaataggggtcagataactgaccaacgtttgcccaaaactaaacaagaaaaccagcaccgccataatcgcaataatcaccaccgtaaggaaaaaggaaactacccggttaatgattggattttggtatttggcgactccataagcgcggttaacggttcgttgaaacgctgcgaccgcttgactagctgaaaagaccgtcattaccaaactaaatgaaaacagttcgccatttccagaacctaaaaaatccttgacgattggctcggtaatgttataaatggtctcaggcacggcggtttctatgtactctaaaacggtatttacccggatttgaaacagtggtaataaagttcctaacagcattactaaagggaaaaatgaaagcagtaaataatacgctaacacgatcgaattatttaccacttccgcttcattgaatcgcttcagtaacgcttttaagaaggtttcgctttttcttaaaaacaccttaaaagtcattattttctccaactacttcacaatatgtttacttaagttataattccggcccgcaatcatcgtgaccagccaactcaagatagtaatgataaaaaagactaaaaatgctgcccggtatcccgctaacgaagataactgccccgggaggcctgaaaatgaccaactttcggtcacgttttgtaaaaccacggatagcaccgtcaaaatcaaactggttgccatcagtttaaactgtccagcaaaaatatccgccatgttaattaacctccgggaccgcggccgttggttaagttgcttaccaacttgaatcaataaaccgtgtcctgcctcaatcaacatggttaaaatcacaaacaatagcaggttgagatacgttgaaaaaattgtcaaacatccccaacctaacatcatgatgcccgtggccattcgaatccgttttattgtagaaacgtttttcaacaatggaatggtcccgtgatgaactagcaaccgcaccatgattcctggaatcaacgataccccaatggcccacgttgcgtagtgcaggccttgccgtaagtatagcactccaattaccaataaacttgcaaaggaagctgctccaatcccctgtaaaagaactgctcgcagataacgtacgtctagtagccctctaaaatcaattaacgggttcttaacttgccactctcgccgcacgtaaagcgctaaacaaatcaacgcgctaagcaaaaagaaccagcgccaccagcttgccaaagctagaccagttttcgtaagtaaaaccatcccgccaatcagtaacaaaaagcccccggaaaggccgaaattaacccactctatgctatacttttgtgcttctagatcaatttcaatttcgtttgccatgccgtagacaattaagctgcctaagattaccaacaaattagcccattgccaagcgtgtaaaattaaaaagctcatccccgttaacagcaacgccgttatcgtcgccactccggtaataatatcttcgagttgattaaaatcactaaaacgactatcctcagggaggagggcgctaatcaaggtggcaaacatcggtagcatcattccgcaaccgaccgcctgaataatcctgcccactaacatgaggggcaacgtgtaagccagtccaatgatgaccgttccaataataaaaacctttaatgaatccctaaataacgtggtcaccgttcgcttctgcaaccataccggccctaacggatacattaatgctaagattgctaaaggcaagatgttcactagttgcacggtggtaccgccgttattaaaattgcgtaaaatttccgcaattggcaaagcagtactaaactcccccactaacatggttaacatccctaaaatcaggacggtaacgtggtgatagtccgcactgctcagctgactacgtaaacgttgcagttctttcataagtgcacctctttaagccaacttaactttaattttattaatttaaaaacctaaagtaaagcttccaagcaaactttattcaatcctgtttgaaactaagtaaaaaacgtgcttcaattaatttggtgactcgattatgacataggagaaaatacgatggccaaaaatacaatcgatgaagcaattgaacatttgagaaaaaagcatattcgcatcactcctcagcgtcgacttgttttggaatacctaatccaaaaaagaaaccatccgactgtggaaaccatttttcacgcattaaattcaaaaacccctaacttaagcttagcaaccatctacaataccctgaagttgcttgttgaccagggattagtgattgaattaaccagtggagaagatggtattcattatgattattatggacacccccatttccacgtaatatgtactaattgtggaaaaattattgacgtcgattatcctgattacgccgctgatttggctaagatcgaccgggtcgccgctactaagaccggatttgatattatcgctaatcacgtcgaagtcgaggggctgtgtcccgattgtaaaaagcaagggactatgggtaccaaatagcttaacgctttccgcaaattaagattgcataaccaaaaaagtgcttttcaagaatttttaaactcattcttgaaaagcacttttaatttgttttaagaaaaccaagctataggaaaaattcaattagcctactctggttttacatatttactttatgcttgggccaaagttacgatagagactttataaacgtcttcttcgctagcaccccgggaaaggtccgagattggtgcattcaaaccttggagtactggtcctaaggcttcaaagccacctaaccgttgggcaattttgtagccaatgtttcctgattgaagttcagggaaaataaagacgttggcgtgacctgccacatcggattccggtgccttcgtggctcctacttccggaacgaaagctgcgtcaaattggagctccccgtcaattggggttttaggatcgcgttccttagccaacttggttgcttccacaaccttatcaaccatttcaccagcggccgaaccctttgtggaaaagcttagtaaagcaaccttagggtcaattccaatcgaacgtgcggtttccgcactttgaatggcaatttctgccaatgtgtccgcatccggatcgatgttaatcgcagagtccccaaagacgtagcgttcatcaccacgttgcatgaggaaggctccactgatccgccgcatgcccggtttagttttgataatttgcaacgctggtcgtaccgtatcactagttgcgtgagctgccccagaaaccattgcgtctgccttaccaaggtaaaccaacatggtaccaaagtaattaacgtcttctagcattttaaccgcttgttccggcgtatttttacccttccgacgttcaactagtttatctaccattacttgcttttcatcagcaggatattcggcaggatcaataatttgtaggttagctaagtcaaggttatctttttgggctaaagcttggatgttttcctttgagcctaatacaattaccttagccaattcttcattagctaaacgaactgccgcaccaagcacccgttggtcttcaccttcgggcaaaactagcgtccgtttttgttctttaactttatttttaaatgtttcaaataatttcacaacttaatcctccatcttcttaaagcgttccacttcacgtgcaatcgctaattcttcattggtcgggattaccatgattttaattgctgaatctgcttggttgataaaacgctcgccgcgttgttgattaagctcatcatctagtttggcgttaaaaatacctaaccggttcacgactttttgccgaattggcacactgttttcaccaattccggcagtaaagacaatcccatcaaggccgcccatttccgttgcgtatgacccaatgtacttaacaatgtcgttaaccaaaatgtcaaccgctacttcagcacggtgattaccatcatccgcagcatctaaaatgtcgcgtaaatcaggcgataattgtgacaaacctaataatcctgacttctcgttgaggatttctagcatctttcgtggatccttaatgttaagtttttccattaaataaactaccaaagaaacgtcgatatctcccgaacgggtagccatcgtgatcccagctaatggagtgaagcccatcgatgtatcaaaagactttccatccttaatcgccgtaattgaacttcccgcacctaagtgcaacgtgattaatttcaagtcctccaatggcttttgcattaatttggctgcttgtcccgcaacgtaccggtggctcgttccatgtgccccatatttgcgagccccgtatttttcatagtattcgtaaggaatactatatagataatttttctcgggtaacgtaccgtggaaagacgtgtcaaaaactgccacactggtaatgtctggcaaaattttcttgaatgcgcgaattcccgtagcattagctggattatgcaatggcgcatattcctttaggtcctcgatatcttttaaaacttgatcattaattaacgcggaatcttggaaaatttctcctcccgcaaccactcgatgacccactccggtaatttcgtggtaatccttaatgatgtctagctttagaagttgttgtaacaataagtcaacggcttcttcatgattcttaattggttgttcaatcttagttttgtgtccatcggccgtcttgattgtaaaattagaacccggaataccgattcgatctaccgctccagatgaaatcaccttttcttcaggcatttcgaaaagcttaaacttcaatgttgaactaccagcattgattgcaattattttttccactttgtgattgctcccttacaataagacttattttatcagaatcagcccgtattttcccattaaagttattgtttagataactaataactattaaatcggcgtgctaccccactttacggcaaattctttatattaaaaataacaaaattagtgacgtttggggactatttatcccaatacctataaaaacatcttattccaaataggaaacgttttcaatcctttgaggcttttttgttcgaaaacagcgggaaataaaaaggagattaaggaaaaagctccttaatctcctgattagagttaacattttacatttcttcggcaaactcgtctaaaaaagtaccctttttagtttttaccttcacaaagttttcggtaacttccgttcgttttttagtacttaccactcaatttgcttgcagctgcttcatcaacgattacgataacattatcatggttttgcagtaagcttgctggtaaatcagtggttactggtccttcaatcattcccttaattgcatcagccttgtcttcaccgtatgcttccatcaaaatgtgcttgctttgcataattgaagccaatcccattgaaatcgcaaaacgcggaacgtcttcttcatgttcaaagaaacgagcgttagcatcaatagttgattgagttaatgctaccttatgagtagtgctatctgcaggagttcctggttcgttgaaaccaatgtgtccgttacgtccaattcctaagatttgtaaatcaattgggttttccgcaataatctcatcataatgttttgcttctgcttcaatatcttttgcgcgaccatttggtaaatatgagtgcttgaatggctttgcatcaaataagttcttgtgcatgaagtagttgtagctttgatcgctatcggcaggaagtcccacgtattcgtccaagttaattgaaattgagtctgagaaatctaaatcacttttaataatttcttgataagtggtaattggagtacttccggtagctaaaccgaacgtttttgctccgttcttctttgcgtcagcaaaaactttgtaaccttcttttccgccttcaacatcattttttacgataattaccttcatagtcagcgctccttttttctttttggtatagtccaattataaaatggtctaaaccaaaatgcaatagataagccaataaaacacaaaaaaataccaaatttggttttaattgtccaactttaagctacgccaacccgtctaatttgggattatggcgtaattgttgaaaacgtatacattttcaattatagttagggtaatcgtaggaggtggataccatgagtgaaacaattttctttaatcccggtgattcaatcggtaattttcacgactataacgaagcggtgcgtaagggacacctctataagcaaaaacagcggctagatgatgaactagtagtcgttaataataaggataaaaatgaggaatacgccattttttacgtaagggatcgccaacctaatcaagataaaaataatgcgtcgtatgatgtgcggagaaaaatttagagtgtggaagccctcgggcagagtttgaagattaattagattttagccttaattgcagggttagcgattaaggctaaaattttattaaccgcagaactttgagggctggaacacgttttgactttatcgcagtaaaactctagaacggcagaatatcggtcttaatcactttagcgattaaggccgatatttggttagccggaagaaactggggctgggtgcacgttttgactttattgcgtaattctccacatccttaatcaccaagcaaaaaaaacgaggctgggaaaaaataacttttcaaggatgaaaaggtccttaaaaagttattttggtgttttgacttcaacaaagcccaaacgtgtaccaaaagtcagttgttttcgcttaatcaaaaattgcccatcatgcccaattcaggcatgatgggcaattttcagttaatgctcgcaaactacccgacttttgtcccactctcatttttattccactaacactgtggagaagtttattcgtgtaactcaattggcaaaccgtccggatcaaagaaaaaggtcattttacgctgattgagctcatcttctcgaataggttccactcgaatcccctttgcctttaactcggcaacgtcggcagcaatatcctccgttttaaagcataggtggcgtaatcctgctgcttcaggatacgtcaggcgtttaggcgccgttggtttaatgaataactcgaccattaaatccccaaaacgcagatctaacttaacgtcttgcttatcacttcgtttggtttcttgcactacttgcattcccaactgctccacgtaaaaattccgcgcagcttcgtaatcagtacaaataatcgcaatatggtcaattttttttggtgacattaatttacctgctttccatgtttttcctatattttatcgggaaaatcgtttttttaacagcctagatagtttatagctcgaaaagattgacatttcccatgataacgggaaaatatgtagttgtacaaattatttacaggaggaagaattgaatgaagcagtcacaagcgccttcaaaaacaaataaaacgctgatcttaattgcgttgggtatttttacctttatgtccacccttgatggctcgattgtcaacattgccatgccaatcatgtcaaaggagatgaacatcagtttaagtcgcattgaatgggttgtttccatttacttaatcgtcatcagcgccctcttaatgttttttggtcgtttgggagacgtaattggtaaatcaaaggtatttcggatcggaacggccatatttatcttagggtccctccttgccggaatcaatctaggtctggcatttttactatttgcgcgtgccgtccaggctatcggagccgcgatgaccatgtctaacagctttgggattaccacgagtacctttcccattgaacaacgtggacgtgcaatgggggtaatcggaaccttcgttgctttgggcgccgttgccggacccgctattgggggacttatcttaaattatttgacttggaactacattttctggattaacgttcccattggaattatagccgttttaattggcgtaaagagtttgcctcacgaccagcccctcgcagctaacgccccaattgactggactggagcaattgaatttgcaatatgcattatcacctttttcttcgcaattcttcgcggacaagaacggggttatctaaatccgttaattcttggagccttattaattgccataatttcatttattttgtttattcataccgaaaatcaccggcgccatccgctgttggacttatcgatttttcaatacgctgacttcacgttagggctcattgccgcactcctcgtgttcatcaatggtttcttctacaacgttttaatgccctattatctagttaacgcccgcggtttgtcttcgggagtggccgggaccctcttgtcgatcattccgttgactatggtgattttcggaccggtaggaggctttttatctgacaaatttggtggcgctaaaatcaccgtaatcggcgtaacgctgctgttgatttctcaatttttaattatgggattcaacttgcaaacgccgtactggttcttcatttttgcatccatcgttactggaatggggaccggattatttcaatcgcctaacaacgcttccgtaatgtcggcggtgccgcataaccgcttgggaatagctggtagcgtcaacgccctagcgcggaaccttggaatgattttaggggtaacgatatccacatccgcattgttcctgttgatgagtgccaaggcccacactagcttaaccacctatccacacggaaatgaccaactattcattttcggaatgcatttttcattcgcgatttctgcgggattactcgcaattgccgacattattgtaattcggcggtggttgattacccggcgaaaaactttagaagcataatcacaagcataatttttaacttccgctccttcttgcgctaggattagctcgtaggtaagatacatgcagtcaattttattgggaggccacactatggaaatcaacattactcaatcagcacaagaatatttaaatactaaaaacattggtcaacgtcacgtcttcttggcgttagacgacggctcaagtaaattctctaagttaggcggttcgtgttcaattggcaacaagttccaactagtggttgcggacaacgaagacgctgactatgctgaaccagttgaaaacaatgccgggttgcaacttactaccggacatgacgagcccacttatttaggcgaaggccttactcttgattacaagatggggctgctttcacttcgcgacaatagtggaattattgacaacgccgttacggtaacgaattttgttccccaagacaacggaaacggtaagcaacttaagaaagacatgcaagaattaggcaaccgaatttgctaattaaacatagttaagaaaaagcaaacgggacaaaagtcagatagtttgcaagtactaaccaaaaatcgactgttataccaaatttaggtataacagtcgattttttaattaagcttggtagttttcaatctgacgagcggccgctagtccaaagactaccgtttccgcaatcgagttacccccgagccggttattgccatgtaagccgcccacggtttctccagccgcataaagccctgcgatgggctgtagttggtcatctaaaacttgggtttctacgttaacttttacgccgcccattgtatagtgcacagctggagctaccggaattgctgcaaaaggtccggttgcaaagtcatctactaagccggtggtgcggccaaattctgcatcatgctgttggtgaaccaccgtttgccaagttgccatcgtagtatccaatgcagcttggggaattttcaattgatcggctaattctgcaaaggttgcgccatgggtgaccaaaccgatttggtcgtaaaattggacggcaaccacccggttaatcaacgattgattaaaaattagaaaagcgttggccgggctttgcgcgttaatcgccgccgtgacttctttgcgggtggccagttcgttaacgaatctgcgtccttgatgattaacaagaatcgcgccctcgccacgaaccgtttcgccaattaaaaaggttcttgctgaatcttgatagacggtgggatgcacttgaacttccgccatatcgattaattgggcccctaattgttgtgctaaccgcaggccatcaccggtcgcccccggttggttcgtagtgcggtaatgcagcaaatcaggtcggtaatgagcaattaaatcttggctagccgaaaagcctccggttgccaaaattaccgtcgcactccgtaacgtttgtcggtcaccagcttggttttcagcaattaactgaaaatctccagattccattcgcataatattcactaccttagtttgacaaaggatcggaacttgtttttgggccaaatcatctactaagtgatgaatcaagtatcccccaattgccggagcgctacttggtcggtgggctcgcttaactgacatcccaccagttaaggtcaaatcgtctaaaacaatcccatgttctttcagccagtccactgcttcagctgcgtgactagtaaagtagcgtaacatgtccacgtcatttttccgcccgccgccccggtaggtatcttcaaaaaaggattcgtaagtatccttaatccccgcgtgctcctgaacaaccgtcttagcagcgttcatccctgaagaagcccgaatagaattccctccaggcttagccattttttctaaaacaattacccgttttcccgcttcggccaacgcgagcgcacttactaaaccagcgctgccagcacctacaatcacggtatcaaattgcttttcagcggctatcgattgaattgattgggattgtgtcattactccgcctccgttaatttttcaccttaaaatctgcaattcgttcaaacccgtatcgatccattgcggcaggcaattccgtgatgacgtcgtgacacgcccgcggattgccgtagcttgcggatccaatttgaattgcttgggctcctgctaccatcaattctaacgcatctgcgggagtaaaaacgccccccacgccaataattggtaaatcggttacttggtgtgcttggtgaaccattcgcacggctaggggatgaatcgccttgccagaaagccccccagtaccgtttgataagtgcggtttgcgggtgtgtagatcaatctccattcccatcaacgtattaatcatgaccagtccgtccgctccgcccgcttcggcagcaagtacgaggggttcgatggcggtcaccgcaggagttagtttaactaacaccggacagtccacctgggccttaattgcttgggttagttctcgcaccatttgcggttccgttccaaaggcaattccgccttcctttacgttcgggcaggagacgtttacttcaattaatttaacgttcggtgcgctagccatacggtgtgcgaccgtcacgtactcttcaaaagtacttcccgcgacgctccccacaatcggtagtgttggaaaattattggctaaccagggaagttcttcacttaatacgtggtcgattcccgtattctttaacccaaccgcgttcagccagcccgcgctggtttccgccgttgtgggccacggattgcccgctcggggagtttgggtggtcgatttaatcactaaggcccccaattcgtttaaatccattttctccgccagggactgaccatacgcggcagtaccactcgcattcataaccggattttttaacgttactcccgcaatttccgtttctaagcgttgcataatcttcctccttataggtgaaccgtagtaaaggcttgggcttctaacacttgtaaaatggcatccaccgtatccaaggcggtaaacaatggcactccgtaggttagcgcggtttgtcggattttaattccgtcgttggcgctatccggatcgtcagcaatggtgttaatcaccgttctaatttcatgttgtttgatttcgtttaaaatttgggtcgattccgtcagtttttccaccgtttccacaggtaaaccgttttgtttcaagactgccgcggtcccttcagtagccactagttgataacctagatcccagaagcgtttagctaaaccaaccacttcttccttatccgtgttgcggaccgttaacaaaactttgccgtggtctggtaaatgaagttttgcaccctccaacgctttatacagtgccttagctaaagtacggtcgcttcccatcacttcgccagtggatttcatttctggtcctaacaaactatccacatcgtttagtttggtgaaggagaagaccggcgccttcacgtgaattaacttgcccggtcggtgaagccccggagttagcccttgttcccgaatactttggccaaggatggccttcgttgcaatccgagccagtggtaaatccgtgaccttgctaatcaatggaatcgtccgactagcacgtgggttaacttcaattacgtaaacctgttcgtcgtggacgataaattgaacgttcattagcccaacgcaccgtaaacaacgggccaatttagtcgcgatttccacaatttggttctgcacggttgttgaaagggtttgagccggataaaccgccattgaatctcccgaatgcacacccgaacgttcaatatgttccataatgcccgggatcactacgtcatgtccgtcgctgaccacgtcaacttcacattccgtccccactaggtactggtcgatcaaaaccggatgctggtgggaaacctggaccgcggtgtgcatgtagttttctaattcagcctggttgtggacaatttccatcgcccggccccctaaaacgtaacttggacgaacgaccaccggatagccgatttgattagccgccgtaattgccgctggaaccgtggtagcggttcgtccttcgggttgccggaactggttttccgtgattaactggttaaactcgtcccgatcttcggcacggttcacgtcttccaccgcggtacctaaaacgggaactccgtggtccgctaaggcttcggctaaattaatcgcggtttggccgccaaattggacgattacgcccttaggttgctctaactcgattacgttaagcacctcttcaacagttaacggctcaaaatatagtttgtcagacattgaaaagtcggtcgaaacggtttccgggttgttatttaccacgatggcttcgtaacccatttgacgaattgcttgaatcgagtggaccgtggcgtagtcaaattcaaccccctgcccaatccgaatcggacccgaccccaacactaggatggagggcttttctgaaacttggctttcgttttcaaattcgtaggtgctgtaataatacggcgtactggaagcaaactcccctgcgcaagtatcaatcatcttgtatactggttgaattccagtttgctgccgaaattcgcgcactcggtccgcagtggtttgccaaagccgggcaatcgtagtatccgcaaaaccgtaatgtttagcatcggttagccattcggttgcaaagggatggtcctgcaacgctggttcaatttcataaatatgtagtaatttatccaaaaaataaacgctaatcttagttaattgcgctaatttagtcaacgattcgccgcggcgcaacgcttcgtaaaggtagaatagtcggtcgtctcgggctactttaattccagcaagtaactctgtgtcgcttaagttagctaagcgtccatcatggagctccgccacgtcaatgtcgagggagcgcaccgccttttgggtggcttcttcaacagtgcgaccaaccgccattacttctccagttgccttcatttgggtacccaaacggcgatcggcgttggcaaatttatcgaacggccaccggggaattttgcaaaccacgtaatctagcgctggttcaaattccgcgtaagtcgagccggtcaccggatttaaaatttcgtcaagttgtaatccaacggcgattttcgccgccaccttggcaattggatagccggttgccttagaagctagcgcgcttgatcgacttacccgcggattgacttcaatcacgtagtaccgattctggactgggtcaagggcaaactgaacgttgcaacctccttcaatttttagcgcccgaataattcgcagcgccgcgtcccgcaactcttgaacttcccggtcgcttaaggtttgaaccggtgcgtaaacaattgaatctccggtatgaatccctaccggatcaaagttttccatgttgcagaccacaatcgcgttatcggcgtggtcccgcattacttcaaactcaatttccttcattccggcaatgctttgttcgatcaacacttgggtcactggcgaaagggtgagtccgttggcggcaattttccgaagttccgtttcgtcattagcgattccgccgccggtaccgcccattgtaaacgcaggccggacgattacggggaagccactttgtttagcgaagtcgaccgcttcggcaaccgtggtcgcaattgcggagtcaggaactggttcaccaagttccttcattaacgatcggaaccgttcccggtcttctgcttggtcgattgcatccaatttagttcctaatagttcaatatttagttcctttaaaattcctgattcggctaattccatcgccatgttaagcccttgctgacctccaagggttggcaaaatggcatccggacgctctttgcgaatgatttgggatacgaattgccgggtgagtggttcaatatagaccttatccgccacgtccgtatcggtcatgatggtcgctggatttgagttgaccaacaccgtttggtagccgagttcttttaacgacaggcacgcttgggtaccggagtagtcaaattcggccgcctgaccaataatgatcggtcctgatccaatcaccaaaattttatttaaatccgttcgcttaggcatgattagcgcacctccattatttttttccgttggtcaattaaccgcataaattggtcgaaaagaccgaccgcatcgtgtggcccaggtgccgcgtctgggtgaaattgtactgaaaaagccgggtacttttcgtgacgtaaaccttccaccgattcatcgttaatttcttcgtgggtaatcgtcaaatcggtcgcggcaaccgaagcgcggtccaccgcgtagccgtggttttgcgaagttaagtcgattcgcccagtagctaaattgcgcaccggatggttaaatccccgatgaccaaactttaatttcatcgtccgggcgccgttcgcccgggcaaagagctggtgtcccatacagatgccaaacacgggcacttgtttttccaccgtgcgaatcatttgtaacacgccgtctggaactgcttcggggtcccccggtccgttgcttaaaagcaccccgtccggattatttgctaagaccgtttgggcgtccgcatcgtagggcagcaccattacattgcaattccgccgcgcaagttcccttaagatggaatacttgaggccaaagtccaccacgaccaccttccgacccgttgctggattagggtacggccggggcgtcgcgctttgttcgattgggtgcgcgttcgatttgaattgctgaatttgttccaccaagccatcgcggacttcgttgactaacgccgccttcatcgccccgtgctcacgaatgtgccgggttaccgcccgggtatcaattccgctgattccggggagttcctgttgaattaaaaactcctcaaaagtcattttcatttgccagtgactagcccgtcgcgcaacttcgtgaaccaccactcccgcgcaactagaacggattgattcccaatcgtcgcggttaattccgtaattgccaatcaacgggtacgtaaacattaaaatttctccgttataggattggtcggttaaggactcttggtatccgctcattccggtattaaaaaccagttcgccgatgcgttcctgattggcgccgattgccgtgcccggataaaccgtgccgtcttctaaaactaaataacgcttcattttaaaatgccccttcgttcaaacttgatttgtcccgcaaccatggtgagctggggttgaccataaactcgttggccaatcaatggactgttgtgccccttcgatgccatcgccgcagcgtcaatttcatattcgtgatccacgtccacaatcgttaaatccgccaccgcgcctaccgttaaattgcctgccttccttaactgaaaggcttgggcgggattggtactcatccagttgaccaattggccgaccgaacaaattcctggtttaactagcttggtgtaaagcaaggcaaaggcggtttccaatccggtaattccaaaggccgccgttttcatcgaacccgccttatccgcgtccgtatggggggcgtggtcggtagccaccatgctaatcgtgccgtccagcaatcccgcaagtaacgcttggcggtccgctaaccggcgcaacggggggttcatctttaacatggggttgtccttagtgatcatctgttcatccaagaagaggtggtgtggggcgacttcggcagtcacccacactccgtcacgttgggctcgccgaatcagctccacgctccgtgccgtagaaacgtggcaaacgtggtagtgtacgcccgtttttcgcgcgatttctaaatcccgggctaattgtgccgtttctgccagctcatcaatgccgggtaaccctagttcttgggcacgcgccccggcattcatcaccccgtgctgcataagcgattcgtcttccacgtgggccgcaagcggcaaatcaattttttgtaaagcttgcatggcccggtacatcgtttgtgcgctttggaccccgttgccatcgttactgaaggccaccgcccccgcttctttaagagctgcaaagtctaccaactgatcgctggtccggttcttagttaccgctgcgtattgctcaatgtggacgcgaccgacttgttgattatgcgcaatcattttagctaaccgggtcgggtcatcgggaaccggatttacgttgggcatcgtcagcacggtggtgtatccgccccgtaacgccgcttggctaccggtagttacgtcttctttttcggttaatccggggtcccggaaatgaacgtgcacgtctaccaatcccggaagtaccagttgattttgggcatcaatgacccgttcagcaaccgtcgtctccgcaagttggggagcaattgcgctaatttgttgatcttccactaggacgtccgccttttgtagatggccgttagagactacccggccgtttttaatcaaggttcgcatttatttacgcccccatcaccaagtttttcgcgtttaggacgtcggtcaaaattgccatccgcatgtacatcccgttggtcatttgtttaaagatccgggaacgttggcattccaccagtttgctttcaatttcaattccgcggttaaccggagcggggtgcatgataatcgcgtgtggttgcatccgttctgcccgttgcttagtcaaaccgtagttggtcaaataatcctgaacttccattcgtaaattgtagcgatcctggatccgttctttttgaattcgcagcaacatcatgacgtcgacttggtcaaccagttcgtcaatcggccgataagtaccgtagtcagctaggtcttcagccatccattcttcaggacccgcaaagtagacttgtacgcccagcttatttagtagcattgcgttagaacgcgcgacccgggaatgggcgatgtcgccggtaatggccaccttcaagcccgcaaaacgaccgaattcttcgtaaatcgtcatcatgtctagtaacgattgagatggatgttggccgctaccgtcgcccgcgttgacgatgctgatgtctaaattctcgtccaaaattggttcgtagtaatcgttttggggatgccgaattaccgccacgtccgttcgaatcgcatcaatggttttcaccgtatccaacagtgtttcacctttggaaaccgaactagtttgtacctcaaattccaacattttcatacctaagcgttgttcagccatttcaaagctggtgtgggtccgggtgctattttcgaagaagaggttcatcgcgtaaaccgggcgctttaattgcaccttcttacccttcttgaattcttctgctaatttaattttgtgtaatacgtccgcttcgttaaagttttctaccgtagtcaagtcatgcatactcattattttttcctccttaagttatcaaaaaaggctacctgccaattgaatttgcttggaaggtagcctaaaaaagccgattcaattggttcctctcgggaaaccgatttaattgaaactaaatcttatttaattgttgtagttgcgccccattgccaaggatcctgatgccaggtgcgggccgaatctagctgggcaggagttagttgttgttgcgtagctaaatgatcaattaattggtgataatcgatcagactatgtaactgggtttcctcagccgcaaagttttggcgtgcgtccgggagctggtaactaaagatactcgcgacccccagcagttgagcggaggtttggcgaaccgccttgccagccttaagtacgctgccaccggttgaaatcaaatcgtcaatcaacactacctggtcagcggcttgtaaagtcccctcaatctgcttacccgctccgtgatccttgggtttagaacggacgtagatcaatggtaattcgagttcctcggcaacccacgctgcgtgcggaatcccagccgttgccaccccgccgatcaccgttgccgtcggataaaattggcgaattagttcgctgagccctgtggcaatttgtttacgtaacgcgggtttgctaattgtcatccgcaagtcggtatagattggcgacttgattccactggcgtacgtaaacggtgcgtcaggctttacctgaattgcttgcaattccagtaactgctgaataattgctgcttgagtttgtgtttccgtcatgtttgaacccctttatttggatttcgaaatcgctattttgggtacaaaaaaaccaccagtaagtaaaatggccggcgctaaccgcgtccattccacctaccgatggcgactccgttagcttgttgacctctcgggatcaacttaaagcgactcgattaatttttaccaatgatacacccctgaaattaaatgtcaagccacgatatggtaaaaaatagggcttgggacaaaagtcgggtagtttatgagcattaactaaaaaacgaccatcgtgtttgtatttagcataatagtcgttttgggattaaacgaaacaaactgaattttggcgcaggtgtggctctatttaaagtcaatataccaaaataatttcagttccttctcagcttccatttcacttgtattttaaaggatccgcgtagttacctacttaatctccccggccaacaaccgctcaatcatgtctaaaacgccgctgtggttgttgtccaattttgtgattagcttcgttgcttttttagcttctggttccgcgtttttcattgcataacctagtcgcgcgtgctgtaacatggcttcgtcattttgcgtgtcgccgaaggccatggtctcgtccatggaaatctgccacaaattctgcaattgggtcagtccataagccttagtcacgtgtggcatggtgacgtccatgccccccagtccactcatcacacaaccaaggtcatctcccagcgcgttttgtaactgctcagcttgggggcgcacatccgttatcccactccaatgaatgtcaatcttgtaaatcggctcgtttaccgccgttagttttgctaccggcgtaaggtgttgataaaaatatgcactgtctttccaatcggcgtcactaggcaccatgttggtgaacgcttgttgacgggtcgacaaaattagttttgcttcggcaaactccggagtgctcattaaataatccaacgcatcacgcagtaaggccggtttaaggggattttcatccaaaactttcccttgctcaacggtcagggcgccgtcttcagcaacaaaagtcaagtcgccttcaattcctgcaaaaacttcttggcagtgagccagttgatttccactagcaaccacaaatttaatttgtcggcgactaagttcgtctagttgggcctgaaaacgtgaacggtcaaactcccgttggtcatttaaaaaagttccatcaatgtcacttgcaattaatcgaatctccgtcataacatcctccttgttgagttactaacgtccgccagcgattttacttagctgtttatccaagtagtcccagagactatccgcatcttgtgtaaaatcctcagtaaagctagttccgcgaggtgcaactttaccagtgggcgcgttaatcacgtcatagactaccaactcgtcattttctaatttacaagtaaagtagtgcccgtccaaaatgtcgtctaataagtgttgggcattatcctggattgcttgttcaattaattgttcttcagcaaccgcttgaccctgttcttttaattgttcttttttaacccttacttcggtcaaatcgtgtggtacttgaataattgccatgcgcttttcccccatttaattactaattaaattcaattttaccatggatattgcgctaaaatagactagaaaacaaattaggggtgagcgaaattttattacaaagtattcaaggggtactggtaatcattattatggttgccgtggggtactatttagcctctcgacactggtttaacgaggattctaaaaagttgcttgctaagcttgttacccaagtggccctgccgccttacatgatcacttcaattaccaaagattttactaaagctgaacttttcaagttactgcccaacctttggtacccggttttatcaatgttcattttaatggggcttgcttggttaattgtgcgcttaattcacgttgacccgcgccatcaaggcttgtttacttccatgttttttaactccaacaccgtttttgtcgggttgcccattaacctagcaatcttcggagaacgcagcttgccgtacgtgttggtttattacatggctaatacgaccattttttggacgttaggggtttacttcatccaacgtgaccaacaacgccaaaccaaaatcagtctaaaaagcactttgcaaaagatcttctcagccccgcttttaggatttatgattggaatcgtcctgatcatcctaaacattcatctacctagtttcttatcgtctagcttcacttacttagggggactgaccatcccattgtccatgctgtttattggggtttccgtttacgatgcaggtttgcgcaatatgcgttttcaaaaagacaatttgggagttttacttggccggtttgtttttgcgccaagcttaatggctttgttagtaatgcccagttccatgcccctaatcatgaagcaggtcttcattttacaatcatgcatgccggtaatgacgaatgcgccggtagtcgccaagctatacgatgcggatgccgattttgcatcaattatggtgacggaatccacgttattatcactaataatggtgccggtgatgatggggataatggtgtagagtgtggaagcccacgggtagggttggaggattaactatattttgggcttaatcgtgtgcttgcgattaagcacaaaatttggttaaccgcaaaaccctgggggctggaacacgttttagctcagctgcagaaaagcatctaggattaatggaataagggacttaatcgtggctttggcgattgagtcccttatttgattaaccggaaaaagttggggccaaaagcacgtttcggctcagccgcaaaaaaacattcctaacaaagattgggactgtgaagaaaataaaaaatgtttttcaagaatggaaaattctcgaaaaacattttttgcgtggatcttaataaaaccaaatttgtgccaaaagccattttcccgcttaaccaaaaatgactattatacccaatccaagcataagtcgattttcagttaatgctcacaaacttcctggcttttgtccgacgctcattttttaataactgatgtctttaaattctagaagaaccacttgcttgccataattacgaaaattaataacaataccgagccgatcgtcgctgccgcaaacggtcccttaccgcgttttaagattacccggaagtttactgacatacctaaagcagccattgccatgcccaagaaaatgtaagccagtttaactaatcctgccaaaacgcctgcacctaatggtaagaaagttccgacaacactagcaaggataaagccgcccataaaccaaggaattgggagcttgcccttcacttgattagcaacgttaacttcattccgccgccggtgccagaaaccgataatcaaggctaccggagccaacaaaagcacccgggaaagcttggtaatgatggccgtatccaaactaaccggaccacccgcaccaccggttgccaccgcgtgggcaatttcatggagtgacccgccagcaacgactccaaattgggtcggcgttaaatgcaaccatgatttcaaaccaatttcgataaacgtaaagaccgttcctaaaatcgccaccacggcaattgccataacttcgtcttcccgcttttgttcctcttggtcagccggcacctggatttgtggagagattcccattactgcggccgccccacaaattccggtcccacttgccacgagcattgctaaattagattccacgttaaattttcgcgctaagttgtaaaccactaaaattgtcagaccaactattaaaaccgccaacaaaatcgtctttactcccgcatgcgccaaatcaattaagttcaacttaaatcccaaaaggatgattcctaaacgtaaaaatttgttagaaataaacccggtaccctttttggatttttccacgacctgtggactaaactgtactaacattcctaaaactaatgaaattactaaggcgccaattaaactaaaatatggtaattgggccaacaagctaccggctaacgcgcagagtaacgttactccaatagctgtccaaaagcttttttctttcaccaactttgccataataattctccttttctctttgtttattttgtaaacccctagcgaatacttttggggttactcgttttctagcacattaattatcctatcaaagttagtgaataaaatataattataatatataatcagtctatagatattacttatagggagaattacgatgattgataaccgctacgccacttttgctttattgtcgaaaaataaatcctacacgaaaaccgctaaggaattatttattacccagcctgcagtttcccaacaggttaagagtttagaaaacgaactccagctaaaattggtggaataccgtcacccgcatttgagcatcacccctgccggacaagctctagcgcgattcatcgaaactacccaacatcaagaaaaccaactggtacaacggctgcaacatcctgccaaagcaaccacgcttcgagtgggagtaactcattcagtaagtatttttatggctccgcaactgttgcgaaagtggcacgatcgctacacccatattcagtgtacggttgctaatacccgcaccattttgtctcaaattgacaccggaaagctaaatatcggaattttggaaggtaactttgacaagtccttatatagcagtcaaaccattactaccgaagactttgtggcggttacccgtgcttcctcgccactcgcccaacgttcttcgcttacgctaaccgatttattggacgaaccgctattgcttcgggaaaacggttcaggaacccggaaagttttcgaagattgggcgagtgcatttaacgtcaaaaaggacgacttcgctcaagtaattgaatttggaagttccggtgggatcgttaacttgcttcaaagcttgggcgtgagctttatgtaccgttccttagttaatcctcaacttgcagatcaatccctagtgacgctgcccattaaaggacttgatattagtcggccgattgccatggtatacgccaaaaatagtttcttcgaaaacgaataccggcaactcctctaagcatttatggcgaagagcgttataataaagttagtcttgataaaaatcatcagctattgatttagtttgctaggtttaacccggcaattatgataggatttatcatacatagatggaaactttatggagggattctttatgaatggcgtaacagaatttgcggaaaaaattatcaatttccaaaagaaaaataaccttacggatgctgacgttgcctttggaacacatctatccgtagaaaagattcaccgaatcaaggaaaactcgtacacgccgaccgacgatgacttaaagcgcatcaccgattttatgaaaaccaagtaagctcggcggcccgtttcataattcaaaaaagaacccgcgtaacttctagcaattatttactaatcgctaaaaactaccgggttctttcgtcctattttgcaggagggtaccatgaaaaaatttgaattttatcacccaattttgactaaccaatacagtctggattggcttaccaaaactaaggtaaaggacatttttgccctccgaagccatccccaaattgcacaacaagagcaccgctcggccgatcaggaactcaccgacacggttgcctacgttaaccaagtaatgcggcaagtaatgaataaccgcgccttggtttgggggatcacccgccgcgccgaccaacaatttattggcatcgcgggattaactgagtttgccgaccatcctcaacaagccaccatccaattcaccctgtccgatgaaacgttgcaggttgccgcaatgacagaggttttaaaacggctaattatttttgcatttcaagaattagaactatcgcaaattaacggggcggttgatcaggaaaacgtctcgcaaatacaagtgttgaaagaagctggtttttcccttgttaaaacgaccggaaccatccagcactaccagttatctagcactgacaaattctaaaaaccctaattaccaaagcgccgcgtcgccgttagattaacgcctactaaataaaaagctccccatagttgttagatttctgttatccaacaactatggggagcttttttagtcaaaactaatgcaaacttcgttccagcaaacagaaattttttactagttttaaccgtacggtcagttatttaaatggctcttaatcagtagttaaacatcatattgcgtttctttaattccatcattcattaagtcgtaagggttgtccatttcttccgcgtcccattctgaaaccccaataaccatggaaatggctaaatctgccaattctggacttttcttaatacttttttcaaatatatctttagttcgttgcgccacaattctgcctcctgcggcattactatataaaagtactgcccatgttggatcgttattatccaacaagtaggtaatgtcgttaccacgggtagaccccttaattacttctgaggtaacttttaacaaaagctggagttgacgttcactcatcattcttcgtaaatcattaaaatatcttattttaataatcaaagtggttaccggaatatcaaaccgtcgactagtttcaatgaataccccagcatcttctacatatgccacggttgtccgtaaattggtttgttgatcaaaagcacccttttctactaattctgcgtataattcattattagccttttgtaaggcgatttgactgcgagtcatggaatatagtgcaactgaggccaacatcggtattactaaccaaaaaattagcgtccactgtacttcacgattcaacccaaaatattcatacaacataaccacagtttgaaaggcaatgaacaccatgtttgctaacaagcttggaataatccccatgaagtaagtaataattaagattcccactgtgataatgaggtaaacaatatttacaactatattctgtgaaagcaccattaggacagctgcaatagcgagcattaataaaaatgcaagtaatccaacgtccccgtataaatgttctttactatttttgtttcgcatctttaggacctccgtttagcattgcctgttttctaaaaactaggtaaacaccaaacccgattaccacaattgctaagaaaacaatcccgagataaataatcaactgactgtttttgctgataatccgtttatgttctaaacctcgatcaatgtatttatttttcttaaatcgataactataatgcgcattgtcttgatcaacaacaattgcatcacccgtaaattgatcaatgtttttcttaaagttaatttgagtcgagcctaagtaacttgcctcaggagtagctcctgttactatcagcatccctttcttatcattttcaggcgaacgaattaactgtgcggtaccaatggtctttccataatcattttcaatactgagtttttcgttagaaacaaatcttttaaaattgtctgaatacttaaagtataagtctttatttagtgacttaattagcggattattagtaggcgttcccagaacaattaaattatcattggccattacttccttgctaggacgtttagtataaaattttatttttccagtattactcttggcataagctccaatcagattaaatatattcgttaaacttttaaagtctattgcggttaactttttaggcacgactaccgctaaattgtcatacgtttgattttttataaaaatcgttgggtaattagtaaatagtaagtcgttacttttctctgacttaactctcatttctgaattcatatctacttccgcccaaggtgtttcagaattatcagaagccgattgattttgcatttccaaatcaaacgccacccgaaccacaaagttatttcctaaagaagtacctttgggaacttctagtgtaacttcatctccgttagccttagcagccgttaattttttacttcctagcgtaatgtcattgacgtataccgtcactaaggaacgcttaaaatccaggttcttactgtaccgaaaatgcaatttcactttggaaccatctgcatttgtccgatcgttgggaagggagacaaagtagctagtttcgcggtgtccagcccccttaattttatcaataacgtttgttagtctatacttaccttcatcttgaatttcggatgtaaaagtatctgtcaaatacgaaactgtctcgatatttttattcgtttcattcattaattcggcattagcaaaaaattacgcagcttttttcagcaatttgtctgttttagccgttacaattagataatccccgtttttggtgtagtgtgttttgattaccgcttggttatcaacgtccttttcattaacttcttttttcagagactcaggcaagtgatcatatctagcaatatataaaatataatctcctttagtagcatccatatccgtgtctcgaaagacattgatttggtcattatctgtagtgatcacccttgattctcccgctaaagcagtcatactagcggttagctcacctttagttggttgattgggagtaacaattttagagtgctgatacgtgatcgtatcttgaccagaaaaatgatcatagaaagaatgcaatgtgttttcgggatcctttaattcatatttaaaattcacattggacccggctttaatcgttaaccagttagctggcgtttgcgctaaattgtaacttttagaatctttctcgtttaaaatttgtcccttaatttcaagcttgttagtcccctctaatagttccagagggatttcaacttctttactctgaaagccacttctgtgagcaggtctaaaggagaaaaatttgacaccgtttagcgaaattgtaatgtcagatatctctttatctgctaattgagatacttgataattaaaattaaaagttgcctttttaatgttccagtaatccatcttggtaaaatacatgctagttgatgtagacttcccagataacgtcatcgtgtcgttttggaagttttgtgtataagttaagtcctcagcgtgaacttgactcacattaatcaacatcatcaccaacatagttaatgtcaaaactactattttacttataacgcttggttttataccactttgcttgtttatgaaagacttgttcacgaatataccccaccattccatatgctgcaactgctaaccacatttgactatatactaaatacatgaaaattatataaataacgttactaaaacgcatttcacctttttcggtcgtaactgttacaaaagtgctaatgataaacataataattccaaatacccataaagtattactaaatccttgtaagtcggaatgtgctaacccagccaccgaaagcacaaaaactacatctgacaatattagagcggacatcaacaaaaagtatgttgataaaaagtatagtaaatcaaaccgaatcggacgacctgcttttttgaaaagtaatttagcgttctttacgaccacgtaaatatttccctttacccagcgcgtacgttgatgaaaccaaacgtctagggtttgaggttcctgctcccaagtaacggcacgtggctggaatttaatcctgtagcccatttggtaaactcgaaagctaatctctgtatcttcggccaaagctttaacatcccatccgccaatcttttccaaaatttcccttctaatcacataattagttcctgggatagtgcatagcttaaatagcctttgtcgtcctgcttgagccatccattgaaacgaaagggtctcaatgttaataaacctggttaaaacagtcgcttctttatttcttgttctaaattttccaattacagctgctaaacgatcactttgtagaagttccgctactaaaagtcgcaatgcgcttcgttccggagtattgtctgcatcataaaccgcaataacactccctttcgcttgttttaaaccaatattgagcgcgttagacttcccttttccacctgtaacattatccgtattgataaccttcaagcgttcctcaccaaaatctttttgtacccctcttaatagttcagctgaattgtcacttgaattatcattaataacgataatttcataacggtcatgcggataatcaaagctaagaagtgataacaccgttttaacaattacaataccctcattatgggccggcaccatcacagtcacaaaaggtatctcttcaggaagatttttatcaggcttggggacttcttgtagataccaagtatatccagcaaccgttaaaatcaaattaattatcagcgttccccaaatggcaataattgcaaccattaggaaaaaatctaaaattgtgattactctctcctcctatctcttgaacatgtttttgtatatttttcttccgaacgcaataaaaatggctaacactaaaaaaataatcgcaaagaaaactgtgataatccgtccttgaactttgaaaaattctttaaagagtgccggtgttcctactggtttaggtaaacttttctcttcggcaacagtttttacctcagttactttaccatttactgagtattgtccgttttgataagcaattaacgaacttgcaacgtcaatctttgaattaaagtcttcggctggattctgccacgtaaaattcaacgcatgaatttgttcctttaggttctttagtctcaccttgctatccggcatattaaaagttaaggcgataggcatcgcaaacctgacatcttcttgatttttgattttgttaaatcctgaagccgcaagtgctaggtaactacggctactcgtttcaccctggttatcctgtttcaaataaactacttttttattaggaaatagcatccaataatttgccttttttaaggcgttatttcgtaaaacttgatcctgatcccaaaaaccttgcgcactaattccgactggataaacttgattttgagccaaattaagtaaataattgtcgaataactcacttaattcagatgcgttatttaccgtcgctcctccaattaccggagcctgcaggaagattacaccaccacggtcctcaattctgcgtaaacttctagtaaagcgtttataagcatccatttcggtatttttcgctacggttgtggtgctaacagcaaagggcacaccaagattttcgcaatacgaacttaattcatccagtatttttaaattactgtaaggtgtcacattagcgattgttaataagggtttagtttcttgctgtcgatcaaataaagtagcaatcatttttccagtcgtaatcaaccctagtcctgtattattgaagaagggtaagtatccttgattccggttgataatcccatacgcatatgactgctgatctttgtcttgcgtttttaattcaccatacctttgcacctcttttggaattccagtcaaaacgtccatccgatctacaaacggcatcatttcagtactattaccatcttttagaattaattgttgttggtagattgtttttagtttcacttgtagttgttgttgttctgttgtatcaagcccttcaccaatatgtaatttaattccatcatattgatcacgatctttaataaaacctggattaactagctgggcctgttcccaattaatcatggttattacgccttgatagccatgacttagttcgcctttttgatattcactctctttaatagttgtgaccttgagacctattccagctaatattctttgcaaagtgtcaatctttttctcaccttgttcaacagtattttgagagtcatacaccaacaaaacatgattactgtcacgcttgctcccatacaccgtttgatttgcttgaattattccactgaaggcaatcaagaaaatagttaataacggaaaaaatattttacgcatcttcgttttcctcccgttcagttagccacagttgatcattcaagatatcagaaataaacattatgaaagttaggtctaaactaagtggtaccatgaacaaatgttttgctaaatctgcatctccatctccaataatcgaaacaattggaacaaatacacaaattgtcatcaatcctaatactaggaaaaatcgcataactcctagaagtcttccagccgtaaaatcgatatacgcactaactgcatatacacctatgaacgttatcgctaaaagacacaagaaagcatacttcccggggaaaaaagctcctgctaacgaactataaaatgtaaaaaacgtactctgctgccccggctttttacctgaatctttggtataatctcccacagctttgacctgggtgaccatgatatctttactagcaacatctagcaatcgcaaaaattgattaacatttttagcataatacttaacaatccaggcaaaattatattttgccattaagtgctttttaatgtatggagaacttggatcactcgtatcaaatgtttttgcatagtagtcctgttcccgcatcaaagcgaattgttcgctcaagccgtttttggcgatatttttgctggggtcacccgtttccatcaagacgccatgagaaaatgcttgatattgattaacatcgttaaactctttattgattaaactgtacgttaaaactcccgctcctaaagtagccagtaatccaccgattaatgctagttttttagctttttttaaacccggcaagaaaaacaaaccaattgagattactccaaagcttaaagctaagggagcgttttgctgtttgctagtaattaaaactactacgctagtaaaatatagtagtactagtttccaacgtttggagtactctccacgagccaataatataactgaagcaaatgcatacaaaaacgagattaacatcgctggttcggcaaaaaaggaattaaagtataaaacaaatgacgcatccccaaaaataatcaccactaaaatagcaatgacatagcttcgaatacgtcgccaagatcccgtaagtgccttggttagtaaataaattcctggcaaaaatgctacataatataccgcacccagaaaacgtatatcaaaataacgttggctataaaataatttatttaacataactgcagctttgacaaaaagtgcttgagaggtaaaaacagcaacattattttcgttaaaatattttaaaatcccaaatttagttattacgtatccaatatactgactacttttagttggcaaacgataaacgccgttacttaacattgcacggtaaaaatccccattatccgcgtaaccgttaattggtggcacaaaaagaatcacagcacaaataaccgctgctagcatagttgccattgcagcgggtgatacatgattttgaaatatcttccaacatcttttaaccgaaaccatcttagaccatccctatgattgtgaagctaacaatgctagtaaattattaaatgaataagcgtcattattcttagtatcgccgagtgctccataaatttccgattttttgttttgaacctgatcttcccagaccaatttcattgccttttggtaatatttgtagttgccacttctagcaaaaatcattgcagctaaagcatagttacccgttgactggctatggtcagcaatcgctcctgcggttgtatagctgttgtataactttttattatcaacttgcatttctaaccaattagctgtctcagtcttcatctttcctatctcagctaaatgtaataccgtgattaaagcctcggaagtattaagattttctgtaccatattggttagtcttccaattgtagtttggagcatacaaaggaaaaatatcccctaaatatccttgcttgactagctttaactgcttttggtaataatcacgttctttctttgatacggattcaaaatactttaaggtggctaaatcgtagtaagctagtgaactcttattactagtttttttggtacgtacgtcataaaaatcaagcactcggtctttatgaatacttgttgtttgaagcatcgcaaaccgttttgccgcttcccggcgatatttttcactattcgtattttgtgcgtagatttgtaaagctcgaatgattcttaaatcatctattgttgcgtttacatcagatttcttcttggttttatcatcgattcgataactaaattgtcgaccttgatcaaagtatttcttagtatgctgataaaattcacgaaaagctttgttttggtgtgtttgggccaaatactctaaccatagtcctgacgactcggataacatatcatgcccggttgccttatcggacttcttttgttcattattaaagtttgtataaataccagctttttggaccatcgaattttctaaaaaattatgtagcaattctacattttgattattctggtggtatcgtgtcgcgattgttaaatcatttgcatctcccttagggactttaatttgaggttgtttttgtccacaaccgctcatcgtaaaaatgctcgcgaatattagcactaaaaaaataatcttcttatccaaaatatctcatcctctaaatatatttacgcttacgaataaattttattaaatacttttctcaaattactttacactactacggactattgtactaaattcggtacaatatttcagacgctaattttttgtaccaccactttttgatcataaaaaagcacccaaattttaaataggctgattgtaatgctcactttatggcttgttaggagaaaatttttcctagcaaacatagcgaatcttatacaatcatccataatttgggtgctttttagtctaattgcaattattttggaagcttattatctacggggaccattcccttttcttccatataatccatcattttatttaatttatggtcaacaaaaatatttccttgattagtggcgtgaccttttgtccataaaaattgtaaatcagtgaattggggtagcagcttagcaatctgttgccacagttcctggttagctacctggtcgccggtggattttttccagccgcggcgttgccatcccgcaagccatttcttagtgatggcgtttaaaatatacttagaatcagaaatcaccgtgattggtgcgtccttaccgcctttagccaacgccgtttccaacccgcgccaaagggccgttaactccattcggttattagtggcaccaaactcaccacccgattgagaatattcttggtcatcttttttcaacaagtacgcccacgctgctaaatccgcttgccgcacgtgaccaccttttacggtacccgtattgcgggatccgccgtccgtatataaaaggatccgatcggttggaacctgaggatctttttgggggattagcggctgcttttgcggggtagctttcttagctgatttagcctccgtaacttccttaccagcttgccactgttcagcttcttctaacgttccaaagcttttatagcttgccccagaaaatcccttaacctgcgcttcagtttcggcccaagtccggtaaattccgggctgtttaccaatttttactacgtaatacttctgttttgccatttgccacctcaaaaattaattttcaataaaaccgagtgctcagcactattgacgaatttccaataccggattctaatctaccaaaattttttcaataatccgttattaattatgactttttaacttatgttagtcaaaaacgttttgccgtttgattaaaaaaggagagtgggacaaaagtcgctaaacaaaaaacgatccatgaggcgaagcttcctcatgaatcgtttttattttggttttttgacttcaatagcaccaaaacgtgtgccaaaagtcagtttgttccactttccaaaactgattaattaatttttttaaacgttaagaattgcgatgaacccaataaaaacgaagaacaatccgtacatcaacggatgcacttctttaccgcgcttagcagcaatcatggcaattgggtaactgataatccctaaggccatcccatctgaaatactgtacgtcaacggcattccaataataattaaaaatgcaggaatggcaatttctagacgatcccagttaatttcacgtgtctgctgtgccatcaaaactccaacaataatgagcgccggcgccgttacttgagaagtgaccaccgttagcaacggggagaagaagattcccaagatgaacataattccggtaattaccaccgtgaaacctgaccggccgcctaccgcgatcccagctgaggattccacaaacgcacccacgggcgaagttcctaataacgaacccgttagcatggcggtcgaatccgacatcaaagccttaccgacccggggcattttattgtccttcatgaatcctgcctgagtagccagtcctactaaagttcccgccgtgtcaaagaaagttaccaataagaaggtaaggactaccacccagagttggagggtgttaatgtcaccaacgtgtgaaaccgcggttagaaaagttggctttaaacttggtgcggcagctagcaggtgggtcggcgcgtgaattactccagttaccatgccgaatagcgtggtcagaaccatcccgaagaaaattgcccctgggacccggcgaaccattaggataatggtaatcaccaagccaaacacggtgatccaggtggttggcgtggtgaaggaccctaagccaaccatggtgtctggattagcaaccaccagaccaccttggctcaaacctagaaaggcaacgaacatcccgatccccgctgaaatggcatgttttaaatcagctggaatggcgttgataattaattcccgtaatttaaaaattgtaattaacaagaaaatcagtgaagccacgaatactccagccaaagcggtttgccaaggcaccttcatcccaataactactgagtaagcaaaaaaggcgttgattcctagagccggtgcggaggcaatcggatagtttgccaaaattcccattaagaaacatccaattgcactagctaaggccgtggcggtaaaaatagctcccttatccatccccgaagcgcctaaaacgtttggattaacaaacataatgtagaccatcgagatgtaagtagtgattcccgcaataatctcggttttaaaattcgtcttcaattgttcaaattgaaaatacttagcgatattcttcaaaactctttctccttttagttcgatttaaacaaaaaagcacgttgatatagtctactctaatccttaaaataagtaaagtacgatatagcataaaattagttgcagataaagttcgtgttttgccaaaaatgtgccaattgctaatcaccttactaatcccctcagcaaataattcctacacaaaaagcactcttccaagttttaagtcttggaaaagtgcccttgttttgcagcctataatctctgtttcgctactttaataaagctacgcccttcgccgcatttataaaagttgaattcccgcattttcgcattgttcaaccattgcttgcggccaaatgctggcttgtacttcgccaacgtgcgccttccccaacagcaacaaacatagtcgcgattgaccgattccgccgccaattgtatacggtagttcttcgttcaacaacgccttatgaaaaggcaattgactacggtcttcggcgttagccatttttaattgtctgcggagcgcgtcttcgtcaaccctaattcccatactagaaagctccaaaacacactgcaaaggagcgtaccaaaacaaaatatcaccgtttaagttccaatcgtcgtaatcgggagcccgcccatcatgtctttttccagacttaaggggtccgccaattttcatcagaaaaacgcatcctaactcatgcgtaatcgccttttcccgttcttcaggacttttttcaggccaacggtcttccaactcctgcgtcgtgacaaaacggattttatcgggcaaatgataaacagcctggggatatttataccaaacttcatgttccatatgcttaatcactttaaaaatcttacggacgtgctcctttaaaactgccgtagtccgttcttctttggcaataattttttcccaatcccattggtcaacgtagatggaatgcaaattatctaaatcttcgtctttacgaatggcgttcatattggtataaatgccctcatgtaagtcaaaatcgttgcgcgataaagtcattcttttccatttggctagtgaatgaacaatttcaattttatggtttggcaagtcttgcattgtaaaagaaaccggactctccgttccgttaagatcatcattaagccccgtggagtggtcgacaaacatcggtgccgaaactcttgataagttcatctccttaccaaattcgtcttgaaaggtttcgcggataaatctaatcgccctttgagtttcgcgtacggacaattttggttcatatttttctggaattattaaatgcatcttcctcactccttttgagattaattacaaaataaaaagccttccgccctagaatactagggacgaaagactttcgcggtaccacccaagttacccattcatcagaacggatcacctcaaaacacgtactaacatacgctccggtggtaacggaccggcaacgtccaagcttaatctgtgcgcgctacatttcagcctggagcttacgggagtgttattcaactaaattgccactaatcaagtttccactatttcttgactcactgttagcgcaaaataatttactcgtctcccacgcttttttattttgtggcacaatgataacacaattagaaatctaatcaaacatttagttttaaaatagctaaattttacttagtcacagttttttgctggccttcctaagctaacccaaccattcgccaataatattgctatcgttaatcccaataatgcagtattcaagccaattttcccaagctgctaacctaaaaagccgcttagcgaagttaacacttcaccaaacggctttttaatcaactaaattattcagtatttttcctgcactaagtcctgaaattaccagatttgcacccgtttttctggagccatgtacattccatcaccgggttctacgtcaaaggtgtcgtagaattcttggaaattttgcacttgaacgtttgcccgcagtttggatggggcgtgaacgtcaatagctagcagtagctgttcccgttctggagttgccttagttcgccaaatccgcgcccaatttgtaaagaattcctctaagttagcatcgtcggtatccttagtcgcctctaatgctgcactaagtccgccatcatcagcaacgttttccgttaccaccaacttaccgttaactttgccgcccgcaaatggcagtccatcaaattcttgaaccatggcttcggatagtttgtggaagtgatctaagtcagcttgcgtccaccagttgtccatgttgccatattcgtcaaagagggccccgttaggatcaaaggcatgcgaaatttcgtgagccattaccgcaccaattccaccgtaattttggctagcagtttgtttcaagctgtagaacggtgcttgcaaaatcgctgctgggaaacagattaagttgccttccggagagtaataagcattcaccgtatccgcactcatgtgccattcactgcggtcaacctttttaccgtactttgctaactgatcttccagaaaaatccgcgagaagttttgtacgttttcaactaaactgccaccctgagctgcagttttcgtttttaatttcttataaactggtttcagttcatctggataacccaccaagatcttcaaagaacgtaacttagtaatcgccttttgtttggtggcttcccctagccagtcgttgtttgccaagcgcttttcgtaaacgtttatcatggcaaccaccatttcgtgaacgtcttttttagctgcttccccgaagtaacggtgaccatagtattcgcccaccacttggctaaacgtccggcgtgctagataaaaggcactcttttcttgcggcatggaaactttctgtccggacaacgcccgaccgtacattccgccaatttgtcggaactcttcgctaaggtaacccgtcaacgaacggaccatgttaacgtacgcccagctcttaaagtcggcaaaagtctcgtcattagccacttggttgaggttttcatagaaacgaggttcggtaacaataatttgttctggttgcgtacctaacaattcttgaactaattttttaacgtcaatactttgaacttggtccgcaaactgcgtaaattccattggattatagagtttcgcaacgtcactaagttcttccgagtttttacggtatggtgctaagctagcgtcaaaccgtttggcttgttcaacaatcccgtgcgcctcttcaggtgacttaccgatctttaccaagagttggttcatcatttcggtaaagattttcattagttgtggtccattggggttatcggcgtcgtaataagttttatctggcaaaatcaagctaacgcccccagcccacaaaacgttacgtttgtcggcaccgtcaccctttaaatcgggttcaattccgatatccaccggtaaatcaaccccgttatagaataattcctttaagttagcgttgacgtcatcccaattttgcagtttttcaatttgtgcaaggtatggcaataacggagccactccatccgcatcccgttgttgaaagtccgccgccatttcataaaacttaataaattcggccaactcgggagtatctggttcaacttcgtgattccgcattgcggcaaaatccttcattaactgtttatcaactccgtcaacgaggtccataaaacctccggtcgaggaatggtcgtctggaattttagccgtttttagccattctccgttgactgcatcataaaaatcttctttaactgaacttgtcattttctttcctcccattctgtttttccacagttctattatacacgggcttcgttaagaaacggcgtcatgcatgtagcgagcaatttctttgccgttcatgtgattgcttaaccccacttggagtttgatccgcgccttttgtccgttaagtccctggcagaagatcactcccatccgttctaagtcaatgccgccgccaacgtaatcgtaaattggttcagcaagcccgttgtagcatcgggaaaccattactactggaattcccttttcaatcaatttttgaatgggttctaccacttcaactggcaaatttcccgcaccaagtccttcaataacgatccccttagtttctgggcgatctagcgtctcaaaaatggctcctggaattcctgcgtaagccttaactaagtaaacaccagaaactagctcgtcaatatcacaaacttgttggctaattaaggcttggaaaaaacgaatatcccgtttgtatacaattcctaacggcccaaacgttggcgtccggaaagtatctacgttagttgtgtgggttttagtaacaaaccgggcggtgtgaatttcatcattcatgactactaacacgcccttgcccgtagcttcgtcggaagccgccgttaaaatcgcactttggaaattataaacaccatcagaaccaagctcgttagaagaacgcattgcgcccgttaaaacaattggaatcacgcttggaatcgtaagatcaaggaaataagccgtttcttcgagcgtatcggtaccgtgggtaattacgattccgtcacattcatcattgtcgatagcttttttgacccgttttttaattaccaacatatcttctggggtaatgtgttccgaaggcttatttaatacgacttcgtttgccaaatcaatattttcgttaataaattgggtatccaataacggattttcttcgttagtctttaccttatcattactagccgacatcgaaattgttccgccagtgtgtaatgccaatattttcttcatctgctttacctcttctaggattaattagtcctatcatatcatttctaaactatttacaccggtcagaaatgcgttaaaataattctattaatttaggagattttactcatgacgaaaacaaaaatcaattggcagctaagctacgacattggaattgcgggcatcgccctcttttcattcctaatcgtcgtgggctcgtttttggatccccatgccatccgtttaagcgctccaccattagcccatttattaaatgttttactgctcctttatacgatcgattttttctatcgcctagccagcagtaggcactggcaaagatttctctttgataacacttttgatttattatcgttaattccgctgcatccggccttcgctatttttcgaattggccgggtttggcgactaattcggcaccaccatttactctggcgatttggtttggatggtaaactttccaaaactgtgcaccgctttgtttactcatcaggatttttgaacctttttaccgctagtatgttcatcttagtattgagctccttgatgtattctatagtggagaaggtcccgtacccatccgcgctttggtgggcaattaccacggcaacgacggttggatatggcgatatttctcccgccaccaacgtcggcaagtttatcgccgccttcttaatgatcgctggggtcggttttatcggtttgttaaccagtacgattacgggatttttcacgagtcaaactaccgacgctaacaaagatgattttagtcggctatttgaaaaaatcgaccagttggatcataaagtcgaccacttgcagcgcgaacttaatttagaacgtaaaaaaaatcggcataaaaaataggctgaggaaattgggcattatcccaatcctcagcctattttattactcagctaattattcagcttcactacctagagccttagctacaacggcagcaactgcaccaccaactagtggagcaaccacgtaaacccagaagtgggataacgcactgccacccactaaaatagcaggtccaaaactccgtgcggggttcaatgaaccaccagttaagtttaaggttgcgatgatcatcaatgccaaagttaggccaataatcaatccagcaaagctggcattgccgtattgcttgttagtaacgaacagaattactaatacaaacaagaacgtaaccaacgcttcggtaactaatgcagggaacgccgaaatcttagtgaaatcagtttgacccaagttagctgtggaagcacccattgcggaaaggaagtacttcaccattccggaagccaaaaccgctccgataaattgggaaatcacgtaataaacggcatctgcaccgctaatccgtttgttaatccacattccaagagtaactgcggggttaaagtgtccccctgaaattgctcctactgaataagccataatggttacggctaacccaaaggctaatccaattccaactacgtttgcatgagcaatcgttactgctgccgttcctacaaagaccaatacaaaagtaccaataagttctgaaatatacttacgcatataaatggtctcctttctatatagtaaataataaaaaataatgcaaatagcattgtataccaatttagaagcattctcaaattaagagatttataaagtaggggtttgttagaacggttggttaatatttatgctaaaatattactagaaatataatcaggaggagtttacatggcaaattttgacgtaaatattatcgaccaacccaccgcgaaggcaatgcttgtagaatttaagagccaacggcaggataacgtccccgttttaaagcaccctgggcactatattcttcctgattacaagctaactcggcaacgaaaagccttcaagattcgcaaacatacttacctgactaaaaagtttcgttcttacgtcgctttagattccgcaaacggacacaccctttggatgcgcaactttggtagtttatcggaagcagttttctggcttgaaaccggaatgaaaattggggatacggataccgatgctcgcttttcatacaagaaatggaaagctgctcacgaagaagatattgaaaagctaaaggatgaattacgagctaaaagtaaggctaaggaagccaaaaaagggtaattacttaacgatgttttaagcaatttttaaatggtattgcacttttatttggtaatttatatactatcggggcgagaattttttcgagcccctatttttatcaattaataaacttacaaagataaaacaatttttaccgcagaatttaacgacttacaaaaacaacctttttgtcaccttttcaattaaaaactgatctattgcctaaactaatttaaggagagcagattgatgtctaccgaaaataaatttttaagttcactttcatatttcagcatcttttttctaccaattatttttccaattatcgtgatggtacttactagtaatgtccagtatgcacctgctcatcggcacgcaattacggcgttttggcttcacctcattcccgtcattttgttgccgttaggttttgggttgggaattctcgctactgcgcacagctttacgggaaatcattttccaaccacctctttggtactgttcttaattgtgggattaatgggaattgtggctttggccctcttcatttacaacatctataagggtgtgaagatttgggtggaatagtttagagcgctccagaacccgggtaaatcttgaggcttaacttagttaaccggagagatttgggttctggaatgcatttcgcctatactacattaacgtgttgaaattaaatataactatcaaaattcgctaatcgcctccacgacgcttagtaagttcgaatttagcattgaaatttactaccaaaaaatattttttggtagtttctagtctttatattgcaaccgcttacaagttgtgatagtattctaattgaggaaaggaaatagttcctcttcaatcaaaaacttctcagatggccttggttctcagattgccagaaccgacgaaaaggcaagaatattagctctattcgcaaatcaattgcatcatgagcgtaccgtgaaaaagttttgacgtttagagacgtcgtaatgattaagtgtttacgcacgatgaattgatgaatggagtggcaatcatctttttaaagagtaatgttcaacgtcatctccaagcattgaatcaagtaggtgtgtccaatgacataagtacttcgcttaggtaattatcctaggcactgttccaaataaaaacccaatagttcactggaggtctatcgtttcgaagaatatcttaatgaaactccaagaccgtctatttcaccgttagcctgaacgagtgtatccttcgtcaaaccctttgtttgattagacatgcagcagcagacgtaataacaaaacctcaggtaggttagaagcacgacggctgaacaattgaatatgtaattgaagttgaaggtgtaaagatcgataaattttccaataaagagatcacgattgattgggaacgcctttcctcttagtgagattctagtgtgagaagtctagaatccttttttgttgcataaaaaagcatattaccatcgacctaggctaggtagcggtgataatatgctttattttcgagtacgcgttcttgaatgcattaataataagataatactgcaagctacaattaaatagccgccccatccccaacgaactccgttgaacatgttacctaggccaactaattgggcttcattttggtaaatcaaaaagaacatcattccgtaccacagcaagtttaggtaactcgcccatttggtcagccaatggaattgcaaaagcgctccaaataagagcaatgcgggaatcacccataaaaagtgagcaagctgatcgtctcctaacgtcttcaaaatactcataagggaagttttaacgttatacccagcagtgggtgctgaagcaaacggtgcccagtaagcagccattccggtaataatggcaattcccataatgaacttatttttcaacgtccagcgttgcttccctttacgtacgtcagtgccagtagttggtttaggatcatttacccctgatgaagccccttctttcatagatttcggctccgcagtcgcttccgttgcctctgcttccgttgaatcggaattttgttcggtagttggagtggtgaaatcctttttaccacgtttttttagtaacgccgtttgcaatttttgccaaacctgacgacctgcttcgccccccttttgaagggctgctttcacagcctggtctgcactacggtcaccagcgcccactcgttgagcgtagaaaaatgcggcagcaaccgccaccaccagtaaaactaccccaaccattttacttagccagtaaaaaattgctccaattactaacaaaactagcagagccgttaaccaattgcctccgatccattgcaacgtagttaacgcaccctccttgaggtccgtagaagcaccagtttttctgcgagtgcgactaatcgttggttcttcttccggtttggtatccgcgctttctttcaaatcgtctaatggtgtttcttgccgatttttatgcaactctgcacgagaaagccgggagctttcacttgatgctgtttcgattttagccccgcaattagggcaaaaatgtgccttttcaggtaattcttcgccacagttcaaacaaaatttcataattcacttctccaattaaaattattaattctattgtaaatgatttagggtccaaaaatcggcttgtttaccaagttttaaaaattgaatgagttttatctttcaaagtagccggtacataaaaaaagaggctaagaaattcattcttgcctctacattcatttattcttttgctatcggtacgccaacccgtattagtgttctgtactaaaacgattgttaaataatggactaaccggtttgtcttcgtgaattaaacgaattgcttccccgatcaaaggtcctaccgaaatgcttgtgatcttatcaattttcttttcttctggaagttgaatagaatccgtcacaatcaattccttgattggcgagttttgaattctttcgatcgctggacccgataaaactgggtgtgtacagctagcatatacttcagttgcgcccgcatcgatcaaagcttgtgctcccaaagtaatcgttccggccgtatcaatcatatcgtcaatcatgatacaacgtttgcccttaacttcaccaataatgttcattacttctgcaacgtttgcgcgtggacgacgtttgtcaataattgcgattggtgctttcaaaaattctgccaacttacgtgcgcgcgtaactccaccgtggtcaggagaaactactaccgcattttcattcaagccccgttcaatgaaatgatcagctaacaatggtgcacccatcaagtgatcgagcggaatatcaaagaaaccttggatttgtgctgcgtgcaagtcaagtgcgataatccgggttgcacccgcacgttcaatcatgtttgctactaacttagcagtaatcggttcccgcgaacgggccttacgatcttgccgagcatatccataatatggaattacgatgttgattgtcttggcactagcacgtttcaaagcatcaatcatgatcaacatttccatcaaattatcattaaccggcgcagaggtggattgaataatgtaaacttcatccccacgaatactctcttcaatattaatacgaatctcaccatcacggaaacgatcaaccgatgttttcccgagttctacaccaactgccttggcgattttttccgctaagggcttgttcgaattcaaagcgaaaattttaagctttggatcggaataatgttcagacatgtttgcctccaaaagattataagatattgagtttattcaatttttccatataatatcataattcatttacgactataaaagcaagttacttccggggagtttctaagttttcttccttaaaaaaacgtttttttctttgttgcagggtgttttttgcaattatcttaaaaagtttcctgaaaggtccgtgaaacaaattatttgtttcaccgaatcgtgttatacttaaatctacaatcgccgttgtctttcaaaaagttcgtttattgcgttgttacagggggatgcagaaacttgaaacaaaaatacatcttatcaattgacgctggtacttcggtagttaagaccgtgatttttaaccatgctagctctgaggtggttagcttttctagagagttgtcccaagaaagtccccatcagggctggtacgaacaatctcccgaagatatttgggaaaaagtttattcatcgatggctaacgcattgattgtttcgggaattagccctaagcaaatcgctggaattgggattactaatcaacgagaaaccaccatcatctggaataaaaggactggcaaacccatctacaatgccattatgtggcgctcacgccagaccaacgaaatcaccgactcttggaacctttccaactataaagacctagtcaaaaacagtactggactagtattagactcgtacttttctgcttctaaaattcggtggattttagaccacgttccccatgcccaacagcaggccgaaaacggcgaactgctctttggcacggtcgagacctggttactttggaagttaaccaatggtcatgctcacgtcaccgattacacaaacgccagtcgaacgatgttttttaacattcgtactctagactgggacgaagagttattgaaagcactgaacattcccattcaactgatgccagaagtacgttctaactcggaaatctttggctacacgattggatccgcgttttttaactgttccgtacctatcgccgggatgattggtgatcaacagagctctttggtaggccagctggctttccaccgcggggcaattagcgctacatacggcactggcgccttcattaccgtaaacaccggtgaaaacatggttcattccgaaaataatttacttaccacggtttcctttggacttgataaaaaaatttattacggattagaaggcaatatttttgttgccggaactgcggttacctggttacaagatagtctggaaatgattaaagatcctttgcattcggcagcagttgctagtcaatctaccagcgatagcctatacgtagtaacctcgtttaacgggatgggggcaccctactgggacgaaaaggtacagggcgcggttttcgggatgaccgataaaaccaccaaagcagattttgtgcgtgccaccctgcagtcaattgcctaccgttctaaagacgttattttggctatgcaagaggatatgcagacagaacttcagacggtctacaccgacggtagcatggctaaaaatgatttcttaatgcagtttgaagcggacatcttaggggtggatgtaaatcgttcagaaactaccgacatcaaagccttaggagtggccttcttagctggattagccgttggtttttgggaagatctcactgaaatcaaaaaacttcgacatcccatcactaaatttcaacccgtttataccgctaaaaaacgtgaacgtctttatcgagggtggcaaagggccgttttagcgtcccaaattttttccaaagaaaatgaataatcattaaaacacgccttgcttctgtactgaacgcatcagcgtgtttatttttgggcaaatcattcttaatcaagcagtccatacttgattttgaaacgagtaatggtctttttccatgagttgtaaaaaatcagtaagaaaaaaacgtttgataaagcgtgtagtaaatcaaagtatccggttcctagaaaagttagtagcatcgccttgaaattcagcgggttgatgtacgctaccaaataccacaaatccatgatccacccgaaaacaaacccccagacaaaaccgaaaagcaccattgcatatttgtgattaactaacggggtgtttttcaacaatccggccgtcatccccatcatcccccacgcaaacatttgccatggggtccacggcccttgtccaagaaacatattcgacgttaacgccactgtcgagccaataataaatcccgattctggacctagcactgctcctgcagtgataatcacaaaactagtcggttgtacgttgggaatgattgcaaatggtacccgactaactgcagcgattgcaattagtaccgctaaaaagaccacctcacgagcttttagagcactgctttcgaatttccaataaaagggaattacgctcgcgattaaacaaataaaactaaataaaagaaagtgctggccttgtagtgcagttacgaaggttaaaaaaaccaagaaaattacaatggcaattaagaaagtaattcccgtcatttgcttattcatggctaagctccctccatactaaagcagttggcaattggtcccgcaccatccgattaatgggggtggtgtaaaagaaatttttagcgaaaaaggagtacgggtctgctgtagaagtaattttaccgtcaaacaacatggcacagcgggtagcataggtagcactaaaactcatatcgtgactagtagtgatgattgtcattcctgctttttgtagcttttgcaatagctttcctaaactccttttacgcaacgggtctagtcccttagtaggttcatctaaaagtaaaatttggggatgggcaattaaaataattcctaaggcgatcaactgttgctccccgccactggtatcgtgtggatttttatttttcaaggagttaatttttaaacgcgttagcattgactcagcaatttcttggggttccgctaatcctaattgtttggctcggttaaccaattcctcaagcaccgtatcatagctaaagtgatcagcaggattttgcgataaataccccaccattcggtacaactgaccgctttcccatttagcaagtttacgattgaacacggtaattttacctcgtcgcgctttttccattcccattagacattttaataaggttgactttccagtcccatttcgccccacaattgatagccattcaccgcgttgtacagttagccctaaatcatttaagatcagtggactattccgcccgtatttaaaatcgacatgctcaatctttaaagctgggtcaccactcagtgaagggatgatccgctttcgttgctgaaatttaatcccatgacgatcgataaaacgcttaccagcgaccaccgttagtggtacggtatccttagaagacgtggcgattaaattttctgccaaaaaaagacgaggaacttcagggatgaactcagccattttctgatcttgaacggcatgttgcaccccttcttccacgttaccagtaaaagttagtataccttcctccataatgcataatcgattagccaagggcaataattcgtcgagttggtgttcactgatcataatggttacccctagttcatcatgaacccgttgtaaaagactgatgaattccttagttgcgatggggtctaactgcgcggtgggttcatctaaaagtaataattcaggctgcaaaattaataccgccgccaaattaaccaactgcttttgtccaccggaaagttcgtttactgatgcgtataaaatatcttgaaagccaaaaaagctaaccatttcagcaattttacgctggatgttttcactatcttccccaacattttcaagggaaaaggcgagctcttggattaccgtatccatcacaatttgatcatccggattttgaaaaaccatccctattctccgggcactttcaattggcgatagtgttctcagggactggtgtttaaactttattgctccccgacgttcgccaactggccataactccttttttaattgttttagtaaggtagtttttccacttcctgaatcaccaatgatcagcataaagtcaccttgattgacgtttaaattaatattttccaaattatccctcttagcgagagcgtatttaaaaaataaatcttttacttgtaaaatttccaccaaagttcctccttcaactctacaaccattggtaatccacaaatcaaagccaccgtgccaatgaggagtccttcttcttgccaagtcccccaattcatttgcaaactaggataaatctgaattacacctattcgacgaatcgcttccccaattaaaactattccgccgctagctaagattcccgcgcatgttatatcacggcgggtcatccgataacgctggtaattggaccttttggtgctgccaaaaccgcgggcagtcattgaatccgcagtttgaaaggcgttataacaagcgtccaccagcaatacttgcattagttgcattaaagccttagttcgttgccgtacgctaccttgatcaacattaattcctcgcatcttttgaatttggctaatatttttgaagcgctttagaaataaaggtataaatcgcattacgatcatcgttagcaacgacaggcggggcaaaattttaccaaacaaaaacataaatttattgttagtcatcagcttgttatacgaagcaaacagtaaaattacgttagttaaagacaaagccattaaaattccgtacaataacgcttctttagtaatcgtcaacccgtgaaaagacgtcagtaagtgtgcaccgttatggttggtcagcggattaataatgataataaaaagtgccattattcccgttgccttaagcgttttaagtgccgacatcatatcagaaacttgaattaacaatcccaaaaccgcggtaaattcaatcattaaaatgatgggggaattaaataaaacggtaatcatgattaaaagtaaatagtacgcaaagataatgcttgggtttaggcgttcaaactcaagtgtcgaattccgttgattagtgttcgactttaacggttgctctttcatctgtaaccactttctttaaaaggttactttaacggtaccattcccaaaactttgaaagtgatactttttccacaaaaagtggtaataatttgtcctctcctatcaacgtgtactattttgtcgtggtgacaatattttacaatcaccgctaaaaatattgccattttagcaataaattgacattatattgcattgtgaatagtatttttttgctccataattaacaaaagaaatcgttttcacatattttttcattaggaggttgatcatgttaagtgcattaaatcaaacgcatgacgatcgttatacgccggactcttacactaaacttgccaattcgttaaatgctttttacgaaatcactcaaatcgacgtgcttttctatagctttactggcgtgttagtttaccgtggcgacattatcaccgataataaagttgttcaaaaaacactcgatcctgaacactttggtaagtcgatcatcttcccaatcattctcaataaccaggtttggggattcaccatgtgcagctctgcaaagtcttctaaccatcggatccaagtatctaaggaatatctttctaatttatttaacagtcattttgctaatcggcaagatttgactgcccaagttttagaaccactgaccgatgaacagttgaccaaaataaattatttaagtacgctactgcagctaaaaagctctgctaacaacgttttaccaattgctactgccgaagatccacaagttcgaactagtactgaaaagtttgaagccattcggagtattaaagaagctactaactacatttgtgaaaatttaactagtcaattaacccttagtacggtagccgaacacgtatttttgtcaccatcgtatttaagtcgcatttttaagaaatacatggatattaattttattaattacatcaatcagcaaaaaattgctcacgcccaacgggaactaattttaagtcggaaaccgattaatttaatttctaacattgcggggttctcacaaaccagctattttactaagattttcaaaaaaataactggaacaactccgtctaaatatcggaaagaaaatgcagccatcagcaggatatacacgattcatcacactttggactggccagaaaatgcctccgtttttgacgtttctaaaacgttctttacgaagcaaaacctggattactattatgagtctgccaatggttatctatacgttaatagcattggtgacctaactgacgcaaatgaaaaaagcggttggatttttaccgttgatggacggcaaccaactaattcagctgacttaatttccacaaagggcgtttccgtagtccagtggatgtacgtggacttccggtaaacttagtaactacgaaaaaactgttcaaatgaatttctagcttatgctagttttcatttggacagttttttgatttcttcgttatccccagtaaaccgtttattatggttttagatttaataagtcagagaattcaaactcatcattctctaaaccatcaaccgcaaatcccgctgtattaagaaattcttttctaaattgagcataacctgtcatcggacttttaaaattatctgcattaatttgttggtataggtctgccgtttttgcctgcgtcgaaggccgtaattcataatggtctgcgcgtagtcgtccttttggatcgtaaattggatgcttcccgtagatcatttcccggtaaacccgatctttatgcataattggtgtttcatgcgtagcctcatcggtcgtcactttgtacaaagcaatcatgtactttggcatgattggaatgactacgcttgccttagtagtcactacggttgatacgcaaactagcgctcgaccttggagtggcttcaattcctgattaatccgctcggcggatctttcagcttgcgtttttgccacccctaaggttccttcatgataaaacggatacgtcacttgtggaccaatgtaagaatacagcaccgttttaaagttatctgctaatacatgggcttcctttaatgcttggatccaccattcccagtcttcaccgcccattactttagcagttccttgaatttcttccggagtcgccggtgcaatcgtttcggtgaataaccgttcgtgttctaaatcaatattttcgccagtcacactttggtcgattggttttaaaaccgaccgccatactttctcggaccgggggtcgttgcgcttcggcgctgctaaactatatacaagcagatcaatttttccgccaaattcatttttaatgtactcaatcacccgttgtttcatggtgtcactgtacgcatcgccgataaagttttgcgcaatcaacccagcttgctcagcaaattgtttgaaaaagatactattataccaccccgcagaacctaattgttcaggactttttggcccccgttcataagctacgttaatggtatctgcaccgctgccaaacgccgtggtaattcgggtagctaggccataacttgatgaaccgcccaaaattaacacctttttaggtcccgcatattttcccttagactttacgtaattaatttgatttaaaactgcttgccggcaaccataaggattaaccgatttgataacgtttccaacgatttttggcttcactttcattttgatttccttctttagttttttccgctgccttagctacttaaattatagaaaactttttctaaaataaaactattaaccctgaattcacttcataaaaatgctaaaaatgaggttagaattgctattttctaacctctttagcatggcttgttttgtaatttatctacctatcaaaaacttatttagtcgagataaatttttcgtaggttttgcctttgtgccttagtcaattggatttcattttttaaatactggggaataccaccatactgataattaagcatccctaccagttggtcataatattcgtccctcacagaagctaaatcttcaacagattgtacaaagtttcttcctaggtgcatcttttttgcttcgttgcgccgccactcaatgcgtgctttagaagctgggttcgttaacaagtaatcttctcgaatcactttatcatcgacccccaaagcagctaataacagcattgtacacatccctgttcggtcctttccagccgagcagtgaaaaagaattccaccgtccctaccgtacttttccaataattcaaagaagtgatgataggcctgttgggcgtgtggatccgtaatcagtttacggtaagatcgcatcatcttctgaaagccaccttggtcgctacgtgcataaagctgataaatccgtttcaaagacgcaccgctttcagtttgatcgtcttgaaagattggtaagttaatatatttaatatgggagtttaatctatccggaaaactttgtacttctgactttgaacgtaaatcaatcactaaattgatcccgtaatctaccagtttttgaagatcttggtctgtcaaatccgataagtatcctgaccgaactagcttacaccactttacttggcgcgcgttagctgccggataacctcctaagtcacgaaagttaaatccaccggataaattcaaaattcttttactgcacattgagttctcctcgtggattattatttttaaagcccttgataaactgactgggcaaccccgatttcactagccgttagggccaaaccattggctgtggattttcccgagtttatcttagtcaaccaattaggatccttaattaagggtcgaccgattccaattagtgagctgagttcttgggcttgttttagcttattagcgtcattaatttgcccagctaccattattggtagatctaccgccgcattgaagagtttcacaattggcacttgggtatcaaaagtccggggagttaccataaaatcacgtaaggagagacttaagtagtcgatccctaactgctctaaaagttgcgctaattgtaaggtttcccctaattttaagccaccgtcttcgtactcttcaggcgaaagtcggtatcccaaaacaaatgtttgattaccaaattggctaaccgttgcttgcaatcgttggattaataacttcacgaaccggaatcgattcgctaaagaaccgccaaactggtcttgacgatgattagcattagatgaaagaaattgttgcggtaaaaagccgtttgccccatgaatttccacaccatcaaatcccgcagccattgctcgttttaatgcgtttgcgtattggtcaataattttataaatagcatcacgagttaattcttgcggaactagctgggaccagggagctgcaatcgcgctgggagaaaatgcttttttcccaaagattgtctgggggctagctaagcgtcctgcatgcactagctgaataatcgctttagcatgatttcgctggattacttttgctaacttgcttaatccctcaacatcttcatctcggctaatactaattgatcctaaagcagtgttcccctctgtggaaataaaagccgagccgaccacatccattcctaccgcttgggaacgttgccgatggaattcaaggtcatttaaactaaccgtaccatcaaatagcgccattcgcatatctaacggcggcaaaacaaaacgattttttaaattcagcttatccatcttcgcaccagccttacgtacgcgtaatcgtcggaatatcgaaacctagaagttcgtgcagcgttttaatcacttttcgcaaggccgactctacttccgagacttcccctacgaccactaccgagccactaaaccggtcgataaagccaagcgttacgttacttgacttagtcgctacgtcaccggcaataattgaagcttcactaggggtgattgttaaaattcctaaagcatttttaggagtttgaattccaagcttttcgtaaatatcttccgttgggttagccacaatgtgtgccaaagttacttgctttcccggaacgtattcttgaatcattctcgctttatcttcaatcatcgttatcatcctcgtttaattaaattcagcaactcgcataacgtcccgagcaatgataatttcctcatcagttggaattaccgcaacttttactttactatctgctgcttcaatcgataattcaccattttgatttttatggtcatcaattttgacaccgaggtaacctaatttttcacaaattgctttacgcatggtaatcgagtgttcaccaattcctgcagtaaagactaacgtatctaacccgttcaaatctgcagcatacgcgccaatgtaatgttggatttggtgaacaaaaaccttaatcgccaattgagcacgccggttaccttcgttagctgccttttcgacatcacgaacatcactagaaaccccagataagcctaataatccagagcgcttatttaacatttcgcgcacttcttctgagtccaaatggagctcttcttcaatgaaaggtaaaatttctggatcgacatccccagaacggctgcccatcactaaaccagctaatggtgtaaatcccatcgaagtgttaattgatttaccatccttaatcgcacacaaactgctgccatttccaagatggcaagtaatcatcttactagtccgttcttcaccaaataattccgtggctcgttcagacacgtattcatgagaaggaccatgaaaaccgtaacgacgaatcccatacttctcatagtattcgtacggtaaagcatacatatatgcttcttcaggcatcgtatggtggaaagaggtgtcaaacaccgccacttcttgggctgctggtaataatttttcaaaatctttaattccaattaagttaaccggattatgcaatggagacaggacacttaattctgcaattcgtttttttacatcttcattaaccaaaactggacgatcgtaataccggccaccgtgagacactcgatgcccaactcctacgatttctgacttatcttcaatgaccccgctggttaaaagcttgttaataaccgctttaatcgcttcatcatggttcttcatcggcactctattttgggtagccttcccatgaacagtgtaatcaaacgtactatttgcaatcccaattcgatcaacctgaccgctggccaatacttcttcttctggcatttgataaagtttgaattttaatgatgaacttcctgagttaattgacaatatctttttggacatcctaattaccttcctgaaaatctttatttgatgatttttttataaatctctgctaaatcttcatcagttggtacgactggattccctgggaaagtaccgtccaacttagcgctagcaacgatttggtccgttgcttccaacgctgctttagtatctattccaaaagcagtcaacgttgctgggcaattcatctttcttgccatttgcttgatttgggattgtaatttacgcacggcaacccgatcacccattccagagcttgctaatccagccttacgagcaatcattgcatatttgtgtaatgctaattgactgtgagttgcgttatattccactacgtatggcaacaacattgcgttggctaagccatgtggaatatggaaatttgctcctaactgatgtgcaatcgagtggcaaattcccaaccctgcgttgttaaaggccgctcctgctgcacaagatgcctcatgaacaattttacgggccgcttcattgtcaccgtgttggtaacattcaactaaattattgataattaccgaggcactcttttctgccaaggcatcggtaatggtattggcatcctgagccaccaccgcttctaaagcatgggttaaaacatccagccccgaaaaagcggttacactattaggagcagtcattactaattgcggatctaaaagtgcaacgtctgggattaggtaatcctccataattgggaatttttgatgattttccggatctgaaattaccgctgtattggttacttctgaaccagtcccgctggtagttggaatggcaataaattctttaatacattttcccgaaagtttttcaccaaagaagcgaattgcctttcctgtatcaatcgctgaaccgcctccaattccaatcattaccgtgggtacattttttaaatattcgttaaccccttgcataattttcttcaatggcgggtccggcttaacatctgaaaaaatagttacctgattactcgaatttatgtttcccttaatttcatctaaggttggcgtccccggcaaaaaagcgtcgcataccattaaaatatgttcttggtttagctttcccaattgctttaagctatcggtaccagaataaatttgagttggaattgcaattctttccataaattatgcctcccatgaacgtaacgaaaatgcttctggcgaatttagccgacgacggcgagtgaaggtcttagctgttgcggttccttctccagttggggttgcaatcgttaatgctgacgcacctgcatgagcaccgttagctcctaccccggttcccacatacgttgcaccgttaactacgaaaatggaagtgttcattcggtgtgccgcacggttaatatttggtaagttttcagaatgaattgaagccgtgtgatgcaatccttgttcaacttctaccgcagtcgctaaaacttgatcaaacgttgggcaagaaactactggtacaattggcatcaacatttcggtagtgaccaatggatggtccttttgggcttccataataattaattttggtgtgccagtgtatgcaattcctgccttatctaaaatgtaggttgcatctttaccgacgaattggcggtcaggtgcaccatttttgccaatggtcatttctgctaacttatcgatatcactagcgttagttaccaaaaatgctccttctttttgcatctttttaataagttcatccttcacgctagattcaaccactacttctttttctgcagtacaaaggatgttgttatcaaaagatgcggaatccacaatgttgtgtgcagctaacgcaacgttagcagtggcatcaacaattgcaggagggttacctgcaccagcacccacggcttttttgccgctaactaatgcttggtgaaccactgctggaccgcccgtgatggacagcatcgcaatgtcaggatgttgcatcatttcttgaacagattcaattgacggttcttcaattgatacaactaaattcttcatcccggtagcttcataaactaactcgtttaacttttcaattgtccaacgggtaatttttttagcacctggatgggcgccgaagtacaacgtatttccaccagctaacatcataatggcgttagcaattaccgtttcagaagggttagtacttgggccaactgccccaatcactccaaacggagcgtattcgtacatcactaaaccaccgtcgccagtttcagcttcaggttgcaaaatttcagttccaggagtgttatataaagcattgtttagcttagcaattttagcttcaaccgttcccattcctgtttcatctttaatgtccttagccattttttcgatgtatggacggaatccttcacgaattgctgttaaaaccttttcccgaaaggctaaaggtttatcaatataaacatcttcagctgccttagctgccgcaattgcttcatccacggtcttaaaaatcccgttttggcccgcatcactagttgacgcagtttggctagtgccacttttctttagttcctcacttaaaatgcgtcgaatatcttcttcaagattttgaatttccatttcacttactctccttcataaattcttccacagcagcctcacaaattgcttggtcttcttcaaccaatccgccgctaatcccaatcgctccgacaatttttccgccgatttctaacggaattccgcccgggaaggacactaattttccattcaacatggtttccatttggtaaagcggtgcgccaggttgaatatctttactaatatctttagtagattctttcattgcgattgctgaccaagccttcttaggagctaattctgagctaactagattagcattcggcatgtggtaaagcatttgaacaaccgttgctgcgtccatgatgcacatggtaactcccacatttaattcgttagctttagctacggccgcgtcaaacaccctttgcattttttggcgatcaaataggtttcctaattgatccccctgtttggtaattatttctttaacaatgttattaatttgctcttcattcataccattcgtcctcaacaaatcatttaagaagttggaaaattttcccttcttttttaaattgacaaccaccagccatcacgaaatcaactaaatttcgtcaccaaccatgttgctgatttatcacgaaatttagttaatccctaggccgttccccttaatttttagtaaaatacgcacggtatctcttaattactttctccgtcaccttggctagataatcttcgtaatcttcggatcgggctaaaatataaaagaaatcagataatcgattaacgtatttttcaagtactggtcgtacggtggtttcactagcaaattgaacaaagcgacgctctgctctccgacaaactgtccgacacacgtgtaactgggcaccggccaagcttgaaccaggcaatataaaagactttacgggtggcaatttgactgtgtattcatcaataaccttttccaaatcgagtacgtcttgttcttcaatggtcacgctattttttaaaaatttttgggtatctaaagtagcaatttctccttgtaaaaagaacatcttgtactcaacttttttcaagatttcttgattttttttgcttaaacaaagtttatccgccacgctaatgttggcgtttagttcgtcaaacgttccgtaagtttccactcgtaaagagtccttatgcactcgtttgccgtcgtaaaggctcgttgatcccttatctccacctttggtatagattggcatcttgctacatctccttacttgtcgaaactgtcaataataccgacaattgcgcaatcgctcacgtcacgaaaatttttatccgcatggttagcaatccgagcacccgctccccgcacaagcagtacgtattctccgataccagcaccgactgaatctacggcaacttcttccgggcgaacgggttggccttgcgaatcaatcgctcttacaatcattaatttacgaccaactaatgacttatctttttgggtagacaccacgctgcctacaacttttgccatatacaattttcatcagtccttacttgtatttttaaatccttttggctgcttatttcttcagcacccgcggtaatattttgaacattcgttactactaccaccgctttatccggaatgcctgctaacatttctcgtgtgattatagttggataaaaggcataaactggatgttcaccgttaacgacaaacataattggccagtccctaatcatcactaacgggataaaattaagtgcgtgatagctcacgtttaactgaaaattcacgtcgtaatcgagcccttgtaaaatccaggttacccaacgattactttggtcgaggtgaaacagatccgcaatcagctcaattgaaacttgctttaaaaccagattggcgttatcaacaaatattcccgttgagggaacgtcattacttttggagtaggtaatttcggcggattgcgcatttctctgttttaatttttcaattacttgagcaacaatcggatccattcaattcaccctccaatttcgtttattttttgatgattctaccgaacgtattcgcatttacgttagcagcgttagcttcatcagtatcgatgtgcatttctaataagaagtctttccgcggtctgcaaatcacgtcatcaaagatggttctgcgttcgtcggaattgatttctacactgaccgtatcacctaactcaacaccaaaacgagcagcatcttccaggctcatatgaatatgccgtttagcaacgatgacaccttggacttctacttctccatctttagtaactaacttaacggaaggagccccttctaaatgaccagataatctaataggagcgtcgattcccaattcaaaagtttctgaacgggcaatttctacttgagaatgtgcccggttaggacctaagatccgcacgtgtttaatagttccttgaggaccaacaatgtctgcaaattgatttgaagcaaattcttcatgttggtataacggcttgtacactgtcatttcttggccaggaaatagagttgcaaagtcttcatcagtcaaatgaatgtgatgatttgaaactccaatacgaatccggtttgggtcagtttcttcctttataatcttgcgaattaactgtcgtaactgttcttcatccataattctcgtccacccttattaaagctatttttattttgttgaaggtaaaatgcgttcaacttcagcatgcgggcgaggaattacgtatgaactaactacttcaccaatgttttcagccgcagcaactcctgcatcaactgatgctttaacagcgccaacgtctccacggaccatgattgtaactaaaccgctaccaattttttcttgaccgatcatttgtacgttagctgccttaaccatggcatctgcagcttcgatagatgcaactaaaccttttgtttcgattaatcctaatgcgttattcataatatgttcctcctgaaatttcaaaaattattttttagattgttttttacgtttcttagtacttgaattagcttcttttttactatttgattcttttttagtctttgaggttgccttagatttctcggacttggctggtttttgaggttccagtttttccgttggtcgagtcggttcaacgttcagcggctctgaattagcttcgttagccttccgtaccgttggttcaagtaataaatcagttcggttaagcttttcaattccttccgcagggttagctaataccgttgaactaacgtagttttcgcccatcatttcttttgccatagcgattgccacgctcactgccgctacgtcaccaacaatcgcaactgtgacccaaccactacctcgcgtattggaaatattttttaattccacgtcggcagtttttaacattttatcggccgatacgattgcgttggtaaggcctttaacttctaaataacctaatgttttcaatcagttcaccaccttatttaatcttttaaacggtacgccctttactaagcgcgccgcgttggctcctaaaatccgtaaatttacggaattgtctttttccaccttaaatagtggctctgatttaggtaaatttttatagtgtacaattactgatttatcgtcaaaggcaattcccactgataatcgcgaaaataacgccccttggtacgcacgttcaaccgggttgtcgaacgccatggtcttgaaagaaaatggaatctcctcttcttcaattccgtataaaagctgcgttaattcagtagtatcttcgttatcctcacgcatggcaattacaatcgaaggtttttccatactcatttacatcaccgaccttaactggtttgcgtacgataaaatcaagccagttgccaccgcgtttcgggggccctcgatcgaccggatattcccgcgtccagctaccaaattgtagtgtgacaaagcgtcggtaactaattgtgggatttcaaaatcaagtgctgatccacccacaatcactacaaatggaatatcccgaatgttgccagttggactaacatgtcgcaacgcacgttgtgcattagttacgaaaacctttcttttagcgctttgccgaacatgcttaattttttcgatgctgagattccctggcaccggtatatatccgttaggcttaataaccaccactcgagcaaaaatatccgctggaaggggctcgtcaaaaaactgcaccgtgccatcttcatgccgaatttggaataagttttctacttttgcaagggggtattttttaatatcctctgctaaataggtgtcattaatgcctaattccgagttgatcatcatcgtggtcatgtcaccagcaccagctaaatgaattgcggtaatctggttattttgatcaataattgacgcatcggtagaacctgctcccaaatcaaggatagcaattggtttggttgttcctggagtagttaaggcccctaaaatggcggcttccgcttcggcaccaccaatttcgactggaacgtgcaaatcattttgaatcaaatccgcaattctttgcatttgtagtcgatcagatttaaccatcgcggcaattccaacagcttgttccgttgaaaattcaccagctaagccaccttgaaccttaattggtactgatgtatcaacagctagcaagtcttgaatggcaatttctttattctgctttccggtcaaatcggccattgtctgccgaactttttctaacattccgccaacgttggttccagcttcacccgtgatgttcgtaattcgatcaaagctagtaattttatccatgatggcatctgctccggcagaaacgcctacggattcgctaccatgatcaccgtgaatgttaattcgacctgctggaattacccgcgccttaacatcacctgccggagtcttaataactacggcggaacgattgccaatcagcgctcgtgaaacgggaacgatgtttttagtttcatctgaatctaaaccaaacagcgtcgcaatcccgtacggattagatagttgagaaattaccttacccttatccgcaacttcaacagctgctaacattcctaaaggtaccttttcaattaaagccacttcatccacaatcggaattttatggtcgagccgattatcaattaaaacgccgtcatcattctgcaaaattgcggccgtaatttggtaaccagccttgctatataaattgattaaccgagctgcatcagcaaaatcaacttctttaggaactaccacgatatactttttttgccgatccttttcttgcaaaagttgtaaaagattgaccgtatatccagaaccaatccccacccctccaggagtgttgggattatgcccaatcatggttgattcggtgataatggtttccgaaatagtttccattgctacatcaccaattacgggagtagcttcgttaatcctgattaaatcaatatcatcaagtgttagttgcgtcttagctaaaacctgcgcaactgattttttaattccaattaaattttgcttagttcccttaattccagttgtcgctgaaattccagagtcaataaatttaacgtctccacggtcagatacttcagcaagtgcaacttcggttgaagaatttcctatatcaactccaattacacgtttcataaaaatgctccttaattgtcaccttttaattttttacgggtttcataaaattcagctgcttcttcaaaccagtccgcacaaattttagcgttgtactggtcgcgtaactctttagcaatatcaagcagctcttgtttagtggagcgatacggccgtaaagcgttgtacatttccaatagtcgttcatcgggaattgcggttagctcagcagctctttgaaaatttttctgaatcgcatcgcgtccagaatctacagcgacttgcccctgcaaacgcaacgtttctgccgtaattcgtaagtctttaggcttaactgcgccgtttaaaacgttatcaatattgagatcatctaaattacttcccgaaggtgaatgaactagttccggatgttttgaataaagcgggtagtccttcgtcgtcaacggtgcttcatgagtcgccgtttgcgaaggagtgggcgttgctgttttagattcatctttaggagcttgatcgcccatctggctcataatcttggccactaaatcatcgatttcactcattactttccctcctaatcaaaattcacttcaatttcttcagccggacgtccaggttcaacttgcttcgtttctttaatgtgcatcagggctgagatcgcttgataagctacccgagccatttgatcatttacggttgggactggattgggcgacatcccctttgcatattcggctgcatttttaccaatcgcccgataagtatccaaatccagcactggagcttgggggaataactctaaattagagagcggttcctgatccttttgatggataattgccgtccccttcgactgaatcgctaccgcaattcctgaacctgacaatttatcggcttcggcaccacagaacgaaacatctgaagttcggtaaatttttaccacccgagcttttaagccttcttcttcaatacccgcaattacttgacgtaaaatatccttatgcggtaatcccgtcatgtttttttccaaaacttccgcaaaagcaggtgctaccccgatgactacttcatctttagaaaaaccgggctttgctttacccacgtgtttaaaccaatccagctttttttcggtaactggtcgtgaaattgtggaccgatcctcactttcagcctttggttgcgaattgggagtggaagaagttgactcatctttaaaagaaattggcgtatccatattttggttttcagccaaaacttctcgtatgatttttcttagtatgttttcatcaattgtttgagacatttacgcttcctcctttgattaaaacttcatatttccaggatcaatggcaaacggaacgttcttaatgcgttcccattcttccttatcttcgtccaaccggtacccggtacccggaccttgataatcatttgcgtcgttgaccgctgaaataatgttccagtctttatcaaagattgaagacgtttgtaagaagtcaccacagactttttgcttttgaaggtttaataccgcttcagcgacatccttaaatccgcgggtataaagcgctttaataatgtccactgcggttactcctctgtctaaaagttcttgagccgccttcatatcttcaaccatgttacgttctggcatatctttagaggtgtttgcgtaagttgctgcttcaacttcttcatcagtaatcttcggtaatcctaattcatcaaataccgcttgtaatgcccgagccgccttattccgacccttaatgacctcttcttctgataccggatgaattccgccattaatcatcaagtcacgttccatgatgtagtagtcgtcataatccatggcatcggtattcgaacctgcaaaggtgttgtcgtaattaggtgttgaagaatatccggaagaaacgtaatccgttcccgcgataaactgacctaataaccgttctgtacgtcgcatatctgaatgggagaatgcttggtcatttccggaagcgcattccaaatcaagcatcatgcataacaagttttcgcccatcactgaacgaattcctgaaggtactgcaccaggaattccaatacagctaacgccaccattttgtagtccttgtaccccagaagctttggtgatgaaaatgcaccgagcctctaggtaaagcattgatttgccttcggtataacccatcatggcttcagatcccgaaccagatgtgaaacgcatcttcaaaccgcgggatgcgtaacaagatgccaaaaatccttttgaccaaggagtatcgtcaccgtcagtgaaaactcggtcagtaccatatactgaaatagtttctgcataaccagtgaatcctcgcatccctaagttgagttcggttgcttcttcaactgaacattgcgttaaaactcccggacgtccagtttgtgcaccaaccatcagtgagatagcgttaagtggtgcatagcgtgctaccgccgtggttgtctcttgttccgggaagccacgtaaagctgcatctgccgcatctgccgcgattaataccgggttatcccgaatattagtaacgtgactttgggtggcaggagtccgccgcggacgcattttctgggttgccataatcatttcgccaaagtttaatttactaataacttcttcagcctttgccggtgtcattgcggtagtaatcgcaatgatatctttgcgggatacgttagggtcaaccaacatatgggcaatttgagtagaatccattgccattactttttcggcattttctaatttaattccatactttgcaatgtataggtcgattaaatcaaaatctgcccgcttttttccgtctaattccgtaaccacgccgttttcgatcttaatacttggcttaggatcgttcggacccatcatcgccactagtccttcatcgggccattctttaataaaaccgtcctcatggatcggacgtttttcaagttcttcgaatcgtttttgccgtttcaaaatactgctcctttccatttgctacttaatataggatggaaaatcattctttggttcagtgccggctagttgtccaagaagctttaatccgactgcccgtccagccatcacagcctgacgcaccgcacccgaatcaccgctaatatggacgattccttcgttagaaaaactagtcccgtgaccaggagaagcaaaacttaggacatcaacccccgcagttttaattgcggtatcagccattaccacaccgatcccagacggagcaccacaaattaaaccataggctttacctaggggagctccgaaggcggtatgcaccgcaccggaagcactcgctgtaaactgtagttctagatgtccagctggggtgttgtatacatcaccaaatgtccgtgacaaattatccaacgcaacgttaattgcttggcgaacgtctgaaggatcgctaccaccaattaaaatcaaaacgccgtgtcctgcaccgccctttgtatcgcgtggcaattcaatgtccaaaacctctgtattggtcgcctttaccgcttcgtccatcgccataatctgcggaccagctcccgttcgagaacttaaaatcccgataactgaatattctctagtactcacgtgtagttcgtctaataacatcgcgtctacactagggatacacattccgatcgtgtcgccaatctcactagaaccaacgtattcgggaaccgtactagttgaattaaaaaaattattcatattcatccctccagatgaaaactgcttaaaaatgaattgtttatttcaacaaccaattactctttcttaggcaaaatgttttcaacatctgcatgtggacgagggatgacgtagcttgaaaggacttcgccaatttcttcagctgccgttactccagcatctaccgaagccttaaccgcgccaacatctccgcgaaccattaccgttaccaaaccgtgaccaattttttcttggccaatcaaatcaacattagctgccttaaccattgcatccgctgcttcaattgatgcaactaaaccttttgtttcgattaatcctaatgcttcatgttccatgagataattcctccgattttttattttccaatcgctacggcacgaccggatccaagttcagtataattgaaaccgtttgcattttttaaaggcattaatttaggaatctggttgattaagactgttcaaagtaaaatattttccataatgacaaaattaaaccattgcattttagacttttagaataaaagtgattattaaattcgaagatcacaataatttattaattttttgaacaaataactgcgttgttgccaataattcataaaaaagaggaattagaatagtttaactatcccaattcctcttaaaataaaactaatctggtttgttggcttccatttcttgttcgcgtgttttgcgcaaaaagtcaaccaaatcgttaacgttttggttagccaccgcagacaacgtaaacactcgttttgctccagcacttttaagccgctgcttcactaagttgatttgcgcgtcgtcttctgccaaatcaattttagtaaccacgcccactaacggtcgggcaaacatagtcccaaacgcttctgggaaaacaatccgactgtctaccgcactttgcataagaacgattacccccgcgtccatcgcggtggttgccaagttagtatacatgcggcggtgttcaatgtactcaccaggagtatcaataatgttgttataaaactcaattgactgcgttttattgtaatgcatttctaaatgattgattcgctgtaacagggtggttttcccacaaccaatcggtccaataaacattggacgtctcactttatttgtatccatcaacaaatctccaatacaaatggtctccggcctttaacgtttttaaattggctgctttagcaatatctttgccattgttaacgtaatatttccaacccgtccccgagtggacatcattttcagtgtatttaccgatccgattgacgtatacggttgccccgttctgatagcccacttgtttgccggcaactttcttaagggcgctaaacgccgtcatccctttttgatacttaatttgcttatcaaaaaggatttgctggttctttttaggccgttttaaatccgtttcaaccgtgacttgcaccttatctgggtcaactttagcattgccaaaacctaaatcatcattaccggaacttttagaatgtaaaattccaccaaagccaattgccacaccgataattaggaataccgccactaaaagcgaaaaccattttcgtttcattagccttcctcaatccttacttaaattgataaaccccattattagcatattttccgttgtggtatgcactaagcgcaacgaggacttgtcccacacccatagtttggtcgtatgcatccttaatagaaccgtcttctttaacaaatgacaaggtgttcttcaacgtggagttttcttgtttgtcattcaacttaacttggttaattttcttgaaagacttcttgttcattgataatgctgtaataacttcagcattggagttagcgttggacttgccatccataccaaagccaccgtctttattaacgttaactttcaagtaatgacgacccttagtaattgcttttttaacggtcttgtttttgctcttactcatttctagagcgtttaaagtcatggcggtagtgtccgcgtctacgctagcagcatcatcgttatatgcccaaccaccatcatttttatagttcttactcttatggttagtgaccttaatttgctttttagccagcttgttgcttaatttctttaccgtaaatttagctttcttaggagccttgaatttcttatttgacttcagtgctactaaaacttgagcttgttcattagtagttgtctttttattcaatactttcttattttggtaaagcatttttactaagtttagcttttcaccattagttttatatgctttgggattgaagcccacagcttgaagtccaataatggcatttgctaattgcttaggcgtactcttttttgaaacaatcaagtttttcttaaccaattgtttgtcatgatcagtaaacttatatccttgacgtttcaatccaactaacaaatcttggtaaccatcactagctcctactcctgggtaagccttcttatcaaacaatttagccttggtagttttaccagaatccatatctttagcaagatcttggttcttctttaaaaggtcatttttggcatatgtaaagactttttcggtctgatccttttgctccgtcttgcttgccgtagtaaaacttgccgcactagcggataccgtaccacctaataacaatgtaactgcagcaaccgctgcgctatactttatactttttaacattctatcccctccgaataattaaagaaatcgtttccactttttcaatataccatttcattaaagttaaaaaatgcttggcatgggaacccgcaaaaaattgttatgccttatcaaaatagttcttaaaattattacaatcttgcgcaaaatagtgcattttttaccgcttaaaattcccatccacacaaaaaatccctcaagcaacctgcgtgcttgagggatcaaattagtaatgattagtcacgttgattttctttttcagcttctaaagctgcttcgtaaaccggaagttttttgaagtaaccttccttaatcaccaaaaaatagttttatctatataagttaattgaatatggattttagtaaagattaataaacatgaaaaaaaaacattttaattaaaaaataaagcgtctttcagtatagaaacgaaataatcagtatcaagcaaataaatacaagaatatgctgtatttattccttaccgcttctatatttacaatagagtttaagagcaccttcttcacttctagaagatgaaagcatgtacaactaaatacccccaatatatgcaatcttatatctatttcataggtgttagtcgcttaacgtgattttacttttatgcggacgtcgtacattattatcaatcatattctaaagcatttccacgtgacaattttccatcctgcatggtgtaaacttggtcgactttatctaataaacgcatgtcgtgagtaatcatgatcacaccccgattatattcgtgagcaattcgtgcaagtagatcaacaacttgatgggcacgttctgtatcaaggctagctgtgggttcatcagctaatatgatgcttgggttattgtataaagcacgtgcaattgctgctctctgtcgctccccaccggataaatcttttggataagattttagtaccttttttaggtctaacaaatctaataattcttctcgattcattttttttgaatttgacttgtccaaacgatctattaaatctaactgttcttgaatattcaaaaatggaatcaggttcgacgcttgcaaaataaagccaaactccttaaaacgtaaggttgttttttctttttcattcatctgtgttgtatctttattttttatgattatttgtccactagttggcgtttgcaagtttcccagtgtggttaagaaagttgtttttcctgatcctgagggcccgatgatagcagcaaactctccttcctgtaattcaaaattagtaggaaatagagcttgtgttagcgtatgtccgctcccatatttcttagtgacattcttcatttttactaaattcataatttaatctccaatcgcttctataggatcaattttcaaaattttaggcaacgagaatagtccccctaagagagccattataataattgctaaacttagaagagaataggcttgccagctaggatagaagaaaagtgttgatggtaaaacaaattttactgcccatacaccaacaagcgctagtaagacgcccatacctgataagacgaatatttgacaaaatagagaccagataattgttttggcttgaataccttgtgcacgcataatgccataaagtcccaatttctgaatcacgataatgtaaatgaaaataccgaccactaaacaagtaattactactaaagcaataatcatccccataaacacatttacttctggtgtgtagccaggaatattacttatcatatcttgtgcagttactgtcactaatcctttcccagaaatattaacattatttttttgaacaatggctgagatggtttttgtggttgtttcagtatgttgtagtttccaataggtggataaatcagtataaatgacgggtatggtaaaaaatttactattattggttagaccaacaactttatattcatctgtacttccatttaactgtatatgatcacctattccgatattataatttttcattgattgatcaataaccacttcatttttagttctaggatagtgacccttaattaatttaggagcaataaagctgttccaattttgagcaaaaattgaagcattcactgtcgtgttatcattttttttatttgttacagcgaacatatatcctaggggaaccgcgtcatcggacagtttatctttatatttattctcagtgataaaagaggctgttaaattcttatttgaatattttgaaagtgttactcgtgttgaatcccagttatccactgcggttcgattatctcgtaccaaaccaattgctagacttgtcataaagtagaccataaaagatataagaaaaattgtaactaggaccagactgtagcgaagtttgttgtgtaaaatttcttttattgcaagatacatagctgttattcctttctatttttaaccccattgtaaattaaggtaacgatctcttctaagcgttgattttgttgttgtttagtcatttctttattaaaaatcgtacattgaacaaacagcataagaatctgactagcaattgccaaaaacaaactcgataacgtgatttgttcattaatcttcaaaaaatggggcttttcttttaaccacataattttgttgttggaattaatatacgaaaaaaatttttgttgtaactcttcgtttaccattatttcggacaaaaaaattaagacaatgtctttattttctatgaggaattgataacgattaaaaacaatgtaacggataatctcttttacttctgtgtttttttcaagatctccaaaaaaatcggaagtaaaaactggtagtatatgatccaagacaggagtaattaagttcatcgttaaatcatgtttattagtaaagaacttaaaaattagagcttttgataaaccagcttcttttgctatttgactggtcgaagtgttggatattccctgttttgaataaagtttaatagtggcttccagaatttttcgcttattctcaggcatttctgctaagtttaaccactgttcataattagacacaatcgactctgacattttatacctactttctgaaatgttttccgtgaccaatcggtcacaaaagcatggtcataatatcatttaaaaataaattagtcaaaactttaatgaaatttatgctgataaacacctaaaatctatctacaaattaataacaacttacttctaatgggataagaagctccgattttatctaattgtcctcttaattacattattcaaattgcgaaaggaactatttagaaataattttttatttacattctcaataaatagatacccctttaagaatttattattacaaagaaaaaggcatcatcagaaacatgtccccaaaaggaaacatctgctgataatgccctatagatacgtttttccacacaaaggtttgaaaagttctataatcaaatagaatttaaaagccctaagcctaaagtaattaaagctgtgcaaaacaccattagcccttgaaataatacatatattaacaaaattaggcaatcgatttccaatattggaaattgattgcctaatataaataaacaaactttttaaacctgcttttatttaattattttagaaaataattgtagttctaagaaaagtgacctcagcgtgcttgagggatcaatttagtaatgattagtcacgttgattttctttttcagcttctaaagctgcttcgtaaaccggaagttttttgaagtaaccttccttgttaacttgccggccccgggcaattcccatttcgtattggttaacgtcgccagtaatggttgaaccagcagctacgtagctgtggtccgctaatttaactggggccacgatgttggcgttgctaccaatgaacgagtagtcacccaccgtagtgtgatgcttgttgatgccatcgtaattaacgaataccacgccacaaccaatgttgatatccgtacctacatctgcatccccaacgtagcttaagtgacccatcttagtccgggcccccaatttagcattcttaacttcacagtaattaccgacgtggacaaattcgccaatttcagctttcgggcgcaaatggctatttggtccaatattgctatcgtggtgcatgatggcctgttcaatttgcgaagaggtaaccgtaacccggtcttcaatagtcgaatccacaatcttagaatgcgcgccaatcacgcagtccgaaccaatcttggtttgaccttgtaattgaactcctggttcaattacggtgtcagcgccaatttcaatcccgtaatcaatgtatgtattttccggatccacaatggttactccattacgcatgtgcacttcgttgatgcgttgttgcattaccttggttgccttagaaagggccacccggtcgttaactcccattgattcgctaaagtcatccatttcgtaagctgcgacaatttcgccagccgccttcataattccaattacgtcaggaaggtagtattctccttgagcattgtcatttttaacttggtgcaaagccttgaacaatttctgattgtcaaaacagtaaactccggtattaatttccgtgatttctgcttcttcacgagtggcatccttttgttcaacaatcttatccaccaccccaaggtcgttacgcacaatccggccgtaggagaacggattatcggtccgcgcagtgagaattgtagccgcagcgcccttttgacgatgatattcaaataagttttcaaaagttttagcggtaaacagcggagtgtcgccactaacaatcatcgtaatcccgtctttgtcgcctaaaatgtcttcggcttgtaaaacggcgtgccccgtaccaagttgttccttttgaaccgcgtattccgtccggtccccaagcaattcccgaaccttttctgcaccgtgaccaattacggtaaccacgtggtccatatccgttttttcaacttgggttaaaacgtgatccaccatcgctttaccgcaaacgggatgtaataccttatataattttgatttcatccgggttccttgacccgctgctaaaataatcgtacttttcaccattgctacaattactccttagtgtcttctttaaaatttctttcaaaatagtttccggccttgatttgaacttgtccggcttgggaagtgtccacgttcaacaacgaagtgaagtcctcaattgcccgttgtcctttgtaagttccttcagctagtaccgaaattccaatcaattctgcttcgaattctttcagcagatcgaccattgcatgaacggtgccgccacccttcatgaagtcatccacaatcaaaaccttcattccgcgctgtaaactgcgtttagaaagctccatcttttggatacgttccgaagagcgggatacgtaattgaccgaaattgtcgaaccttccgtaatcaccgattcgtgccgcacaatgatgaacggaacgtttaaatagttggctactgcttgggctagcgggattcctttagtttccacggtcattaccgcatcgacgtcggaaaatacgtactcactagctagcatccgtccaattgcacgcaaggtgtccgggtgccccaataaatcggacatatacagatacccaccaggcagcttacgatccggatccgaaagttgttccgtgagatcctgaataaccttttgggcttctgctttcccaattcccggtaaatatttaattccaccagccgctccattagtaatttcaatggtccctaactgtctttttgctaaagttgatttcataattgataaatcttcactaatcgaagatttagcggatgaatatcgcttaacgaaaaatccagaagttattagtgtgcggggatgattaataaggtagttagtcatatcaatcagccgttcactacgcttcagtttcattgctttcactccacttcgtttgtctattagatatttgttctcattaaccaatatcataccacagttcaaggataatgttcgggtttaggcgaaaaccttaatataatttattgcaaaaattcataaatgtaaaaagaaccggaaaacagtccttttcaatcgttaagttgctatgtattgggtggaaactgccatttactgcttgcgtagccccatcacacttaggcaccccaattcctccatccaattaaataagggaatcaatcgctaaacttgcgaccaatccccttagctggttaatttttaaatttcgtccccaattttgaggtattctaatcttttctccccagcaacatcgctgaaaagtacactatgcattcaattaaggcgatgaagaaacttaccggccaactcgttacgtagcccaagtacagtcctaaccaaacgcctaccaaggcagcgcctaccgcaaacagcatcataccactcaccgttttagccacgatctttgcggcggctgccggtaacgttagcaacacgaaaattaacagtgaacccacaatttgggctgccgtactaacgctcaacgctaacactactaaaaagataattgaaataaaattcgtgtgaatcccctttaccgaagcacccacgtggtcaaacgaatcaaacttaagcggtcggtacatcaacaagatgaaggctaaggccacgatggtgagcaacaatacttggcgaacctctgaccggccaatcccaatgacgctcccaaacaaaatgttagtagcgtaactaacgtttttgttagaaattgaaaggaataagattccaagccccaaaaacaaacttgaaactgccgaaattgccgattctcgtcgtgaagcttgcacactcattttaccaatcaaaattgagctgacaatggtaaacagcaacatccccgttaaggcttgccatcccataaaaattccgaacgccgccccagaaaagccaatttctgaaagcatgtgggacaagaacgacatgttgcgtcccactacgtagactcccataatcccacaaataatggcgatgaaagttccggcgatgtaggcattttgcataaattcaaaactaaacattgggcaaatcctcctcactgtgaatatcgctgacttcgcccaacgcgtaccggtcttctttcaacaataagtacttgtcggaatattttttcattaaatcgaaatcgtgcgtaattgataataccgttaatccgtgccgccgattaaaatgttgcaccaagtcgaaaagttcgtatttacgaacactatccaaacttgcagtcgactcgtccaagattaacaaatccggctgatcaaccagtgcctgagctaaatacgccctttgtttttgtccaccggacgcccgacccatccgggtattttgaatttctaccaaacccgtttcttgcaaaattttgtctagttgttggcgttctttcttggataaccacggtaaccgactttcttgcaaatttagggctacaaagtcccgaatggataatgggtaatcccggtcaatatttctaaactgaggcacgtaaccaatgttcactgccgaccgaaatttaatctccccgtgagtcggtttaacttggtgtaacaacgtcctaattaaagtggtcttccccaccccgttttcaccaattacacttaaaaattcgccccggtcaatgttgaagcttaaatgattgaaaagtttttgtcccgggaactcgaccgttaagtcgtgtacttgtaccaatgtctccgtcattaatctttccctcttattattttactgatttgatttagttggctaaccatccactcttgatacgacttaccgtccggcatcgtctccgtaacattgataacgggaacgtgatgttttttagccatttttaaaacttcatcgattaccttattaccagtctgttggttgttaacgatgaattccactcgacgctgcttaagatcttgttgcaggctttcgaccgtttttggtgaaggatcggtctcgttttcgattgcaagcgcaaatttccggtcgctaatttggtaacctaactcccgcaaggtgtaatcataaaccggttcggttaccgcaacttttttccccgaactttgttgtttaatttcgtcaatcttcttctggattggctgcagcgatttaacgtatttttgagcgtttcgctggtaaaattcgcgatgttgcgggtctttcttacttaactgtttagccacctggtttgctagacgttccatagttgccaaatcgtaccataaatgaggattctcaccattctttttgttcatcaaatgtccgagattaatcacctgaagtccctttttatgcggggtgatccgttgcatccaggcgtccgtccccatcccattttcaattactaaatcagcatccaccatgagtttagccgtcttggtcgttggctcaaaatcatgcggatcagtcgccgcattttgaataatattcgtcaccttgacgtacttaccgccaactttcttggccacgtctccataaaaattaagtgaactaactacttgaaccttatccgaatgttttggcttggttgccgtacatcccccaagcaaaaatactcccgctagtaacaaaactaaacctgctaaccaacttcgccttccgcgcatcttcttcctcctaaagagtaatcattactatttactctgacaattataacaaagaacgcgctagttgctagcattattctcaagataacgttttcaatgatgtatactggaggtagtttcctaatagaaaggagaatttgtttggattatcaaatgccgtttttcaaagaaatcatgcaggatccgcagaatgccgtctttactgaaaaaggttggcaccccatttacatgctcaattcccaggcgcggattctcatcgtcggccaagcacccggcaaacgcgtgcaagatacagaaattatctggaatgataaaagcggcgatcgacttcgggattggatgggcatttcacgcgagactttttacaattctggaaaaattgccgttctaccaatggacttttactatcccggaaagggtaaaagcggggatattcctccccgtaaggccgttgctgaaaaatggcatccccaaatggtggctgccatgcctaatatccaattaaccttgctgattggcgcttactcgcaacgttattacttaaagaccactccgaagacgaccaccacggagttggtaaaaaattaccaatcgttcttaccaaaatattttccgctagtccacccttcacccagaaataatatctggctggcaagaaatccgtggtttgaagaacaagtggttcccgatttaaaacgccgggtcgcggctattttacaggattcttaacgtctgaccaccctttactaatttttgctgtaaaacaatctttgcacctaaaataggtattctcaacccaaacgccattatccttacaaagcattaaaaaacaggagctaactaagctcctgtttttatatcgatacgtttttaatacatcaagacttgggccactaaaattcccccaccgaagacgagtaagaaaaccactaccggccaaacaaacttgaaccagtgggaatatttcatgtcgagcatttggagggtagccattaccaacccggtaggggcaaggaacaacattgcgtattgcccaaactgataggccgtaaccacgacaaaacgtggaatctgtaccgtatctgctaacggcgccaaaatcggcattgaaagtaccgctaaaccagaagatgatggcacaatgaagcccaggacgaagtaaataagtaacatcacgataataaataccggcccgctcatgtgggcaactaacgacgaggaaaagtccaggattgtatcggaaatcattccttggtttaaaatcaagttaattcctcgagctaaaccaataatcaacgataccccgactaagctcgaagcaccgttgacaaacgcgtcaacgacacctttttccccaattccatttttaccagtcgctgttaaaatcatgatcaaaatggcaaaggccaagaacgaagccgccatcttagggaaccaccagccctgggtcattactccccaaaccatcaaaggaaaaccagctacgaatagcgctaacacaattttctttcgtaaggtaaacgctgcttgttgttcatcattatttattaccgaccatttttggttaaattcatcccggtcttcgtaagagtacgaagctgccggattttgtttaaccttcttactgtaccagtagaggtagccaattacgaacaacgccgccactacacaaccaaaggcccgccatggtaacccttccgtgaagctaatccccgccgcgttggaggcaattactacggaaaacgggttaattgttgaaaaggccgtcccgattgaactagctaagaaaatggctcccacacagacaatcgaatcgtagcccatcgcaatgaagacgggcacgaggattggataaaaagccaccgcttcttcttcaattccgcataacgttccgcctagaaccattaacgtcgctactaagaaaattaacaggaactcgtgccccttcgttttcttcgtcagcgctagcaaaccggattcaaaggccccgcatgcccttaccacaccaatcaaaccgcctaacacaaagataaacaccataatgtcgacagcttcgatagttccgttaaccatgctcgaagtgatttgatcaactcctgcaggatgctgcttcaagcgttcgtaggtgttgggaattgaaatttcttggttaatgcttcccgacgtgaacttctgaatgttaatcttaacccccagtttatccaattctttttgagtagctggtaccttttcaacctgtccgttaggctgttttacctgtagagacgagtttgcttggttgtacgccaattttgcgtaacttcctgaaggaactacccacgtagcgattaccgccacaatcgtcaaaatgaataaaattacaaacgctcccggcattttaagcttaaaacgccgttttccctttgttaacataatggcacactcccttaccaaaagacggtcaaccttgcagaagctctttaaaaataagccccacgccagttgaccatcttttttagttttatttaattgtgtgccttcaattttgttagttagtcgtcattttcatcctgaaaaaattcaggtttaaaaacaaaccgtttatgttcataatcaattaagttttgttccaccaagtatttgacaatctgtccggcagtctcccggctggttccgctcatcaccgctaattccttaatgcggaggggatacggaattttagaactaccatccggctggagctgtcctaaatcagcttcaaaagttttcaacgcttggacaattcgttgtcgtgcgcttggggtaactaactgctgaatctgatcttctgattcgctaatgattgaactcatttccttaaccaccttgaccaacgccgcgttgttttgtcgtaacaacgattcaaaaactgacattggaaaatagacaatttcaatatcggtcattgcctgggccgtgtacggataataacactccgtaaacatcccccggtaaggaaaagcaaggtcggccttaatgtatgtataaaaagtgaatttatcgtttgcatcggttcgctccgctcgtaccaaacctttaatcacaaagtacaaattttctcgatcatcgctttgatcaaataaaacctgtcccttgggaaattgctttacgtgcatttggttaataagctgttgcaactctgcatcggtaaaatcactaaattccggtttagtttttaaatactttttcggattatcccgaatggaatcctgctcgtttgtcatatcattactcctagctgatgattcttagctcttaaatcaagtaaccaaagttctaatataacacattcctaaagcgagattccgcccgtaaacattagacccacactcaatagcgcacccgcggtaagcaatccggtcactaatttttctttgtgcgacaagcggactgcgcagccattttcctgacgagccttcccgtagaagtaaatacctggtaagtaggcaattaaacagagtaataagtactcaatccctgccatccaaatccccacgacttcaaatactaacgcgaaaactccaatcattagttgcgcccgatttccctttacgtttaggtgttgataggaatacttgatttggtacgctgctactaggatataacagacgataatcgaagccgtacaaagcgaataagcaaagttatacgcacgcgaggtaaacaacaaggtaaacagaaagccctgtactaaaaacgcagtcattactaacgcaaatgttggtgcattatgccggttgaccttaccaaaatactttggcaatagcttttgcttagccattagcaaaatggtttctgctggtagcattgtccacgacaaccacgcacccaagatggaaacgattagaccgatgccaatcaggtaaccgccccaaggacctaccatctgggcaaagacgtataatagcgctggctgatgaaggtccgccaactgcgtccgggttaggtagccatatggcaagattgagattagcatgtaaattgctaatagactaatcaaaccaaacatggttgcctttccggcagttgacttcttctgcgcccgtgcggagagggtggaagccccttcgatcccaacgaagacccacatcatcaccatcgtgcagtttttaatttgctgcattacgtcactgactacaaagtggcttcctacgttatcccaaaaagcttgggtaaaaagatgcccatcaaataaaataattgcagttacgataaaaacgaacaacgggactagcttaccaatggtaaccaccatgttaataatcgcagcgccttcaattccctgactgacaaagtaggttaaacaccacagcaagacgcttgctaacaaaattgaaggtaagttttgtcctgatttaaagacggggaagaaataccccaaagcactcatcatcatggttgcaaacgccacgttgccaagccaggcggacaaccagtatccccagccactaataaaacctgcaaacggtccgaatcccttttgtgcataggaaaacatgccttccagcttcggttccttaagcagtaagttatttaatgacaaagctaacattaaaattccaaaaccgacaattaaccatgcgattatcatcggtcccggagccgctgcacgtgctagatcggatggtaggccaaacaccccacctccgatcgatgaactaatcactagcgcacataatggcaataaaccaatttttttgggcggctttttttctgacaagttgatcacctctaaaaagtttgtgtccgtgagcagaacaatcagctcacttaataatttgactgtttacttaaaatttagttgtttagcggcgatcattaatcacgattgatgaagcaatccgtatcgatctcactagtagcaacgttttagctagtactcttaaatacgcgtaaaaatatctaactagttaaatacgacaaatgctttcggtaacccctcaatcaggacactgagcaaattttttattgttttaaactaaccgtatcgaaataattggcgtgataattcatccgagcccgggctacgatacatagttaaaacaataaaaatagtttcactccatgggtctattttaccgattaataaaaccgctttcagtggatatttaacgttctaaatgttagcaatttatcatttttattaaagtaattgtacaaaacaaaggaaaaaaaggcgaggatggtgctcaattgagagagtgcggaagcctccgggtaatctttgaggattagtttaattatgtaattaatcgcaggtttggcgattgattgcataattttactaaccggaaaagattggaggctggagcacgtttagtctgtattgcaaattaaacttttgttcaaccggagagtttgggtttgggaacgcattttgactacctcgcaagcccaccattaattaaataacaatcgctaaaatttcatccgtcaccatttttttacaattctccgtcacaacaaaaaagctcagaacgatgtaattctcgttctgaactagttcaaagctaaattaaaactgacttactgaaactgcattccgccatccacaatgatggtttgtccggtaacgtaattagaatccggaccagctaagaacgcaacgactgcagctacgtcttccggttccgaaagtcgtttttaaggtgatgtcctttgcgaactgttgcatcccccactcgtcatctttgccagcgttttgaccgacttgatgagcgatgtccatcatcattggggtttttacaattccaggtgcgtaagcattcacggtaattcccttgtctgccaaatctcgcgcagccacttgcgtaattccccggaccgcgaatttagtacccgagtagagtgctaaattaggatttcccactactccggcctgcgaagtcgcgttaataatcttgccaccgtggtttaacttttcaaactgtgcaactgcagcttgaatgccccacaatgggccagcaacgttaacatgatataccttatcaaattgctcaggagtgatggtttcaattggtgttgtgggacctaacccagcgttgttaactaacacgtcaaacccgcctagttggtcactaacctgagaaaccgccttaaacacgtcatctcgattagcaacgtcaacttcaacaggaatggcggtttgtccgcggtcgttgatctcgtccgctacttgttgggcgactgcggcctttaaatccgcaactcccactgcgaaaccatcctgtgctaagcgcaacgcaatcgctttaccgatcccttgcgcagctcccgtaaccatcgctacttttgatttgttcatgctcaggattcccttctgcttaaaatcagtttactatttcttagaatctgccttggcaaccgccgccatcgctaacgcattaatgtagttaagcggttggtcgtaatttggttggaagaacatgtccaccatcgacaagtcatcaatggtcatcttgttttgaattgccaacgaaacggtgtttgcagattgtgcacagtcataatcactgtagaacgcacccccaagcactacccgggtctttggatcccaaaccaagcgcattaaaattggggtagtggtaagcatgaattctggacgataatcttgttcaagagttaccgaatcaacttccacgccccgcgcttgtgcgccaccttcggtcaaaccggtacttgccaaagttttaccaaaaagtgctaccgcagaacttgcttgggtacccaagtattttacggttggtttttcaatgttatgcccaattagaattccttgacgaaccgcgttagttgccaacggaatgtaatcgtctttgccagtaggattgtagtgcactactgaagcatcacctgcggcaaaaatgtctgggttcgaagtttgcatatattcatcagtgatgattgcaccgtttttgagcatatcaaccttgttctttagcaaactagtatgtggccggaaaccaacgcagagaattgcgtaatctgctgtgtaactgcccttatcagtcttaacggtaatttgatcagttccgctaaagccttgaaccatttcgttcattgctaatttaacaccgtggtcagtgtagtctttggcaacccggtcagaaatttcagggtcaaagttctttgccaatacgtttggtaaaccatcaatcaaggtaacttcacggccagtgattgcatattgttcagccaattcagcgccaatgtagcctgcaccaattaccactacggacttaacgtcgtcgtcaatccgttttaattctgccgcgtcgttccagttcttgcaaagcttgattcgttcgttatcaattccatcaattggcggaattacaggcgatgaacccgtcgtcataactagcttatcgtatgtatcggtaaactcttcatttgttgcgagatttttaactttcaaagcctttgtatcggggtcgatatctaaaacatcatgcttcattttcatggttgcaccaagttcagtcaacgcttctggcgatgaatagaacattttctttggatcagaaacgtggttccctacccaaagtgcaatcccacatgataagaatgacaaattatcattacgttcgtaaaccgtcacgtcgtaatcgggatgttctgttaagatttgttgtgctgcaaaggttccagcgtgtgtacaaccaactatagcaattttcataagtaaccaacctcctagttgtttataactaaatagtaaccgttttcaaccgtttgtcaactactacacaagtcttggaaacgctcgctttatcgcggctattgaacctaatagttaacactgttgatttattggaaataaattagcacattggcttttagaagcataaaaaagttgggactaaaattcacgaaaaaatttttattcccaacttttttgcttaaaattaaccgtcctcataacactattttttaaccttggtgactcaccttagtatctttcattagctcgccacaccgctgaccaatttgctctaaaacgtaaactaccggtacttgagaagtgaagtctagcgtccccactttcttttccggaatgtcgtatgccaaacaatggtcgcaaacctgcgcaagtgttgaaaggtggttggccgttaccgcaacggtagtcgccccattttgtcggtaataattggcttgtcgcaaaattgcatcggactcgcctgaaacggacaaaaacatgatcaaagttttagtatagtcccggccctcaatcggctgcggctggtacggatccataattgccaaagaaaacaatccgtaattagataacactcgggcaccgtactgtgctaggctgctactcgatcccatccctaaaaaaaggcgggtgtgcgcctttaaaaataactgcgctaccgtggaaattttttgccggtacttaggcaaattagcttgcgttaaaaattgggcaattggtccccactcttgttctacctgtccgaaccgatcgggttcatcatgatgtcgcaacgcatatttgaaatcggaaaatccttcgtaacccattttcttcaaaaaacgcaaaaccgtagtggatgacacgtgacttttagctgataaatctcgaatcgtcatcgttttgcattcttcaagatgaccggcaacgtacttataaacaaacatttctaattgattgagggtctgaattcgttcgtaactaaacaccttgatcacctccttaaaacggcattaaccttgtaacctgcaggacgtcagcggttttaattaattagtagttaaatccgccccgtttgaagcaattaccttttgataccaagcaaatgaatccttcttagaacgcgctagacttccatgacctgcgtcatcttggtcgacataaataaagccataacgcttggccatttcacccgtgctagctgagattaaatcgatgcagccccacggagtgtagccaatcaaatcaactccgtctaacacgacggccttttccatctcgagaatgtggtcatggaaatacttaatccggtagtcgtcatgaacctggccatcggcggtcttttgatcgtaagccccaaaaccgttttccacgatgaattgtggtttatgccaacggtcttgcatccaattcatggaataacgcaaaccgattggatcaatttgccagccccaatctgattttgctacgtacggattatccactaaatcagtagactcccggtaggcgtagtcgggatcgtcgtcattagcctttgtcgtaaaggacatgtagtaactaaagccaatgtaatctaccgtgccctgcgctaaaatttcgcggtcttcatcgctgatgtccacggaaatattacgccgttgccagtacttcaacagccatgcgggatattcaccattcgcctgaacatcaccatagtaatagcgggtctgcattgcccgttcagccttcataatatccgctggtttagcagtaagcgggtagatcggacacatggcaatcattgccccgacttgataatctgggtcaatttcgtgagccaatttgaccaccttcgcgcttgcaaccatttcgttatgggccgcctggtacattaacgcttctttatctggcgtagttttcgtaactagcaaccccgagttttggagcagcgggtgcggatcgtcataatcagcttgattattaatttcattaaaagtcatccaatatttaactttaccgcgataacgttccattaccgtcttggcaaaccggacgaaaaagtcgattagttttcgattagtccaaccgccatattcctttactaggtgataaggcatttcaaaatgggacagggtgataattggctgaatatcatgttttaaaagttcatcaaaaacgtcatcgtaaaactttaatccggcctcgttgggttccgtttcgtcgccgttagggaaaatccgtgtccaagcgatcgaagtccgaaagcacttaaagcccatctcagcaaaaagagcgatatcttcgcgatagtgatggtaaaaatcaattccccaatggttagggtaaatctcaccatccaccactccgtccgtaactttacgcggagtgtctttattgcctgccgtcatgacgtccgcaatgctaacgcccttcccgtcggcttgccatccgccttcaaactgatgggctgcaactgcgccgccccataagaaaccagcgggcatccgataattttcttccgtcatcaaatctccaccttacttttcagctaatttcttatataagtccacaatttctccggctaaatcccggaaagtgatggcattcatgatgtgatcttgggaatgaaccgttaataaagttaccttggcatggttgccgttggcttcttcagtcagcatcccggtttgggcgttatgtgcttcagttaaaaagccgtcagattccttcaatttttcatcggcacgcttaaagtcaccttccttagcagcgttaattgcttcaaaagcagaactctttgcgttccctccgttaataattaatcccataattgcttgcatatcttgttcttgttcagccatttaatttacccctttcgatacaaaaaagcgctccagttaagtgaaagcgcttttaaaaaattcacaacgttacttaatttcccattgctgataaagcttctttgagaactttttcgccgttcatcatgccgtagtcttgcatatcaataacttctactggaatatctaatttctttttgaagttgtcttctagataacgaacttgcggtccaagcatcaaaatatctggtgatttttcggataatttgttatccgcatcggatgccgccgttgcaaagatttccgcgtcaacgccttcagcttccgcagctttttgcatcttggaaactagtaaactagtcgacattcctgccgcacatactaacataattgttttttcagccatatgaatcactcctgtaataaatttaatttaggcggttgactatgaaaccgcttacgttacaattgaattataaaacgtaggtacaaattttacaagtgccaaacatttaaatttgtcaccaggttattaaaaccagataaagaaggtgtcactaattgtatacatttatcgcaaatgatttgatttataaaataaatcaccagcagttcaaggtaaaattgcctaccgaatacgaattaatgcaaaagtataacgttagccggaacacaattcgtaaggccatcgacatcattagccaaaagggactcgtccgtcgggttcaaggcagcggatactacattaataatattggcgcggacaccgatcggatcgttaacctcaccatgggggtttccgaggggtttaaccaccaaaagctaacttctcgggtagttactttcgaccggatgattgccgaccgggccatggcgaatgagtttggttgtgaagatggcgatgaactataccgaatcatccggtaccgttaccgtaaaaatcagccttatatattggaatacgcttattacgagcgcaatgaagttccctttctaccagtcgacgtcctgcacgaatcaatcctcgagtttattaaaaccgaatacgatgtcaccgttgattcgagcgaccaatacgttggcattgaaccgttatcgccagaagctgcgtccattaccggctttcctcaaggcgatcgctatatcaccctttaccagtcgcattaccggaagaataacgtcttattcaacttctcgaaaacttattacttagatcgcggcacccgtttctacttccatgccattaaccagagctaggtaatttttaaatcgtcgttgacaaactaaaaagtcttccgttatactcatggaagattaacttgtaaggtaggaataagcaaatgagcattttaaaacgaaaaaatgtcaataatggttggcaaagccggtaactaggttgtgttttgcaaaggcaagatacgacctgtatacagatcgtatctgtgccggctcatttgtgttgaataacgctgataatcgcccgcatggatcattaaccgccatgcgggccttttttggacaggccctctgggtttgtccttttttattactttattttaaggagctttgcttgtatgaaaagaatgttaagttttatcgtcatcatttttgcgtttctgggatttgcctttttcaaggaaggaaattctaccaaccaggctagccaaaccaccaaaaagattggcatcctgcaactaatggaccaaccagctttaaaacaaattcaacgcggggtttactctggcttaaagcaaaccgggtttaccgaaggaaagaatctaaaggtggactaccaaaatgctcagggaaatcagagtaacctcaaaaccatgagcgagaagtttgaaaacgaaggggtcgacctatcgattgggattaccaccccagccgcccttgctttggcaaatactaccagtacgacgccggtcattatgagcgggattaccgatcccaaaggtgctcgtctaatgactaacctaaagcatccgactacgaacgttaccggcgtctccgaccaggcgccgttagcccaacaattgcaattaattcagcagctcatgccggatttgcacactttgggaatcatttatacttctagtgacaactcggccgtgacccagtaccaccagtttaaaaaactggcccagaaggcgggcattaatcttaaggcgtattccatcgcgaactccaacgaccttaaccaggtttcgcaatccatggcccaggcggtggacgcagtttacgttccaaccgacaacaccattgccggagcgatgtcaacgttggtcaaaaacaccaacgcggctaacgtgcccgttttcccagcagtcgattccatggtcaaaaatggcggaattgccacttacagcgtgaaccagtataaactcggcgtgttgactggaaaaatggccgggcggattttaaagggtgaaaaagttcgggaaaatccggtcgaatatcttaaacgcggcgacctaaccattaacttaaaacaagcgcaacaaatgggaattaaaattcctaataacttactacaaaaagcacaaaaggaaggggttatttacaaatgaatctaattacttctgctatcggtcaggggttgctgtgggggctccttggcgtaggattatttttaacttttcggattttagactttcctgacatgaccgtggaagggacctttccgttaggagcagccgtgagcgtgaccgcaattactcacggagtagacccgcttttggcaaccgtactagcatttggcgtaggtatgttagcaggtctgaccaccggtttactgtacactaagggtaaaatcccaattttattggccggaatcttagtgatgaccgcctgctactccatcaacttacgaattatggggacttcgaacgtatccttattaggacatcacaccttgtttagcggtgcgttcctaacttcattaccgcccttcttcgatagcgtactgttaggtttgttaattatcaccgtggtggttgcccttctagcgcttttcttgcaaactgagcttggccaagccttcattgcaaccggggacaacgaaaaaatggcaaaatctttaggaattcacaccgaccaaatgaaaaatttaggcctcatggtttccaacggtttaattgccgtctctggtgccttgatcgcccaaagtgacggttattccgacgttaacatgggaattggaatcatcgtaatcggtcttgcttcaatcattatcggcgaagtagtttttggcgagctgaccatgaaccagcgtctcgttgccgtggtttgcggtagcatcatctaccggttcgtacttctcttagtcctcaaggccggctttaacaccaatgatttaaacttaatttcttcattagtactggccctttgcctaatgttgccaaccttacgccaaaagttgcgtttatccaacattgtccgccgcggcctttcaccaattagtcaggagcgtgattcaaatgaataaccaagtaattttagaattaaaaaacgtgtccgtctacgccaaccggcacactagcgaagaaatccaaattttaaaaaacattaacttaaaggtctaccaaaacgactttatcaccttgttaggttctaacggagctggtaaatcaaccctttttaacgtgatcgctggaaacttagccgttgacgaaggccagattttgcttgcgggaaaagacattacccacctttccgaagaaaaacggactcgctacattagtcgggttttccaagaccctaagttgggaaccgccccccgcatgaccgttgcggaaaacctattattagctacgaaacgcggacaacgtcgcggattgcgtccccgtcgcttaaaccaacatactgccgaattcaaacagattaccgcaagcatgcctaaccaacttagcgaccggcttaaaaccccaaccggaagcctatctggtggacagcgccaggctttaagcttcttgatggcaaccatcaaacggccggaaatccttttgttagatgagcacacggcggccctcgaccccaaaaccagcaccgagttaatggtggctacccaagaacggattactgcggatcatttaaccgccctgatgatcacccaccaacttagcgacgcggtcaagtacggtaaccggcttttagtcttgcgaaacgggcaaatcacccaagatttaaacgccgaagaaaaggcccgagcggatttacgagaactttcaatttattaagattacactgccttatataacgaatcattatccttaacgattaaaaataaatatttttcattatccataattgcggatataatgtgaacaattccaaagccatcgggaatttcaccaatgttaaggaggatttgatgaaaaaaatattattagttttaatagggttgttgattatcgcaactggaatagtctacttgacgggtccgcatcgttcatcaaccaccgcaaaatacgttcagtccaccactccaacgttatttgtccatggctgggggagcagctttcacgccgaagaaaaaatggtggacgcagctcgccaagccggggtaactaataccgtagtccgcgcggacattgctaaaaatggtaaagttacgtttaaccactccatccccgcggacgcaattaaccccattgtggaagttaacttagcggataataaattgacggcaaataatgaccacgaagattacgttagcggatatcatcgtggtggcgaatacattaaacaagttgtcgtcgctttagaaaaacagcatcattatcactcaatcaacctagttggtcattcgatgggaaatcttgaaattatcaattatctcaatgataatttgcacaatgccaagcttcctcaggtggctcacttggtagcaattgcggggcattacaacgggctgatgggtgaaaagaagagtgagcaagccaccgttaatcaggctactggtaaaccaagctggatggcccctgcttaccgagaattgcttaacctgcgcaaaaattttcctacttcaactgccgtacttaatatttatggcgatttagacgatggcagtcattctgacgaagccgtgccggtaaattctgccaagtcgctaaaatatttagtaagtccgcgagccaagtcgtacacggagcttgaaatccagggaaaaaacgcgcaacacagcaagttgcataacaatgcccgggttaaccgtgcgttgattaagtttttatggcaaaagaagtagcagtcacttttaagcacttccgcccactaatctaagaaatcagctaacacaaaaatagccttactgaaaaatctatttcagtaaggctattttagtggcttaatcgcttatttttcagcatccttagccgtagtaattctcaatgaagctaataaaccaaccacgattaacgcaattgtgaagtaaaatccgtaatgcgttccgttcgtaaatgctgcactcaagtggccactgccatggtgattttgatatgccgcttggccaattcccaacaaactagttgccaaggccgtcgcaatcgcacctacaatttgttgcatagtgttcatgatggtacttccatcaccagattgtgctccctgtaatgaattcaacgcgtacgtttgcgctggagacattgctaacggagcgccgaccatcaaaattacgtgtgccgcaattaagtaagcaatcgacgtatgggtggtggtgaatactagcatcaatgcacctaccaaggcaatgattaaacctaagcgtaccggagtctttgcgcccaccttatcataaagccggccagcaactgcagataccaacgcgttaataataccaccaggcaacatgataatccctgttaaggcaactggtagtaacaacccccgttgaatatacattggcaacaagtacattgctgacaaaataatgccaaaatctaacattactaagaccgcgccggttcgaaaagccggaatggcaaaaatctttaagttaaggactggttcagcaagggcaagttgccgcttaacgtaaagtgctaagacgacgattccaacaatcaacgaacccagcactagcggggaagcccaaccttgttcactggcaaagctgacacccattacgattccagaaaaaccaataattgattctagtagggaaaggacgtccaccttaggcttcgtcaattcaccgacgttcttcaaaccaaaaatcgcaaataatagcgcaattactaagaatggcacaaacgcccagaaaatccaattccaagataacttagctaaaattaaaccggtcaacgttggaccaattgctggtgcaaacataattaccaaggcacacattcccattgccgcacccagtttgtaaggcgggaaaacttgcattgccacggtaaacatcattggcaagatcaaaccggtcgcgattccttgaatcatgcgcccagccaataacattggaaaggctgttgataacgcagaaactaccgctccgacgataaacgctaacaacccaaatataataatctgacgggtagtaaaccatttcgaaattaaactcgaaaatggtaatacgattccgattaccaacatgtaacccgttactaaccactgaatcgtaccagcggcgacgtttaaatggctcattaattgtggtaaagcaatgtttaacgaagtttcgctaaacattcctacgaacgcgccaatcatcatgcttgccatgactatcatgggatgagcaactggaactctagcttgcatcatgccattgttttcattttgtttcatttaaaatcaaaccctctttctttcacgtactctagttgttttaagtaccctatctaatgacgcaactagattactatagcagaaagaaaattttttcgtaagttttttcttgaaacttcgtgaaaaccacgtccccattgttcttaaaatgcaaaaagagtctgcagagaacatctcgcagaccctttatttactcatttaattagttattcatcggtttcagaaatcgctagcaccttattgaaaataatggtttaacggaccaccagtactgaaatcggcgcgtgtttagccatgtatgacgcttgcgaaccaaaatatttggccatgcccgtcttagaagaggagccaatcactaataaatccgggttaactcgcggaattacgtttttgacgattgtttcgccggcttccccttcggcaatgtaagtttggaccttcttgattccaaactcaagcgcaatttttcggtactcttgcaaatgtttttctagctcggcccgtttttgggtaataaagtttttatccaacgcctggtaaatattaatgtcgttttcttcaataaccgttaccaagtccaattcagcatcatcttgtttagcccggttcattgcaaaccgaaaagctaattgcgcgtccggggaatcgtctaccccgactaaaatttgactgaatcttcttgggttcaattcccgcgtactactcatctcaattcctcctgttatacttccttagcaatcgtgaaattatccattttggtgcgaaccagcaaaacgtcaactggcgcaatgcgaactacgtaatcagctaccgaaccgagcagcgttcgttgcaaagcgttcaggccggtcgaccccatcataatcaggtcggttcctaacttctctggcaaattagtggccaccacggttttcggatcgccggcttccacgtatacgtcaatatcagtaaagtggtacttttgctgaatttgttccttaatgttatcgacatattccttagctcggaggagggatacttcgacgtaattcatgttagtacccatatgcccataaatatccataaaacgtgaggactgaataacggtaaccacgtctaaatgtccatggttccgctgagccaccgaaattgcttttttcagcgcccattcactattagcagagccatcaattggtactaagatctttttatactcgagcatgtccatcactcccataatttatgcttctattatagtaaatttcctacgagagcgctaccaatcccccatagcagaacggtttccgtccattataccgttgccacgttctttaaccagtttggcaactatgtaaatatgctaccttaagaagcgatgggcaaccattaccatttcttggtttgtctgcacgagtccatccttcacccattgcacaaccatttgacttaagccgccagccgcaaaattaacccacattacggggatgtccgtccgtaatttgaaaattcccttttcaattagatcggttaggtaaaaatgcaatttattatacaagcggtcgtttaaatcagcgtcgattaaaattccaatgtaataagcatttttccgacaaactgcaaagtaagcctccaagaaggcactaatatcgtgattaggacgagtcattaagtagttaaaaaattccgtaaatatctggtcaattttatagtcaatgatttggtccttagatttaaaacttcggtagtacgacatccgcgaaactgacgcagtctggcaaatgttactaactgatatgctggctaactcattatcctttaacaactcaaataacccgtcgacaattttcttttttgttgcttcatgattagccatttctatccctcacaaaattctcactaaatatacttcatgacaaaaaccctttaagctgttaacaatatgtttagcccgggtcgacttggaacaaattccaaacacggtcgggccggtaccgctcatttgcgctgcgtccgccccgaattgtttaattttatccttaatttttaatacttccggatgttcttttccggttacttgttctaaaacgttccccatataacgacaaatactatcataatcctcgtgttcaatcgcgtcgagcattaatttaatatttgagtgttgtaaagtttggtgttcaattttactaataatatggggcgtggaaacgctaagcttgggcttggcaattaccacccacattgggggcagcttttttaagggaatcaccttttcaccctttcccaaaacgtgtgccgtatgcccatagacgcaaaacggaacgtccgaatcgatggccaacccaattttagccaattcttcgttatttaattttaaatcccacagctggtttaaaccgcgcaataccgctgctgcgtctgaagaaccgccacctaaaccggccgctaccggaatgtgttttcgaatctcaatgttcactcgcgcgcggatttggtacttttcttgcaaaactcgggctgcttgatacgctaagttccgactatcgttaggtaaaaaaccagtattcgtccgcaccttaattcccgtgcgtcctggaatactttcaatcttgacatagtccgctaaatcaaccgacgtcataatcatgttccattctggtaaaccatcgggatgattgaatggcgtgtctaaaaaaaggttcaatttagcaggagctttctcggtgatttccatttactccacccgctttgtttacttttaatactgattatactagaaaattaaacaaaataaaaaagggtgtttaacacaaagtgaaactttaccctaattattagcaaaacaagataattaaaatagttacaaatcaagccaccaagtgtaacttggaaaagccgcatcccaaagttccgggaagtaatttatcctctaatatctattacacaaaaaaacgcaaagtcattaatgactttgcggcctctgctgttttggttaacagcccgtttccatgcttaagaaccgcgtgatttagctttaattagcccctccaccacggttctccaagttttattagctagaagttactctgcatcaaattctgcttcgtcttcttcatcctcgatgtcttcggcggcttcttcaccatcagtttcatcgtcaaagtttagtttgatgtttctagttaaaatgtctgtgtaactgtacgacacacgttcgaaggagttctcgtcttgatccaaatcaactacgaaaacggctgggtatgtcatgtgcaatcgtccacgccgtttagttacttttttgcggccagcctgagcgactaccaataattcttccccgatacgattatcgagtttatcttttattgtagctagtgtgattggcattaacttcaccttcccatgtgaaacattctatcatagtttcacaaaagatgcaattttaccacaccaacaattgaatatcaacgctttacatttagtttttttgtgctttatttcaattaaaacggtttatttacgctttagtccgacagtttggatttgattgtgcaagttgatgaaatcaaccaccgttaaccgttctggccgaatatgcgggtcaatttccaactcgtctaatacggactgaattttttctttagtttccggtgccttgccgtataatccctgcatgttattccacaaattctttcgccggtgcataaagcatccgtgcaccgttttgaagaagtcgcgatcgtctgcaggataaactggccaatctttgcgcggcgttaaactaacaatcgcagaatccacttttggttgtgggacaaacacccgggcaggaaccgtgaactctacctgagtttgcatgcggtactgcaccacgacggataacgaaccgtattccttgtcaccaggttgcgcggtaagccggtcggcaacttctttttgcatcatcaccaccattttcgcgattggcaaggagcttgccatgaacgattttaagataggagtggtgatgtaatacggcaaattagccactagcttaatcggatgctgtccgtcgaaatgttccacgaccacttcgttaacgttaactttaagtacgtcttcgttgataatcgtaatgttatcgtacggagccagcgtttcatctagaaccggaattaaattttggtcaatttcaaaggctaaaacttggtgggcccgtttagcaatttgctccgtaaggctcccaattcccggccctacttcaatcacgtcgtcgccatcgttaatttcggctgcgtccacaatgttaaccaacacgttgggatcggttaaaaagttttgacctaagctttttttagcggataggccatatttttctaaaatcgcccgggttcgcgtgggattcccaatctcaatctgattcttcatactttcctccgtcaatttgttgaactgcttgttcaaaatcacttttagctacctgaaataattgcaacctttttggtagttgctttgcgtttacgtagccaattcctaatatttcgcctaacttaattcggcgttgtttagcctcttttcccacaattaatccagcttccattaagtcgtcctgagaaatttggggcaacgcttcgtcatcttccgtataaagatgctctaatgcatgccgaattgcttctggactagcgtgttcgacccctagactacccttgtggtcgggaacggcatcactacgctttaagaaagcatgtttaacgttaggtacttcggccgcgatagttttacgaattttttcacctgaaaaatcagggtcggtaaacacaattactccccgcgtttcttgcaactgctgaatttgttcaatcgtttcctcagacagcgccgaaccccgggtttccaaagtatccgcattgaccgctaaattaattcgtttggtatcgtcttttccttcaactacaattacttctttaattttcttcattttcaatcccataaagtttacttgtattttcaaaagttgcctttgctaattcgtctggatccatgtcccgatggcgggccaaagcttctaggacgtatagtgcgtaggccggttcgttttgcttgccgcgtaaaggctccggagctaagtatggtgcgtcggtttccaccataatccgatccaacggtacttggcgaacggcttcgtgcacttccttagtcttcttaaaactcgccactccgctaaacgagatgtttaatccgagttccaaaaattttcccatccaagcaacgtccccattgaaactgtgcatcacgcccttgattgggtgtgtgctggcattctttaaaatttcgtaggtatcttccatcgcatcccggttatgaatggcaatcggtaaattacgttcttgggcgatttgaatttgttccgcaaaaacccgccgttgtgttttttggggcgacgtatcccaatgatagtctaatccaatctctcctaaagccactaccttaggatttttcaactgttccaataacgttgctcgctcggattcatggaaatcttttgcgtcttccggatgccatcccacaatcgcgtaggtgtgggggtatttttcagctaattccagagcccgttggtttaaaacggtgttggacccgacttgggccgtggctttaacccctaacttgcgcgcgtgatccaggtacgtttgctcgtttccccaaaaagcttcgtcatttaaatgagtatgtgaatcaaaaattttcatcttgattgcctccccaacttatcaaatcgggcttaacgccccgttacttaatagcaaaaaagctggggtgaacaacgtttttcccagcttcttcgcatttcacttatcaattccagattcttaggataaacacagtgggagtggctgccttgccgaaatcggctccgtaacccagctctctccggttaaccaaattatctaatcaatcgcttaacccgcgattaattagataattccgttaatcctcaagagctgcccgggttactccgccctctggttttatcccaacacatctccattttcgtgtttttcgtccaccattaccacgtttacttggccatcgcgttccgtcgacaaaatcattccttgactaatttcgccgcgcatctttcttggcttcaaattggcaacgatcactaccttcttacccactaattcttctgggtttggataccattgtgcaattccggacaaaatttggcgtggttcttcatcgcccgcatctaatttgaacttcaataacctgtcagcgccctctacgtggcccgcttccagaatttctgctacccgtagttcaaccttatcgaatgcttcaatgcgaatttcttttttagcttcgtttacgttttcttccgtagcctttgcttgatttgcttctgccattgctgcccgtcccttctttttgtctgattgggtcatttgacccttcaaaaatgccgcttctttttcaatatctaaccgagggaaaattggcgttcccttttctaccaccttagtgccggctggaatttcgccaaagtgtaaaccttgaagttccatcgttgccggatccaaacctagttggccgaaaatcttcgctggtgattgcgtcatcaccggttgaatcaaaattgcgataatccgtaagctttccgcaaggtggttcattacgctagctaatttttgttttgattcttcatcatcgttacgcgctagaatccatggcgtagtttcatcaatgtacttgtttgaacgagaaactaacttccaaacttcagctaatgcgtcactaaagtgcatgctttccattaattcttgataatttttaatggtttctgcagcaaccttttcaaggtccgcatcgacttcgttaaccccactttggaacgtaggaattacgccaccttcgtacttgttaatcatggcaacagtccggttcaataagttccccaggtcgtttgccaaatcaaaattaatcttagaaacaaagtcttctggcgtgaagtttccgtcgttactgtaaggcattgccttcaatagataatagcgaagtgcgtctaacccgtatttttccacgatggtttcgggataaattacgtttccctttgacttggacatcttgtcatccttcatcaataaccaaccgtggccataaatttgttttggcatttctaatcccaacgcgtgcaacatgattggccagtaaatagtgtggaaccgtacgatttccttaccaaccatgtgtacgttagccggccagtaacgtttaaacaagctgtcatcgtcactaccgtaacctaacgcggtgatatagttagaaagtgcgtcgatccaaacgtaaattacgtgtttaggatcatttttaacgggaactccccacttgaagctcgtccgggtcaccgctaaatcttcaagacctggcttaatgaagttgttgatcatttcgtgcatccggctagccggttgaatgaagtcgggatgtttttcgtaataatctagcagccagtccgcgtacttactcatcttgaaaaagtacgattcttccttaactaattcaacttcgttaccagaaggtgctttaccaccaatcaccttgccattttcgtcacggtaaacctcagctaattgggattcagtgaagtactcttcgtcagaaacggagtaccagccttcgtattcgccgaggtaaatgtcgccttggtcaagcagcttctggaagatgtattgaacggacttttcgtgagcttcatcggtagtccgaatgaacttgtcgttggaaatttcgagtaatttccaaagttctttaatccctttagccatgtcgtctacataagcttggggggtggtgtgcagagcttccgccttttgttcaatcttcaagccgtgttcgtcagtaccggttaaaaagaagacgtctttgccttgtaaccgttgaaaacgggcttccgcatcgcaagcaatcgtggtataggaattaccaatgtgcaatttgccggatggataataaatcggtgttgtaatgtaataagtattattttctgccatcatggttcctcaattctagtctaaagataattactgttattgtaccatatagcacgcggaaaaacgggcgcttcccgggctaaaataagtctaactgcatcgggcccagtcccgtaaaatgaattcctaggagttcttgcaattctttagcgttggctaccgcatcgtgattcccattgttgttaaaaatcaccatgacgtcttggactgattccgcgaccgccttgatggattctgccaactctttcagttctgcagacgagtaccggtagttggtccgttcacgccgccagttcttgccgctgctgaaccagccactggcattgcgcccgtgtagccggaaaaacgcctgttttgcgctggtgacttgtaaaacaaacggcatcccttggttcccatcaaagggttcgtccaccgtcacgttaatcatttttaagcgttgtaaataagataaggtatcttcagtcaccgcatcggtaaaccaactagcgttacggaattccacggcaattggcagtttccccatcatttgacgaacctcgaataagtaacgaatatttttcagctcgcaacgaaacgacggtggaaactgaaagagtaccgcagctaattgattagttttcactaagggttgcatgaccttataaaagtcggtgaacaccatccgccgctcggtagttaagtagtcttcgtcaactaccccatcatgaagcgtcatcgcttggttagctttaaaaatgaaccgaaactgttctggaacctgatgctgccagttaaccacgttggataaggaaggggtcgcgtaaaaggagctgtccacttccaccaatggaaagtgacccgcatattccgttaacgtggctttgtcctttccttccgttgacaacgccggatggtccgtccacgtacttaaaccaatttctatcatttgaattcctttctaaataaaaaactgaaattcaaatccaaaagttcacggttagtttgatttcagttttattaatatttatttaaaaaccaccaaaagtgtcgataaaagcaccatcactaaattaattgtcattaaaagcacgtccagccaccggccttccacgcggtgacgaattggcttgatcaaaaaaattaatagcccggcgtaactaatcgctaataatggggcccacagccacatccccaaaataccaattaagaaaagaccgcacccaattttttcagcttgtgacaggggccaaattggatcgtgtccaaccatttgccgcccttgtgtttttgcgttcgttaatcgccagatgtcataaatcttggcaacgatcgtgattaaagttgccccaaacaaaatcgttcccgctgcttcaccagctgccgttttgctaaaaaaactaaagccgatcgcacaagcaaaaactactaaaatgctcataaagagtcccacgaattccctggtctccgaaacctgctcggtaaccgattctttgcttggggttaaccgccgaatttttagaatcatatggatcaatgcgtacgcgaccgctccgaccacaattaacgaaaaaaacaggatggtccaaaaatcaatcttacctactaacatgcgaaacatgaacaagaataccgccactaacgaaagtattccagcaatgtttgccgtaattctccaacctttttcactcatttttaatgtctccaattttacacatggaatcagtacctaataattctaccatttaattttctgcctagctatcgggattcatctttcgcgtttttcttacctaaatgttatataatgtaagaaacgaaatgaggtgagcacatgaataaacggctgtataaatcatccaccgatcgggtaatcagcggcgtaattggtggctttgcggaaacatataacgtggatgccaacctattacggattatttacactgcaatcaccgtcttttccggattcttcccgggcctcatcatctacctggtggctatggtagtagttcccgaaaaatcataatttattaacttgaagtaaacccagaaaaacttaaaagtttttctgggtttttattatgccgctattcttgcgttgcactgcgtgacgtttaacaacggctccccacttaaaaactctggttaacgtcaacgaccgcaaccagagttttgagttaataattaaattagcgagtggtgtacggcatcttaatttcgtcaaagaagtccttaacgttttttgcgtacaattcccggaaatattcgtcactaggcttatcctttggcgtaggaactacgaaggcgttttgttggtcgccaattcctaatcctacaaaggcccgggtgtcctgagctttttcgtgcaattccgaatggtaaatttggaataattgtttaacggataaccgtaattgccgttcgctaaacacgctgcccaacgtagcaaactctagtgcatgaagttctggcaagtcccatttttgaagctgttggtccaccatcgtaaacgccttaactacttttcggtgcaagtcaaacgggctagtgatgctgcgttggtttagttccgccatcattttttgggccgttgcaaatgtggttggataatccgcggttaactgtgcttcgtaatcgctaagatggtcgccataaaaattaattgcgtccatcatcatgattaaacgaatggcgctaaagccatctactttgccatccgtttcgggttccaccgcgtcttgaattcccttcaagaattcagcttccacttgttcatcaatcaagtcgtgacgccgttgctcatcaaccaccacttcgtgggcaattacgtcgtaaagctccgtaattaaaaacattaattgctggtcggtttccttttccccagtcgttaaaccaaagtacagttgcggaaatccttttagtaccatcaataagtgaattaattcgtgagaagccgtgtagttaggcgcggtaatatcgtctaccttaattaacatttttcccggctcgtggaattgttgggcttggtcgtgccgaacgaatccggcctgttggtcaccaaaacttaagcggacctcccccgggaaagttgcgttaacggcttctaacagtgattttacttggtcattaacctctacgttactcatcaagatccttctttctcatttgttcaataattttttgggcgtgggcggcatcaatccgcggctcttttaataaccggggcaccgcctcgtttaatttagttgcgggcaatccgtgttctaataacaatgattttgcctgtaaccgcatgtgtccgtgctgaattccttcggtcacgatggctttgagcgccgctaaattctgggcgagtccaactgccccaatcacttctgcaagttggttagcactatcaacttgaagcaattcaaggtttagttgagcttgttcattaattccaatcgacccgccgaccgtagcaaccggcaatggcactactagttggccttgtaactggtgatcaacaatttgccaggtgcttagcccccggtactgcccatcacgagctgcaaatgcgtgggcaccactttcgatagctcgccagtcgttcccggtagccatcaccacggcgtcaattccattcatgattcccttgttatgggtagctgcccggtacggatcaatctgggcaaattcacttgcatcagcaatctttggggctaccgcagaatcgataaccgtttcaggaatcgtacaagtaaccgtagtcagcgcttggtcagctaggttagataaaattgccatctctacggcaatcccttccatctcaaattccgttttcaaagcttcaagcatggtgttaatggtgttagcccccattgcttcctttgtatcgactagcaaatccacggatagctgggtagcagacagcgggcgtggcatgatttttaacgcgccgcctccgcgtttttgcatcgaagggtgggcagcattggccacttctaacaggtgcttttggtggtcaaccacccattggctaacttcgatgctcgttttcgtattcatcaataattggccgcgcatcagtcgcttactatgtgcttgaaatccgccagcttggcaaactaacttggctccgttgctggctgccgcaattacggaaggttcctcggtgaccattggaaccacgtgttcacgtccgttaactttgaaattcaccgcaattccttccggtactcggaaatcagttaaataattttcgatttgttgctgccgtacagcgtcaattggcagttttgctaacgtagccacccctacgccagtcacttctgacaataattccaactgggcttgccggcttaaccgatggtatccttcaatcataaattaactccctttacatgttggttaatgtattctgaaataatgccttcccgtacgccactttccgaaaagattacccggtccgagtcaatcatctgaagtagcatcaccaatggtaacaccccacccacgataatgtcggcccgagccgtttccaaaccagcaatttttttgcgattttccagattacgggtaatcaaagaacggaaggtgcggttaattgcttccgtttttagccgatagccgtgaatgttgttcacccgggcaattttttgccgacagcgattgatccgggctaacgtccggttcgcgccccctagcaagacgaccggtttattaaacgcgtccataatccaccaaacgtcacggagctgcttgttaacaaacatttcggcggaaaataaattatccccacgaatcacgttgcttaagtggaaccgttctgaaagcgacaccgccccaattgggatgctgatcatgttccgcgccttaccattgtgcacgtcaattaactcacaactagcccctccagtgtccagtaccaaacagtctttgacctctagtgaattaatgacccccagatagtcgtagtaggcttcgtcatctcccgataaaacctctaattttattcccgtttcgcgttgaacgcgttttaaaaagtctttttggttacgggccatccgtaccgccgccgtagttatcccgcgaacttcaattctcgggtactcttcataaattgctttaaaacggtgaagtgcttcaatcgtccggttgattgcttgcggccgaagcaagcgttcgcgtcccataccttcagaaattcgggagtcttctttaacccgcctgatttcccggaacgtgccttcatccgtaatcgagttaatggccatccgtaccgaattcgaccctaaatcgacaattactaaatttttcattatgggatcctcattttaattgatatattcattttttattttaccattcccaatggttgagcgcgttaaagagttggcaaaactagtaaaaccttatcaattagcgttccttaagtactatttaaaattagatccggcctttcgttaagaaaagaaaaaaggaagctcttccggacttaaaaaaaccgagtccccttttcaatggattgcctttagtaatgtcgaaacgtgctccagaactcaatttcttccggttaactaaatcaaggcctcaatcacccaaaccgtgattaaggccttgattctgtgctttcctgctgcatagtcgaaacgtgttttctgccccaacttcctccggtaaccaaattagggtctcaatcgctaaaaccgcgattaagaccctaattctgttatcctcggaagctgcccggggctgaaaacactctattttttaaaataattcaacccaattgcttcccgcacctcgctcaaggtttggttcgcaattgcatttgccttttggcttccctcttcaagaatttggtaaactcccgcaaggtcagccgcgtaactttcccggcgttcccggattggtttcaattccgcttgaagaacttcgtttaagtaacgcttaatcttaacgtcgcctaacccaccagcttggtaatgatccttcaattcttgaactttttccttatccggatcaaaaatgtcgaggtaggtaaagaccgtattaccttcaatgtgtccaggatcctctacacgaatgtgttgcggatcggtgtacattgacattactttcttttgaatcgtgtccgcgtcgtctgccaaataaatggcgttgttcaacgacttagacatcttagcatttccatccaaaccagggatccggcccattccctttggtgggaagtagccttctggttccacaaggacgtttttaccatagatattgttaaaactccgcacaatttcgcgagtttgttccaacattggttcttggtcatccccaaccggcaccgtatccgccttaaacgcagtaatgtcggccgcttgactaactgggtaagtcaagaaaccagctggaatactttggccaaacgccttttgtttaatttcagttttaacggtcgggttgcgttccaaacgcgaaacactaaccaagttcatgtagtgttgggtaagctcactaagcgctggaatttgtgattgaacaaaaatggtcgatttcgctggatcgatccctaccgccagataatcgagagccacttggataaggctattgcgaatcttttcaggatctcgggcgttgtccgtgagcgcctgcatatcagcgatcatgatgaaggtatcataatcccccgtgttttgaagttgaacccgattttttagcgaacccacatagtgaccgatatgtaactttccggttggccggtcaccggtcaaaataacttttttggctgtcatttcttttcctccaataacttaatttaataaataaaaaaacctatcattcaaaatttgaataataggacgaaatctcgcggtaccacctaaattgtgacttttctataaagtcaccgctcacttgaaagataagggatttcgccctacgtaacgtaaccaatccatttcgcttgccgtgggatttttcagcaatcctccctctctgtgcttggcttactacttctcttccattctataggaatttcactgaccttgtcaaaaaaatctcccttaatatcctttagtttgactttccaggaaatggcccctaaaatggttcaagcactaaaaggacggaggtaattcaggtggacgagcaacagcaagaacaacaacgcgtcgatttcgtagttgaccagattggcgcccagaaaaagcggacggaagacctgtacgaaaaggcccatcacgaaactagcaaggtagaaaagaactattcgcaaaacgctaaagtcaacttgattgaagccgacgaccggattgaaacggaagcggaaatccagcagcaaaaaggtttggttgcccgggcagtggaaaacgaagccattttaaaacgacaaatcaactccttaactgaattacaggattcgccttactttggacgcattgacattcaagaccctgacgaaaccgcgccggaatcactatacatcggcgtggcctcctttgccgaccaagacggcgactttttaatttacgactggcgggcgcccatttccagtatttattacaacggaacccttggaaaggtcaaatacgaaactccggcgggccctatggaaaccgaattaactaagaaacgacagtttaccatcagccacggcgaaatcacccacatgttcgatactaacgaaacggtcggtgacgaactattgcagcaggcgctcggtgagcaaaatgacgaatacatgcgcaacatcgtggccaccatccaaaaggaacaaaacgacatcattcgggacgtccaaagtgacctgctcgttgttcaaggggtcgccggtagcgggaagacttccgcaatcctgcaacgcattgcctttttgctttatcatagccgggcttcccttgacgcggacgagattgttctattctcgcctaacaaactgtacagtcgttacatctctgacgtgttgcctagcttaggggaacgtaacatgcgccagcttaccctggccgaatttcttaaccggcgtttggaaggactcaacgtccaaagcctgtttgaccgtttcgaaaaccaggttagccaaacggcggaagaacagcagattatttcatttaaggaaagccaacggtacattgagttaattcagcaatatgaagaccaactcaccccggaaaatattaaattcaccgacatcaattatcaaggagcgcctttctttaaaaaggagcagattcgcgaaatttttgcgagtttccctgcatccatgagcaaccgcgaacggattttacgaactaaaaaccaactagttaagttattaaaggcccggattgatcaagaggtttctgcggactgggtgcaaacccagctcgaccaaattagtgacgaaaaataccacgaaattgtgggacgtcgccactttaactcctttgatgaagaaaattatttcattggccgtcacttagttactaaggcttttgaaattatcgacgatgccatttttaataactactttattgatatttacgcccagtacgcggatttcttaaggcagctgccatcttcggaaattgatggcgccgcggcagccaccaccttcaataacgacattgaattgcaccacgtgcgtttagaagatgccgctccgttaatgatgttgcgggacttgatcaccggaagcggcatcaatcgcaagtttcagtacgtcttcatcgatgaaatgcaggactattcggttgcccagttaatgtacctcaagcacgcctttccgaaggccaagtttacgttgttgggcgatagtgaacaagctttgttcaaggacgttaccgaaccggccgtgttacttgaaaaacttaaggacgcgtttgccgttcaccgggccaacctgatcacccttaaccgcagctaccgatccaccgcggaaatcactaaatttgcggcggctctactacccgacggtgataagattcaaccctttagtcggcacggtaagttacccgaaattacggttacggataccccttccgaggccattaccgcagtgaaacaaatttgccaagccgaattgcaagattacgggaccgtcgccatcctgaccaaaaacatgcaggaaagtactcaagttgcagaatggttgcatgacttaaaacctagcctgctaaccgacggtgaccgctcgttgcctaagggaatcgttgtattacccatttacttggcgaaggggttggaatttgattcggtaattgcctacgacgtttcggaacagaattatcccgaaaaattgtggcggggcaccctgtacacgattgcttccagagccatgcaccacctcaatttgataagtattggtaaggttagcgaaatcatcacccaaatgaaggaagaaggctttagcataaaaagagtgtggaaatcttcgggaaagctctaaaaattaaaaagacaaagctgagaaaaacgaaaaatcactgggggttttgacttcaataaaatcaaaacgtgcgccagaagtcagtttgttccgcctaatcaaaaagaccgttatgccaaattaaggtataacggtcttttttcagttaatgctcgtctttttgttccactctcaattatatttaccgtgccatcgcgcgcttattgtacttgattgcatcttttaaaatgaacggtgcaatcaacgttaccagcacgattaccaacacaattgcggaatagtatgtttcactcattaagtgttctccatacccaatttgcaaggtaatcagcgccatttcgccccgggaaatcatcccggcaccaatcactccgctactggttacgtcaaagccggacaggtacgcaccggcgccgcaacctagtaacttggtcaaggtcgctaagaccgtcagggtgacaatcaacccgattaccgactgcaatcccgcaaacgacatcgaaagcccgacgctaacgaagaatactggaataaaaacggcgtagccaattggctcaatgctttcatttaactcgtcattttcgtcagtcaacgaaacggcaacgcccgcaaaaaacgccccgatggcgccgctcaaaccagctacgtccgctaaccaagccagtcccagacaaataatgatcgacattactggtcgggcagcggtgatgtaaagatgatccgccgcccgcattagcatcggcaccagccatttcccaattacgtacacggcaatgaaaaatagcacttggtaaaaaagcgcgccgcccaaactaatccgtgaaccgccgctcgaactagttaaggcaatcattacccctaataacaatacgccaaggatgtcatcagccactgctgcgcccaaaatcgtcgctccctctttggtatttagggtttggtattccttcaacacctctactgaaatacttaccgaagtagccgaaaaaatcaccccaataaagagggcttccattgggctaaccccgaagatcaaactcgcgccgcctaccagcgcaattggcaaaattacccccatgacggcaacgaccagcgccggtttaatataacgcttcagcatcttcaggtcgctttctaagccagctaaaaacatcagaataatgactccgatttcggaaaacactgcggtgatttcgttactgtgaattacccctaaaactcccggtcctaaaacaattcccaccagtaattggccaactacggcaggaatgccaatccgttgtgcaaagtggcccgctaacagcgtcaatcctaagattaaaacgaggacgcccacgaactccattaaatcacgatccttttcttaaattttaactaccgcaagtactctaagtcactagcttcagtggggtacgcgaaaatttgccgttgtaactcgctaagactaccaccatggttgatcagccacgtaaggtcgttaatcacgtgttccgcctcactactcatggtaaccacgcccactacttgctgagactggcggtcaaccacgaccgtcgcccgcgcgtctggatcttggatccgccgataggtaaaccaattagttaaatccaagtccttaacttcatagcgttgcgaatctttttgtgcagttgcaacttccactccggccttcgctaattggggaaccccatacacgacggtcggaatcactggatacgcaatggctgccgaactttggtgggtcaacaattgcgccaaatattgtgcttcaaagcctgccaccggagttaatttcggttgcgctttagccactacgtcgcccattgcatagatgttgcttgccgtagttttcaaatggtcatctaccatgataccatttttcgcggtctctaccccagcctgttcaaggttcagggtatccaggttaggcactcggccggcagtaacgaaaacctggtccactggcaaactaaattgctgatcatcccgcaaggtcatcccctccgcgcttttttcgatcgcggtaacgtcaatgtttaagtggaattgaaccccttgtttagtcagttgttccataaattgcttaacgctttctgctggaaactgcttcaggggccgatcgttgtgatgaatcacgtgtacttccgcaccggctgcgttcgcgatggctgccaattcaaaagcaatgtagccgccccctactaaggcaattcgcttaggcagttctggcattgccaaaaagtctgtactagtttgcatcaatgcttcattttcaattttgcttaggcgtcccggacgttggccagtggcgattacgaattggctgctttccacccgctgttcgcctacttttagcgtgtgttgatctacaaactcagcgtgcccgtctaaaaccgtgatcccggcgtcgactaatccctggcggctgcttgaagaaactggttccgtgaacgtttccttaaaacgcattagggaaggccagtcaatttccggttcgttttctaagcccttcccaacgaggtggcggctacgtaatttagcttccactgccgccattaaaacttttttcggatcacacccgcggttggggcaagtcccgccccagcgattttcttccactaccgccacggtttgaccagcttgttttaaaccatacgctaaccctaaccccgcaggtcctgcaccaataataactacgtcaaatttttccataatgctccccctcattgactaaactaatgaaattaatggactgtctcactcaaatacttaaacaaggacggccggtccacccagccggtagtctgcccatgttcatccaccacctgtaaaattgtgtgctcagctaactgttggaacacctcgtctaaactggccgttcttgggatgacaggtaatttttctgtcgtggacggcgccgacaccccaaaacccgtgcgcaccaccttttccacttcggtttggtataggttcttacccacggtggctgaaaagaaattttccacaaattcgttggcgggatgttgggcaatttctttcggagtggctacttgcaacaactttccgtccttcatcaccccaatgcggtcccctaatttcagggcttcgtccatatcgtgggtgacaaaaacgatcgtgttcttaaatttctggtgcaactttaaaactaagtcctgtaactgcgctcgcaccaaagggtctaacgcgctgaaaggttcgtcaaacaataccaccggtggttgcgcagccaatgcacgaagaattccgattcgttgttgctcgcctcccgaaagttctcgcgggtaccgtttgcggtagcgctctggatctaaatcaacatcttctaacagctgggtgacccgccgtttaacctcttctttatcgacccgcttcatttctggaatcaaactgatgttttgctccacggtcatcgttggaaatagggcaatctgttggagcacgtacccaatctccaaacgtaaattacgcaaatcataatcctttattctctgcccgttaaacaaaatgtcaccggcggtttgcacaaacaactggttgatcatttttaaagtggtcgttttcccgctaccagaagttccgaccaggacgaaaatttcgccctccttaaccgtaaaatttaggtcatcaattactgttcgaccaccaaaaatctttttcacgtgccgaaattcaatcattgtcttactcatttacgttcggctcctttcaacaaacccttgctgaccaaatagtcgtgggccacctgttgggcggaacgtttttggacgttcacttgataattcatctcttgcatttctgcttccgtaattttgcctgctaagcggtttaacgcgcggaccacttgcggatgttttttagcaaagctcttcttcattaacggcgcgccttggtacggtgggaaaacgtgttggtcatccttgagaacttgcaacccgagttgtcgaatctgactatccgtggagtaggcgtcggcaacgttaatttgcccgtttttaattgccgaatagcgcaacgaagcctgcatcgacttgaccggaaactctaagccgtacgctttttgaattcctttccacccgtccttgcggttaatgaactcgagcgtcatccccccgtgtagctggttttcaatccggcttaaatccgaaatgttttctagatgatgttgtttggcaaaatcttttttcaccactagagcgtaagtgttttgataacgcatcggtttcaaatagtccatttgatattgctgagctaacaatttacgaccggttgcgtaagtttgtgccgcacttaggcgctgggaaggggcgtccttcaccaaagtttctaatacggtaccgctaaattccgggtaaatatcgattttgtcagccttcaacgcgttaaataagaagctcgtttccccaaagttttgctttaaggtcactttagtatggggagcttcctcttcaattaaatccttgtacatattgattaaaatgtacggctccgaacctaattttcccgcaatcgtaatcgtttcggtcggcggagttaatattttagcaaccgtggcgccggtaaccgccaccacgagaattgccaaactgatggtgatttttttcaccgaccaccgttgtaaaacgtttaataacgcgctcaacccaattgctaatagagcggagctgatggcccccaccaaaattaacgcagggtcgttacggttaattcctaaaaggatgaaatttccgagccctccagcgccaattaacgcggccaacgtcgccgttccgatgattaaaaccagtcccgtccgaattcctgaaataattaccggcatggcggtgggtaattccacgcggaatagcttttgtaacggtcgcattccaaaagcgtccgccgcctcttctaacgatgggtcaatctcggtgatccccacgtatgtattttgaaatattggtaacagggcgtacactaccaaggcaatgatggctggcacgctgccaatccccactaatggaattagcaatcccaataaggctaaggacggaatcgtttgcaaaactcccgttatctgcaacaaaatttccgcaattttgcggtgtcgcgtcgcccaaattgctaaaggcattgcaattacaatcgccagtaccaacgcaaccagtgaaatccccaaatgttggagtagggcttgccacaggtcgcttttctgttcggcgaaggtctgaactaaatctttcatgcgctcaacttccttgtttgtatttgaattaaattatcgcacaaaaaaattggcaaccctaacgaaatgcccgttgagttgccaattagttttagaaattaattttaatttgtgctggttgagtttggacaatcactttaccttggtgaatggagtaaagcaattctttacgctcgtttaactcgtcataaaaattatccgcgttaaaaatcaaacagttggctggtttgccgaccgcgattccgtaatgatcctcaacgttaagcgtcttggctccgttattagtagtcagattgtaagaatccataatttgtgaataccccatcagctgtgccgcgtgaatgcccatgtgaactgaatccaacatgttgccatcgcccattgggtaccacggatccttcacatcgtcttcaccaaacgagacgttgacgtggtgttctagcagctccttcacccgggttaatccgcgccgcttcggatacgtatcgaatcgcccacctaggtgaatgttgattaacgggttggaaaccatgttaatttccgacatttccaagagtcgcatcaacttgtagacgtaggcgtcgttgtacgaccccattgcggtagtgtggctagccgtgacccgatttttcaggccgctttcgtaagccaaggtcgccaatacttccaagtgtcgtgaatttggatcgtcaatttcatcacagtggacgtccactaatttatcgtacttttccgccagttcaacgatgtacttcaaagaagcaactccatagtcccggttaaattcaaaatgcggaatgccgccaattacgtcaactcccatcgcgaccgcctgtttcagtaactgcttaccgttaggaaacgaccaaattccttcttgtggaaaggcaactaactgcaattccataaagtcctttacttcgtccttaacttctagtagggcttctaaagccgtaaagttaggatcggtagtgtcaacgtggcttcgtacgtattgaatcccatgttgcgcttgccgtttcaacgtttgcagggcccgggttttaacgtccttttttgtaaggctctttttgcgttccgcccaaatccgaattccatcaaacaaagtgcccgactcgttccattcgggatcacccgccgtcagtgttgcgtctaaatgaacgtgtgaatcaacaaacggcggcaacaacagtttgccctgtgcctcaatcacttcctcactttcatgaggggttaaattaggcgcaatttcttgaaaaactcctccttcaacccggacatcctttggttcctttgcgttttcaatatacacacctttaattagcattgtgcttccccttttctagttgcataattccccaatatagacaaccaatcaaaatcatcaccaaaaaggttgctcccgtatatttttgaacaaagcttaccctttgtaaagcactataaattaatacaccaaaaatccacattccaaaggccgtccagtgaattcccttatggtaccaatatggtccgtggggatcacctaaatctttcgccgcgtaacgttgtttggcaatcaagaagtagtccaccaccatgatgctgataatcgggccaagaaccatgccaacgtagtccaggaaggctgtaaaggtggttaagaaactaccgtagaaaacggggataaacgtgaccaccgtagcaattatggtagtaatcagtaacgattgttttaaagataatttgctaaacatgttattcaaggccgagcccgcagcctgaatattaaccgcgtttgccgtcatactagttagcataatgacgatcatggcaattacgcctagtcccagccggttagcaatcgtactaggatccgagttgttagggtcgtaaacgcccgaactaactgcgatactaatcgtggcgcttaatccaataaacgcaaacccaaagactcctaaattagcgcctaggaacggagcggtagtggcggtatttacctttttagtgaaccgagtaaagtctgcaccggccgtaacccacgcaaggttaaacgctgctagcgtatccatcgcggtcccttgatccatttttaagtgatgtggtacctgccagtgggcaatttgactaaaggaaacgtcgtgaaataccaccaccgactcccaaatcacaaagataatcactaaaataatcccaatccgttcgataatttgaatcgaacgttgcccagcaacgatgctaagtaaatggaggatgctcattaccacaatcccaacaattaaacctaaattaccaccaggttgtccgtaaacgggccagccccaaaaactatgtaagatataagatacggaagtagccgcaatgaaggtgttcaccgccgtccaacccacaaactgggttaaatttactaaggatggaatgatgctcccccggatcccaaacgaagcccgcgaaagtgccatcgtggaaacacctgttttagttcccatatagccaaccatcatcaagaatatgtacgaaatactggaggcaatcaagagcgccttgattccgccccagaaaccacacgccgcaataatccctccaataaaccaggtcccgttattggcgttagccccaatccaagtcgcaaacatatcccaataggtcatatgccgatactgctttttgatactttcaacccgatatttcgaatccatccatcaatttcccccttgtcgaaatttgacacatttttaaaattatactaaatctcataaagacaagcaaaaagaatcttgacgacggaccacaatttttaattcccgacgtaaaaaaggacttacccgataatcgggtaagtcctcatgaagaagataactattaagccactagtcgggtttgaaccgacgaccccttccttaccatggaagtgctctacctagctgagctatagtggcaacttttactagaatagtataccatatttattcttgctgtaaaacgtttattcgcaacaaatagctaaaaattatcgtaaaaaaagcggcttagtgatgattaatttttttgctaatcaatgagctctaaccacctgttaaaaatgatttagttaatcgtaattgacccgagaacagaaacctagttttagttattcaccactgtttaaagcttaacgaactgtggattccttttattggatagctttcattactcctagtcttgcgatttcctaatttactttattagaacacacccttcaatttcacgttctgatttcaatgtaatcattttatccacccgtttcttaattaacctaactactatagtatcacaactttggtgaccaaattaacccaattgccttgcttcccgtataggttcccacttacggaccaattggacaagattctatgtgtaagcccgggtattggaccttcagttcactttgccattgcatgccgcgagtgcccgtacttgcttgaccgtccaacgatctagcggccgtgagttgacgttaaaccatgttgtttgactgataccactctcttttgctagtcgatagcgtgtgaggccgtgcgcctcaagatacttatctaaaattcccaccatgtttttcctcctaggcatattgtcttttgcttttctctacacttatatagcaccatatctggaagtaattgtaaccattttaaattattttttgagcacaaaaaagtcccccacgccgaagcgcaggggattaattatactatttttgacttgcttgtgacgttgtttcagtttcagaagctgcagaactattcactgcagtagctgtggacgttggtgtttgcatttcgtcagcaaccttattagcagtcgcttcaacttggctttcctcgtcactgtcaaccattggtgctgtcactgtttgaacgtcagtaacaactcccagcataccaaggattgttaatacggtgttaataacgccaacaatggctgaccagtcaccggtaaacttaacaccaaatatagctaacacttgctgaactagcacaatcaataatgaaataattccagcaatcaatttaccatttaagcttccatcagcattcttaaaactaatttttttcataatatcctcctataaaaatttctctgcaatataaataactaacgtgacgagcacgccactaatcaagacaccgataacccaattctgaatctgagtaatccgtcctatctcatgttcaacctcaattgatttggctagtgccttttctgctttgttgccaatatcgtcaacttgatttaacttttcttcgatgttctcaactttcgttttggtggtggtcacgtccttttggatatccattagtaacttagttgtgtcgtcgtattgcaccattaccgcaccaccaatcgctgcccaggatagatagtggtgtaaatcgtctttccattctgactagctaatgtagtcatatttaggccgttgcgttgtgcgattgtccaccaactgtcgccatacttaactgtgtaatacgtgtgagttgcaccactctttacatattccagcgtattacttgccgggccggttgctaaatagccataaccattaaatcgcggctgacgtacccagcgatacccgccctgaataatggcttgatcagtatttaccgtagtgccagctggtaaaatagcgatcgtgtttgatgacgttgaagcgcctgtgcgcagcttaaccgccatcttgagtgtgtaggtcttcttttccttgacccactttgctgaggcagctggcttggaaatgtgtttgttggcttttttgttgttggccttaactgcacctttattagtcggcttgactgttgatttttgaccagcagtgtagtagttgctatttaattggctaacatcgaagccaccatagctgatgcggaatctagccgttgatgaccactgccatgcgtggttagttgaataccagttcttaccgctaaccacatacgggtaagcagcaatccagccggtttttcccttgatggtcatcttgttgttagcccatgatccagacgtgtaaatatcggcccgataaccaaacttctgaatctctttcatgaaggcggcattattgcggtcgttggttgctttggattggtaattttgttcctcggattcgacgtcggtcgctagtactgcaccaactggcaaccctgccgctttagccgttctacccgcaaagtcagcttcagcgattgcttgtgccttagtggcgtagcgtgcgaaatggtagccattgatatacattccggccgcttggacatttgcaatgttgctggcagcatacggatccttgtacgtaccgccttcactgatcttgaccgtaacagccttaacaccgaactcgttacgcatggaaacatactctgccgttgacatgtatccgttgttattcgacacgtcgaccatatccatacgagcagcatgactggtagtattgcccaataaaaaggccataaaaatagcgcccaccattaagatgaacgcccttaatttgcgcttattcaattgtctgcctcctgttcaagactattattaatttggaactgtaacgttgactcactagggtaaattgacgtaccggtactatcaaccacccagacttctagctgatagtctcccgcttttaagccggtcattagatctgctgttaaagctagtacgatctgaccagtcgttgggtcggttaaactagctgggtcaactgtggccgatttaagatagccactagtattgcccaatttaacggtaatactagtggccttagttaaatcagtggctgtgttatcattgccacaaattaacgtaaagctagtggtggtatcgccaattttaatcgtttgtggtgaagtatcggtaaaactaagcgtcttcgccatctttaggtgcctccttctcggccaacttggcattaagctggtcaatttgaacttgtgccatcgctaattgctggtctttaacggcaattgcttgggcatagttactcgttagcttgttaattaaagcttgtgcatcgatattcatatattaagcctcctgtgtggttgtggtaactggtttcaaagcggtcagactgtcaattagtgtgttcaacacctttaatttaaccctatctgctcccccagcaccgccagcaatagcagcgttaaagtcatccatggtaatgctgacctgtgagttgatacccagtgtattaatttgaatgctaattgtcatgatgttgttcgtgtaatctggtttataattagtgattaaaatgctatccatttaatttggcctccaattctaataaatgcccgtttagggcagaaatctgcttttgttgttcctgtaccgtggctagggtggcgttcagtagtacactgtcatccaccccatttagcttgccgttttcatcacgactaataaatacgtctggcaattgccactgtttagtatcattcacatcatcaacgattgaagacagccttaagtggctggtattatcgtcagttttgtactggtaggttgctaggtcgattgagttaactagctgcgcccagtaagctgtgtcaacctttcgaacgtccttcttaacacttagcagagaagatttaactaggctatcatagtgaacggtactagcatagatgtcgacggatttgccattagcacgattgaaatgaattgggccgttgtcggaactggtaatcgtgtgataggtatttatgttgaagttaccaatatctaaagaacgattgaattgaatgttattagcacccgagccatcaataccaaaactggctgtcttcatagttggaccattgccgacataccagatattctgtgtgccattagggttaatattgccgtagggcgtaataattatacctttaggtgcaacatcggcagaagtaccgttaaaggtgatttgttgattgtcaccatgcagtgtcataccgttacttgcatcaacaatgacatatcctgtcgaagtcagactattgtttgtgaagttagcatcttgtgaagtcgaataaccttcatgtaatgctagttgcccagctcctagtgccgtgtcagccgctgagtatttaccggtagcaaacggggtcatcccacgaagattagttctaaatatgccatcttttaggcttgctcgtagtgctgctgtttcatttgcaattgttttaaacgttgtgctgtttagtgatccgtctggagatatggtcatcggataactagtgttgccatattgatttagctgagtaccagcattaaacgctgtaccatttatagttgaaccattaataataccggctattagtttcttacccgttaactcccccgtgatattagcactaggaattattacaggattaactgtatcaaaatagatagttttaccagataacgtcagttggccactagatgaaattagggtgttaccagcttggatattaatttggtcgattaagtcatttttggtaactctaaggttaatatcgtctgccatctgagcaatcatagagtcttctgctccgtacacataaggcgtcgcagtgtcaccgggctctaattttaattcggtaaaacctagtatcgaagttttcccattggtcgaaccgttattatcaatacgcagataagcttcatcaatcgcccctgttgtaaaggtaaccgtccgataatctaatgctgacatagataatactgtccctttaattatttcttggacaaccgtgtaatccgaagtgctaccatttggccggcccaaaacataaacgtccatactgcttacattagagctagcaaagccttttagttgtaacgtgtaagttgcgttagcattaattttaaagcgcgggcttttagcaaagacttcattagaaccagctgtatttaattcatacaggggatcggcaccactgtgatagaaggcatgtgtcgttgcaattagcgttccacctgttccagactcagaccattgtaaattattagcttctggcatagctgaatatggtatcaaatttacattgttggcgtcttttttagataccttgctagcaatcatatcagcagtctgtgttttgtacgtgttaaaatcactagattcaaccttactatcaattaacttagcagttgtagcttgataagctgagaagtccttagtagccaccttgctagcaattaagtcagcagtctgtgttttgtaagttgaaaagtcaccattatcaacttttgatccgatcaagtcagcagtctgaattttgtaactagcatattctgagttagcaacctttgtagctagtccattttctaggtcagcaatcgttagcttggaaccatcttttagatctgtcactgcttgactagttacttgaccattatctattgctttagttgcttggctaaaggcgctgtcggctgtactttgagccttagctgtagcattagacagggttgttatctctgaattagcataagcatacgtgctatccgcagctttttttgcagcatcagccattgattgtgcaattgaagcagcgttatcagcattgcctgcctgggtagccgcattgtcagccgtattttgtgccttgataattttaaggccatcatcggttagaatgacttgagctgcgttagattctgccatttaattcacctcccttcgtagtcattggcaaacgttctttaattggtattgcaaaaacacgctctaaatgattaccttggtttctacaattgaaagtgaccaatagttccggctggttagtctggctatagataatgttacatgtttcaggctcaacaacgtcatcggttaaccctaaatccatatctaacaagtaattagaggcaaattcttgcccgccatgaacaacattaactgcgtacaccatacgaggatctttcatgttgtaatcgcctgaatgaaagtaaacataaggaaagtcaattccttgtgattggtaggtttgttggttccagtcaaaaccatagttggcagcatcaaaactatacagcacattataattgccttgtttaacatcatcgagtcgtagcacattctgtttaccatgatagtaactacacaatacatatccatgtttgaaatcaacattaattcttatataacggtcgacagtgcaaaaacgcgtaatacggttatcgtcattgctcagggtcacattagcaaggtatggtatgcggctgattgcatattcgtcaacatttaaattaggcttagttgcagaccaaatgtaaatagccccgtctacttcttcaaccgagaaacttgaaccatgcccaccttgtgaaacaatcatcttgctaatcggattaaaattagtgtcgtgtaaaacgaacatggtatcgccagtttcaatcgcatggctagttatatactgaccgttgctcaaaggacacatatattgtactgcgccagttattcctagtgcactgttgtctgggttaaaactacccaaactacgaatagcgctagtttctagcttgacctccggttcatcttgaatataactggtctcaatagtcccgtgcagtgtgccaacggaactgtgtgccgcttgtactaaatagccagtttgattgaaattagtatcaagggtgccgtcagtattataacggtgccaaataaatcctttgttatcaatataggctgaaatattagcgttaccttcccaagcttgcaaaattagtcgcttggtttgcgtagtatcagtgaagttgttgccgtcaggagttaaagcaaccggtttaaccgaactagcgtcttcctttgccttttcaatggcgctattaatcgcactttggtagccttgcatccaggccggtgtcgcaactggtaccgtgacatactcgccaaagccaactgtgttgccatacgggttagcaaaactgattgtccgctgaatgactcggccactggcatctaatgctggcttgattaactcatctttaaacctaatcgtggcacctaatggtggattaaatttgggtgttacattaacctcataatacgtccgcgggtgattatacaattgcagcatttcctcggcccatgctttaagaccagcttcgtcttcaatagcgttggctgtaataaccccctcatagtacaaaccagattgccaatcagggttatatttctgattagcttcatcatcaacaatgtagttcttaccatcattaactatcccaattgtgttgccgttagcaccataagggataagtttagtaattgggtttgacaccgttgttcgcttgatgctagtcatattcttaccaaatactgcctcgttatagaccacatcagcattaagctggtcagtaatgacacatacctttttcgtgatattcccttggctgtcaatctcaacataagggtcaatctcaacgttatacgtttggattagtgtctgtactaacgtactagcttttgttttaccatcaatggtaatcgatggtgtcattacattagtggtctgatagtctagcgtccagccagtagcgttaaagcactggttaaaagccgtctgaatcgaactagcactagccgtaattgccactgggtaatgatgagctagtgtatacaagcataaattggtaaagttagccgttgttacgtgcttagtagcggcggtattgctttcttccacgctgtatatgcgcatgacataccaatgaccagatagctcgtcataataggctaagttattaccagccaccactttatctgaatccggctggccttgaagcacatctaatgaaccttgatggtcgaacttcttagactgggcatttaggttgatggtgccgttaaagttatcttgggttccaacattggcatcatcgtcataacttgtactggtcgtatcggcgtcagctagttgaatcttgacgctgtcattagaaaacttagtagccccgtcaaccgtcagggtaccaatccgctttaaattcgaatctaggattaaatactggttatttaaagccatctattaacctccttattttaattatgtaaaaaagccacccttaataggcagcctttagtattgttatagtatccttggtagatatttcagggtcatttgtgcgtcatctaaatcaccaatcatcgacaagctattaacgcccggtttcaacttaggaaagtcggttgaccaaacgggtgaaactagcttgccatttaccgtaaccgtatcagtctcacagtccatcacaatttcttcaccagcgccagcaatatatgttggctttgttgtatcaactttattgactttccatatttgaagatcagtcatcgacataaaggggttccggtagggaactttataaatatcttctgtaattgggtgctttagaaagacagatccaatcccacctaagggtgtctgatacttattctgagtatcaacataggttccgtgtactaacatgtggatatgggggtctaggaacggtcggcctgttttggtcgaatactgggtgatactccaagtaaatacttgtcctcgtttggtgatgtccaaaattagccaagcacctgccagcgcggaatcttcctctttattgaccacggttgtataggtatcaacggtttcttttattgttctcttagttacctttccgcttctggaacgaccatgtttagtgacagttctggttgtcgtgccagttttgattttaattttctggtcagacttgtttgtaaaagaacctgctggccctgaaccatagtacaagtcagtatagcgatcaccatattctaatgttgatccaggctcgcatatttgaagtctagccattggtttagcgccataggccatatcacgcatgccaaagcgtccgatagtgttaccgttagggtctaatagcaagacttcaacgcgccccatcgcacggccgttatgagtaccactgtacttaaattgatgaatacccgttcgtactcgccagtcagtcagtgattgcgtcataccagtataccgataggccggaccataccagcggtcttccccggttgtgggtatcggcccaaagtcatatccattgctagttaaacctggccgcattacattagtcgaagtcttaattgcactgtggccctgatacgtgtatgtttcaccagttttcatattgctgattgcattgggatcatttgtccacattgccatagttcctagcgggtcatcaacaactttagtgtaaggctgaaccgcggtggcttggtcttccggtgactcagggcctaaaccaaactgaccgccattaagattgaaaccaatgtattttaacggtcgtttaggtatgacctggataaccggctctgttcgtgcggtgccatcaacagtgatcgtatttaaaccattatttaaaggcttctcaacctgtggcagagttgctcgggggtcggactgcacaaaggtaatcgtaagcgtcatgtcatacatacccgggttaatcggggctggatcactaattgcggtgatatgtccccaatacgtcacctttggttcaaagccaaatactagtggatattctttaccgttatcattaggatcatcacttagtagtaaaccacttaaattatgcataatctgattaaatctagcttggttatcggcacagtaaatagataccggaatattaatcgtccggctggtaaagtccgtgccattgaattggttaccatacatagccggtatatcagtcacctgttcagccatggccggtgcactaggcaataccacgttacccatctcaacttgtaaatcgtcccggctattcaagccagcatattgaaaatcatctcgttgtaaggtcacgatttaacctcctttttaaatttaaatatgtaaaaagggcgtccaattaaggacgaccctttggttgattaggatattagtaccccatcatttgggagtattgtgaagctgttttattgtccgatttaacggcattaaccacgtcagatttagcaataacggcttgaacgttgcccatgttgcctagaatggcggacattaagctgattagtttatcaagtttcttattactttcactattagtagatacaacttggctaccattgttgccatttacaatctgactagcttgtgaaattagctggttagcccgtgatttattagtcaacggtaacaccatttcaggtttgttatgttctgcaacctcaatcaactggttagtgttaataatgccaccgttttcgtagccatgtccattaccaaggaaactcaacccgctaccataccgatgttttgcatagtttaatccggctaaaagattgtcgtatccattccagatattgttatgcccaggtaaatgataggcactaaacgtccccggtttaacttgcatcaaaccttctgcgtgtccgtcagctaaaccgtcagtaccacccattgctttagggttaccaccagattcggtgttaatttgacgtaacacccggccaaccatacttccactagttgaaagtccaagctcatctaaggcttttttaacgtcaggtttccaacgctcaacaccaaagccacccggatcaccaacatcatcaccaaacaaactagcaagcttactaataaacttccagaatccactgccaacttgtgatttgataattttttctagtccactattagctttaatgcctttatcatttccacttggaagtcctcgaacacgtccataaattggagtgccaggaaatgacgatacagaactcataccaatgttagggtgtgagcttgggctcattgctgaccaatatttaccattaccagcataaacaccgatatgttcattgttaccaatcagatcaccaggcttagcatttgcagcagaaacgtgttgcgtttttgcaatttgagaaccagaaaaatgtggaaaatcaataccaaaagcatgtttcaaggcgtacattaccaatccagaacaatcaaactcatctggaccagtagcaccccaaacgtaacgcttgcctttaccatatttttcaactgcgcctaataaaccactagcatcaccaccatctaaatcaaccattgaccaaagtgttgaccaccatgtcttagcttgcttctcaacgccattaaataggccgtgaccaatgttactcataacacctgagatgcccttagaagaccagccaaacaggttttcaagcgacttaatcgggtgagcaatgatgttagtggcagttttgaagaatttctccaaactgccgacttttttaccaacccagctagtcacacctgagatgccgctagtaacactgtttaaaatatcgccaaagaatccagttcctttggcgtacttggtcacgccttgcatactcattaacatggctgtctcactagcgctcagcacttctgatccagcgggtaacatcatcttagtgttacgtccttgaacaatgcctgaatcgccattaggtagtacaaccatttctttgttaccagtttggggactgtcgttaccatcattaagcactgccatagtaggccgtgtaattggattacgtgatccactgaacataccagtaccagtggcaaagtgaacatggcctaaatcgacgatagtctttcttttaccaccaaacgcgtggatgacactatcaaccgcattgataccaccattgataaggtcgataacatcgttcatgccgtctctagcaagccgctttaaagtactccataggcctttgaagatattctcaacgccgcttactaagccagaccagccaccactaaatgactttctaaatccacctagccagtcacccattgaatgtccgaacactctagtatggctcaagtctttattccaatagttgtgcaggttagcccgcatggtgtcccagtggttattccaactatgtgaccagctcttcttccagccaacccatctggatcccatactagaaaagaaatctctagtatgtttatatgaactgttccatgcaccatgcaagttgctagttgtgttattccagtgtgttgaccagctctttctaaagctattcttgaagccattccacttactaccaacggtgctaaagaagtttctagtgtgcttcgatgaactgttccaagcgctatgcaagttacgagtcatagcattccagtggctgttccaaccttttctaaagctatttttaaatccgttccacttattgccaacggtgctaaaaaagtttctggtgttcttaacggaaccattccagctatttctgagcgatttacccatggctgaccagtggctgttccagctctttccaaagctctttttaaaaccattccactttttagacatgttgcctagtgcttggcctatcgacttgccgacatttgagccccatttagcaatacccttgccaaagttaaccactgatttaaacgcattatttacccagtcacgaaacggcttaatatgtttgtatgcctcgtagaatgctacacctaaagcaaccacagcagttacaactaggccaattgggttagctagtaacaatctgcctaatgacaggaaggatttaccaagtgttttaataccagcgcctagcacgctgaatgccttagaagcacctttataggcgattttagccgtccacttcaaaccacggccaatcttgccaccgactgatttagtgtgtgtccacatactgtcaagcacacctttggccttggtggtggttacactagcaaccatctttaaccagtgacccattccggttcctgcacgcttaacaaaacttgcaaacttggttagctctcgttcaccttcagctccatcaacctttggttttaatacaattcggctaagcttaccgcccattccctttgccaagtctaagccactaaaggctagcttcaatgcagatatagccttacttgcaacatacgcactagaagctaaccctgcaaatgctttaggatgtttctcagcgaatccaccgataatcttcaatataggctcgatgtctttcagtgactgtacgaacacattgaatgatgtcttagaagcagtcttcatcgaactaaagaatgacttaatctcttttttatgagcaacaatattggcgccaactttattaatgcctttagctagattagataacattttatctagcgtatcaccaacattaaaattcttgccagcaaatgctttagttatgttactaatctgtttggctagtgcattaccaacatttttaaactcagatttagtattcttatcgtcaatccacttggtaaactggcccattaatggagatttcatattggcaattggcttgtaaacggcgtctaataacgccggcatttgagtcttgattgaccgttccatgccggggatggtcttcattaggttttctgatgctttggcgtacttgccaccaagcgagttcatgacttcctcagcgtctttagcactaatcttaccggcactcatctggtcacgtaacgttgacatggttagcttactattatgctgttgctttttttcaaactccagcatcttttcagcgtacattggcaattgatcgttaatcatgttgaaatcgccaagttgcatcttgccacttgatagcatatgagtgaagttggtacctaatctagtaacgttctcatcacttaggttaagcgtatcacccagcgttaagatggacttagttaattctttagtccgtggtgcattatcaaacacatggtagaacgactggttaagttcatcaaccacattaatgttctggttgaaggctgaagccaaatcgttgccaatattgaccatctgtttgcccttaccagcagatccagttagagtttcccaggtggctgccattgtacgttgcttgttatcgtattgcacaacggaatcttttaaagcgccaaaactagcagtgatttgaccaatagcgttggtaattccgtttgcaactagatgtgcgcctagaattgtgccaaataaatgagaagttttcttagccttgtcatcaacggaatctaacttagaccgtacacctgacataaagccatggggttctttttccatcgctttaagtagctcgttttggctagtcttagctttagccatggctgttgcggtctcgttaacccgcacttgctgacgtttataggcgtcactagtagcaccactggcattcttaatccgctctagttcgctagtttgggccctatactgagcctccatgttagcataggcctgttttaagccacttaaacgagccttgttagcttcggctgacctgccttcggcttctaggcgctttacataggactcacttacagctgtaatctgtttatagcccttttgtaagtcggctaagcctgaattgtaatactgtaatttagacttagcccgatctaactgaccacccatactgtcgtatgaccgactagccttgttaatctggtcagctagttttaaataagcttcttcaccgcttttggtatctctgtttaggcctgattgacgggactttaactcatctatcttagccttttgcagctccattgatttgactaagccatctaccctagctgctgcggccttttgatactcacctgctgactttaatgccgtctcttgggctttccaaccactagtgttagctttgacctcagcggttaactgcttgagcgatttaaccgcttctgctgaatctaggccaaccctactggtcatctcacggccaactactttttttgccattttttaacctcctttttttggcacaagcgctataagccatatgtttgattaatggcctctagtgggtcaaccagttcagcacgatcttccttcttacgagcgttcaaagcctccatcatactgaaaaaagagctatcatcgaattctttcggtgataacccctcggttaataattgttgagctagtaagttgaagtcttcctgttggtttttcaactttaggacttcctttttaatctcactgttacgcttgtgccggcttattttgacgacttagcgtctttgatggctttacgttgcttctgttcagacagcttaatatcagcgtctgagataccatttaagcgcataatcaagtaaccaacaccttcgccaaaccgctcaattgagacagtatcgttaatcgtttccatctgctgatcagtgtagcccattacccgttgtacaaaatcggccatatcgtcctgcaattccagaccgtttttcatggcgtctagttcagtaatctctttttcagtgccttgtgactccagcatgccaatttgaaccttggtagccaagcgaatgatattgttagttggtgttacattggccgtcttgttgattttgaagtaatttttagcattgattttcatagtgatttatacctctttatttaatttttgtatgtattaaaaggccacccagttaagggaagccttttaattgttgctatttgctaggagctgcactgctgggaactacagtggttgtactagttgtactaccggttgcaccaccggttgacttagtgtaaccgccaaatgtttcagcatataatttatctaagttgaagttagggtcatttgacttggcaatcatataaggttgttgtaccccattggcagctaagaaaatgtctggcttcaatggtgttaagacagtaccatttagaaccgttgagtaagctgcttcattgttggtatcagttgagttgttagatgcttcttcaacgaattcaatgttattgaagcattcataaattgagatgtcaccatctagtgattgagattcggcaatcatcgccacatgaggcttaggcaactgacgaacccaagcacctgtgttagggttctgtgtatatccctttagcatttgattaatccgaaaatccaagtccaaagcggttaaagccagggtaggcatagacttaccataagccgtacgcttgatttgtccattcccccagccaggcgttccggccgcttcaatagcagtcacgttaatttgactgaaaccttcgccattatgatcggcaacatagattccgtcagcagatagacctttgacagggtctttgattaagtcaccgttatcgtctagtaaagcaaaagttgcttttacaatattgtgttttgacatttataaatctctcctttatatcatttcatttttagttacgtaaattgttttggttacttggttggtatctggatcagttgtgtggtgctgactagatacaattaaccagccagcagctttaagagctttcagcaaagctatctcggcttccaatgggttaaagtcatcggctaggtcaatcttataaaagatttgaatttcaacgcccattgctaggcctttaaacgtgctgtttgcatgatatgtcgggcttgaatcggtttcttgcaatagcatgactgtactagtagtgttgtctaaatcttcattcggtatttcattcagatagactttatcaagccacgttagattgagggaatcaactaggctggctacctgtgatactggtaataacactagtcatcgtcccccttcttgtactcatctagcatggcgttaaaaacatcatcttgtgagtcgtctaggttctggtcaacaaagtgatcagccctaatatgtttagtcccatcatttaaacgtctggcattcatatcatggtacttattagtccagccgacaattgatctgccatcatgttcaccgtctatatcgttagcgttatagcttatgtggtcagccatgtgtccgtacgtttcgtctttatgtgagctgtagtgtttctttcgcgtggcttccgtcaagttatcagctagcttcttagcgccggccgcggttatcttctcttgttcagcttcgttagggattagcttttgaacgtctttaagccatttttctagttgatcggccatatcatcgtatgccatagctagacccccttagtaacctgtttgagcgtcaaataatcgcaagacagataattactagaatcatctatgctgtcattgatgacatcgtaaagtttacctttatacttacatctaatgccttcataaactttaggattatgcctaataatgaccactatttgctctaattgttcagctgtgagttgataagaagatgcaatcgaccgtgtatagggcgcacagtataaactaaattggctaacaaatgtctgtttactagtcccattaataggattttgaacagttttgacagtgccaatttctatacgttggttaaagtcgactggagttaatcgattagttaccattgccgtttacctcatcttgcttctgactatacaggcctcgtaattggccaatgattgaatcaacaactaagtcaactggattaacagcgtttggagtgattgatgttcggtaataccagtatgaaccagctaaggcgtaaacagccgtttcaaacaaatcactcacgccttccatttcatagaaacccggaacgctattgtcgtccccaatggcctgtttaatgtagctagtggctgcagtcaagtaacctgttagcagttcgtcgtcatcatcgccatcaattcgcaaagatgatttcaatgtttctaaattggctgccacttaaatcacatccttacttagccgcccagattgttactgcactgtttatttattggcgacatggttggctaattacttagcaggggtcgttggagcagcgcttgctgcaaagctggctggttggtcagcaattgcactgaatgatcctgcaacaaatgcgtccttatcagtagcttcaacatcaaagcgatcaattacacgaatcttagtttgatctttttcaaatgcgccgccaccaatattggtagtcaataaggacatgttttctcggtcaaacaaagttaccgcttgtgataagtcaccatagtaaagcgggtaagctggtgctgaagcagtaccaacattaggcagccacttatcagcaacttcgacaatgcgtttgcctcggattaagtattgatctggttgtgttggatccggttgtaataggtaacgtcccattgcatccttaacttctgaaagtgcattcaaaccagaagtatttgtcattaagaatgatgtagccttgatagcaggatcgacagcagtgttaatcattgtgataatgtcgtcgaacttagccaaagtaggcttcttaggtgctgcattcattgcttcaatgattttagcgttgcgagtaacaacaaccttcttagcaatccattgagatagccaagccaagatgttgtcggctgtgtcctttagtaatgagttagtagcggtggtaataccagcataacgatggattgtgtacttaatgatagatagtttaggatcgtcattatcaccaatcgtagctgtttcatcatctaaatcagctaatggagtaatgtcagtccacttttcgtaaacgcgtgaaccagattgagttgtaacagcttcccggtttacatattgttgtaacgaatcgtattggcgaacaagtgcattaattgctgtttgaatatcttgaggaatagttaagccaattgcgttaccagattcatcagtagatgaagttaccaagttcataaccttaggatcacccttaatcataccttggaagttcttaatgaactcagccttgatatctttttccttagcatcaagtggagctttttccttatcactcatgttggcaatttcttgagccttacgttcttcttctaattgttcatgtaaagcatcacgacgggcaaccgcattgtcgcgttcttgtttcattgctttaaatttgtcttgatcaaagctgtcgtcaagaacagctgcgtttagcttgtcgtttaagtctgatactttttgaccttgggcaatccaagcgtcattgattttgttaatattagccattatttggcctccttttgatttttttcaaataaaatagccaatttgctgtttcgtaattcagcagattgaccattagtagtattttcttttttagacggcttagctttattcttatccgccttgtaaatgagattcattagcttattaactgcagatttaggtggaatgtgtgatatagcgttcaccggttgtaattgttggtcattagcaaacataatttcgtcagcaaagcctttatcaacggcatcactagcagttaaccatgtttcgtttgccattagttgtagcaagtcagcttgatccatgccagttttagcttcataagcgctggcaatcgattgatcaatgccatttaaaacactggcttcatgttccaaatcgtccgcatttccagctggttgtgaccaagccttatgaatcataatctgggcagttggtgaaatgttgatatgatcgccagccatagcaatcacgcttgccgcactagcggctaatccttgaatattaactgttacattgccagcataattctttagcatcgtgtaaatctcactagctgcgaaaacatcgccaccattggaagcaatatcaacttcaagtgcttcatcatcaccaccatcatcatcgccactgtcatcatttaaaatgtcagcaacacccgaaggtgatactgctggcattccgaagaattgatagaacccggctgtttgatcatcaacaatatcgcctttaatcatcactttctttgtcatcattatcacctccttttactgattgagcatcaggcatttcatctgggaaataaccagtctgctgtagtaaccaagttgcttgattattagcaattgtgccatctttagttagccccgatagggtagctgcaaacgagtctcccaatgggtctacagcagtccgtatattggccgttatcttagcattaagcttattatccaactcagctaaaatagcctgtaaatagcgattaagggcgttggtatacatgcctttaatttggtcaatattactttgctggtcaccttggccattcaaatagctatcaggaatgccgaaaactttagcaatttgtttgctcgtccagtctgtttggcttaacagcttagtaacatcggctttcatttctaatggcttgtaatcttcaagttgatcaataactaccgggccaccgttggaattgttaacctgtttcataaagttacgtgaacggctagctttcatcttctcacttagcagtccaccatgttgaatagatagaacgcccggcgcgctgattgaacgtgctaatgcagctaacgttaaactgttagacgaattcttaacttgtaactcactcgatagtgcttttaatggactgttaccagtcataccgccatcggtactagcccagcgaatatgaatcatgtcagactgtggtacatattgaagaacgcccaaatcaggctcatcaaaagtaatcgtataggttaaaccactgccatcatctaataagtaggtttgcacttggctaggtcgcaaatattcccaacgtaaatctaaaccgttaggattgcgccagcgatatgcaaagcattcaccacccaataacagttgtgaatacatagactgccaaaacgtgtgaccgttagttgtcgtgctaggattgtttaaaatcccttgtgctcgtggcatattggccgttaattgcactgtagctaagtctccagatatttgattaactgctgaataaatgtctgaattcttcaaagcttctttggcactgacgtactcattatcgccagtgggtgacagaaagctaacgatattatcgtcttctactggcacgctttgaatactaactgaattatttattgttgttggtggttcaaagaaaggcattgttaatcacctcctttttggccagctgttatgacttctgaaagccagccaaccaaaaataaagctacagcaattgctaaaacaccttgggctttcccaaataaaaaggctgcatataccccagcaatcatacttagaataaaacacaacacgtcaaagtaacgccagatagttgcaaaaaattgtttaaaaatcatttatatcatctcctagcaatcccgattccgggttattaaaccattcaagaacttgtttttcgttcatccgttcaacctgtttatcaggattgtttacatctgcaaagtcttcaaagtggtacatggcttggaataaggcgtcaattatcgcatcaaccacatcaattttcagtgtggccttagctttatcgacttgaataccaattttatcttcataaatttcagcatttagtaacgccttttccataattcgatcatccaagcggtcgactgagccttccacaaacattatctgcaaaaacttagttggatctttcaattcactagttcgctgccgaacggcttgcaatggccacccagaatttaaatctaattgtttaattgtgggcgttagtcccattgcatcatagccaaagaaagcaacttccagtcgatgctgttcaacaaagttaagtagccactgataaacttgttcgttattgattagcccttgtgggtgactagtgattgtacaaaatcccttttgagctaagtcccgataattaataccatcttgcttttctttagcttcaatcgaaccagctttctgccatggaataaagctatgctgataaataaaccaccgtggtttgccattattatcacgataagggaatacgaacgccagtgccgtgttatcgctaaacaacgaatagtcaaagccgatatagacttgccgatcatcaaaattaaaagatggcacaatggctttttcaacgtcaggcagcttcaaaaagctatcggtcgattgttctagccacaagttaaggtttttgttttgaaagtcgttgagtgtgccagacaaagcgtcagaattacgcttatccgtcaagccgtttagcaaaacttctcgttgacttggtaaatctagtaagggattacttttaacccatgtatcgggcttgtaagtttcatcaagattatcctgcgaccagatcagccctaaatatgtatcagcatcacgcaaataatcttgttccatagcttgctgaatcatacgctcatcatcatggaatggcacggttggatcaggatatgccgttgaaatctgaataaattgcttattacgcaccttaacttggcccgaaacaattttagaaatcttttgtcgtgtttttacttcaccaatttcatcaaatatagccgttgtaaagtgaaacgagtcgtactgaccggcctcatggctaatcgcccgcaacttgttattagtcttgctcattgtgacttggtccgcttgtgaagacaatgtccgtgtatctagcccactatcagcaatcaatgacttaaatggttcaatcgttgcaatcttggctagcattgatttaatgtagcccagaatcttactagtttgtttgtaattaatagaagatactaagtaatcttggttagatagtcccaatgactcaattaaaaaactataggcagtgataatcgccataaggtaagttttaccttgaccacgagcaacggaaacaatcgcccttgagaatcgcttgccaccgtcatcattacgccagccaattagcatagccataatgaacttttgccatggcataagcttagttggttcgcctgtatcaacattcggacagatagaagcaaatttaagcacttgatctactttcttaactgaataattaaacggaaattcaatactaccttgtcgttgcaagtctcgaatatggcgaaaagctgctagcttaatcaaataaccagtagttaccttctcatcgaggacatcaaaagcatattttgtgcctgggtcagtatattgctggcgaacttctgaacaatctaatgcttgataagctccaataacatcatgggtttgggttaaatcaatcttcatttttaccctcccaaaaattctttcattcgatcagcaacactacgctcgtctttgtggtcatctaagcttaacttgagcaaatcgctacgtgacttaggagatagtcccaactcagcgcctagtttagttagattcttaacggctgagtcgtaaatttgtgtcatgggattacgcttgtagcccatggagtcccggccaattattttaccggtctgatcttgtaacgttttatagatttcttggacttcaccgttttcctggatatgtttatacgcatggcgataaatctcatattgggaagcatattgctctacaagcccactatcaatgcgcttaactggggtattgtcttctaaaaaaggcactaatcgacgccaaacgaccttagcttgccggcctaagtaagctggtggtgtacgtgataatttcccgtcgttgacgtctttatccggctttttcactactactctctccttccactatttggtgaccccccctacctaaaaattttcaaaaattgtttctatcacaagaaaacggcaatgtgtggctctcctctagcgatataaggggcggggggttgttttaattgtcactaagtatataattacactcacaaatttaaagtcgcttagaacgcatgctaggtgccaattagcacaacgattgacgatatgtcattgattggtgttacgtttttaagatcaaacagactattggaccgctttgaagctaaagtcccgttgcttttgtctaaacaaatatgaaattcgaccgtccttaatgccctgaacaatttttttgtaaccaattttaagagtctttgaagcaacatcttttgaattgaataacatcttagtccctgtgacgttattaatgacgacgaatttacttccttttgattcagatagtttgttattgtgatttccatagttgcagttatatttgcgattgcaccactctaaattgtcagctctattatttaatgtattctcatctttgtgatttacttcattattgttttcgacacgatgaacaaatgactcggctactaaacgatgaatgtatttacgtttcttgcatccatctttagcgagttgaacgcttagatatccattgccattgttacacccagacaacatcattccgtgctttttacgaccaatagtatcgtatcgttcaacacttctcacattaccgaaacaactaacttcatagtatccttcataacctttaactggtttccaaacttcttccatcatgacctcatcattctgtttatggttcttatatcatcaacaggtttattaccagttggcgtatttccttttccacttccgtaataacgctgttcccattttgttttaagagtatggcaagaaccacatataactgaaagattttctatgctagcaccatcgttataaaatagttctaatggtcgtacgtggtcaacagttttagcaggtgtgataacgccttgcactttacagtaagcacataagtaatggtcacgttctagaactcgttgccttagatgtgaccattgccttgtccgatagaagctgtattgctggcgcttgtcttcgttgcgatagcgagtgatagtattgtacttgtgtgtgtattgtttatcattgctgcgtgcccaccgttgccgactagctaagtactcagcttcatgctcatagtgctgctgacaatagtggtcaggaaaagtgaccattgcatggcagcctagttgcctacaccttctaactctcggcacgccctacacccccactcactgttaatgactgaacccatcgcaaattccatggctccatatgcttcaaagctaatgacgaaacatgcacttcactgtattggcgaccatccttactgcgttgacgtaatgatatatactctataactgcaccagattcagaaacaaatcgctgtttgcttttaaaatacttaccggtagcaagatacgttctatttcgcatataatctttgaactcttcataagcatcgtgttttgtataacctacgataagaactttcatatctttatcctttcaagttacccatattcaataaccacttcaaagcatatccaacgtcatcatcatcacaactcattaaatacctccaaaataaaaagccacacaacaattaagttatgtgactttagtaatataactatgagatggtaaggatttgcaccctacaactagccactgggtatttttgctaactcagtgaggttggtctccgcagagattatcaatctcactgtggctttacctattccgccacgtctcacctggtagttgtccccgatggtttccgagtaggacttatgctggcctttatgtatctccaccagacttcttttgtgtttgcttatccgtgactaccaactacgacgtcaaacacaccagtaacaaaacagcaaggaattgaaccttgcaacaaacgtatcatgcctttcctctaattgaataatttgttgaaacggaagcttgtcgaaccatctgccctacatctttcgatactaccaatataacggatgataactccaaaagtactcaagttttactccaaatttactccagatttactccacttttactccacttttttattttacaaaagcttggcactccagcctttcagctacatctaatagtgccgcttcatgccagttgaaataagtagtcgatgacatattgtaatacctgtcgggcaatcgttgcattaatacgtccatgtagtagccgtggtcttcctcgtatccttcacaatagacaatctttaggagttcacgataatggtactttctacaactgttgattgcccaatctacccatttacagaacactttacctttttcggcattaatcattctttgttcaacatattctggagcgggtgccgttgcacttggtgccccatcaccaaagctggcggtaactttcgggttaaccggagcattgatgtaagctttgtacttacggtatttagacaatatttttcttgcgttatacttggtctgctctttatctaattctggtaataatgtcatgccccgtcactcctgttataataatgttgttgagattattagatcgagggcacgtctatgaggtgctcttttttattaccatcattcatcgtcgaattcattccacattttctttaaacctgtactaaaacatagttcacatgtttcaaactctacttcttcttcattcgtttcaatatcaacaagtttgattttttcattattccacctcttctagattgattttgtaaaccttgccaccagtttgtttcgctaattcttttgcgtaatcttcattgtaaaacgttgcgccatttatggaatttgcaaatgtataaaccatttgtgatgcagatactgattcttttaggtataaattccctaacttaactatgtaaatgttttccatacttaatcatcctcctttaataattaccactaattaatgcccacttcgtagtatcaaatcttttaattttatagcacttagggcaaccggcaactacttctttgtgccatacacccgatatatctgatgggacatttgccacacgcagaaatacccaatcatgcttacagaataatctcaccgttattacacctcttcataagttttcctgaaaatgtcgtcagcgattgcccaatgctcaccctcaacacccgtagcaatccaatcacctatattgatagccaaatcgccttcaagggttggtattgaaaacgtaggatcccaaccatcaattacaaagttttctttcacaatcccatatttatcaatcatttcatccgagccatcaaactgttcagccttgatagttgctgttttgcgatattcttttagcattggttgtcctccaatttttctgcctaatcattccaatatggataaatcagcagtgttatgcccaaaaataataatgtgctggctacatcgttacggtatgttccgaaaatcgtaaatgccatcatcactatgtaggcatgttcatgaagcgaacttataattttactcatcttctacctctttataaattttcaccaagcgattctttccaatatatattagctatatttttccgccacacttcccagtaagtcatgtcgtaaggacattcattccattcagctaagttcttttcaacaggtacccaatccttatagcaaagataaaacgacattatgaatataattggaattaatataagagcaaggattccaaacaaaacatctttaatcatcttctacctccacaaactcaagcagtccagcattgttgtaagcatcgtattcgggccacttttctttagcttcctcctctgtaagagcaccacccgtaattccgtcactgcctgtaaggcctaagattaccttcccttcatcatctaatctaacatacttccgaagaccgtgtatcccttttaacttaactacacgtcttggtttttcaaatgtttttacatattcttctttagtcatctagtcgccctccttgaatctttctaataccggcttaaattgatcttccaatcggtccaactcgtcaagatattgtgttaattccatcacatcattattgtcacggatcattaaatgaatagcggcgttaagagcgtacctgacactcggatagaaaccaagttgcttcatgacaggtaaattgtccttgtctaacttaatcgctccagaatcatctctgatgaacttcatcaaggtgtgattgttgtggctctcgattttaatctggtaatcttcgttaattttgataatcatttttttatccccctaatcagataagtgatcccgctaatccacgtctgtaaaataatcgccgctataaagattgctacgccaatcaatccactatgcaacacatgcccgattaacactgctggcaatagccaaaaaacgcatgagaaataccacagcatgaacataattagacttcctccggttcaaattccacatcaatgcctaccttcgccataccgatcgcaatctcttcagcttcttttaacgccgcttctttttcagcaaacagcttggcttcttctttcggtgctgtccatgacacttggttcatgtagcctttatcgtccttattcttcaatatgtagaacttgtgctgttcaacttcgaagttaacctgctcaccgatcggactaatcgcagcgtgtaagatgtccgctttctgtttggcttgcttccattttctaaacaccgtggcatcttcaatacccacatattggtgagcttgatttcctagcctacgataatagttattagttgctgtgttcttaatcacgtacatctttttcaatcccctttttaaacttctttttccgccaatgtctctgttcgtcgactactgatttttcaatgcgttttaaatcttcgattgtgtaattatttccgtagacttctctaacaatttcctctgccgtcataattcatgaacctccatttcatcttaatcacttgaggacgccttctttttgcgtatcttgtaccagtgactggcaacgttatatcgtgaaatgcctaatttttcggcaatttcatcaaacgttgtacccttgcttctttcggcaattagaagcgcgtcttcctttttagtccaacttttcggcttcctttcgcttttgctcttgtcgattttgattccaaggtctcgcaaatctgaatagattgtctgaacttcaacgcctagtttccatgcaatgtcagcataactaagatttttttcgagcatttctggaagtaggctctgtcgggcaaccttcatcttgtgcttcatcacgctaacctcaccaatgtacttacgcttttttacttttgaaatactcaattcacgagccttacgaaaaccttcatagtcgccacggtctaataattcctgctcaatatcagattgcttaacaaccgtgccaacctttacatagcgcatcggttctggcatatccatatagatgctgtccttgcggtcaccgtcgtattttgtgtaggtcttaagcatccacttatgtaggtctgacttatgttcgctttctccataaacctctttgctattgactccgattaattgccacattagtctaacaactccttttgcccttctgcttcttgtggttcgtctgtatctaattccatttgcttaggcgtaatcttaactaacacatcgtcacctgcggtattacttaatcgggttgctacttcaagaaaatcagtatcttctacagtcaataaaacttgtgctccatttttatctagagttaccttcttcatgtttgctgaaaattcaaaactgttatctttcattatttttcctccaaatctaaatctgctggcatgaccaacatttcaacatgcggatcttctgagtaatacttgttagttttagtgctaactatttgcgcgtcatcgacccataggagccccgtacaggcgtccgttactgctttaaagtaattatctatgtcacctttaacaacgggtctatggaagcctaagagcctcatttcacgctctttttttgataggcttttctgaatcggccggtaaattgaaagttgcacgtgcactgcgtaattaattggttcatcgtggtactgttccttaaccgccgcagccacttttttcttgtatgctctcgacttaggtgggtcgtagctccgaacaaatcccccacgtccactaaatctaggacgcccttgtggtactggttctcccggtacttctatccttatcaactcgctagtgccccctctcgtgctctcttagccatttcatccaatagttcgtagtatttatacgtagctttctctaacgccgtcatacggcttaaatcgcctttgtattgggcaatcattacatccataaacttgtctccaccgccatcctcgaaaaacataaagccttggcgtttttcaatctcggcacaatcgatggcgtcccacacagccttccaacgttgttcttctgtttggttgatatattgattcaaaatcttgttaccgcagtcagcttcttcttgctttattaaaatttgctttctccgattgaatgccgctgcacgtttcaaaaacaacctaaccgccttagattccttatagccattctctttcataatcgcttgatactcgcggtagtccatgtaagccactagattgccacctctttgaacgtcatttcttcaccaataaatgtaaagttgatatccgctagctctccttcacggttcttacgaatggataactgcacaacgtgatcatcgttgactgattctggtcgatgaaggaatgcaaccacattagaatcttgttcaatacttcccgattctcgtaagtcggatagcactggtgtcttatcattacggttctcaatcccacgagataattgtgatagggctacgattgggatgttgaactcgttagttagtcgcttaagctctcgtgttacctcgccaacctcgatgtagcgttctttaacgtttggaactttgactagcccaatgtaatcaataattgccatatacttgccttgctttgccctagacgcgtttttacgaatcgtctggactatttcacctaacgtttctaaaccgtcgtatacgcgcaatttagacgctaataattggcttgtagactggttaaccaactttttaaggatgtcatttagtttgtctgcgttggatcgcaatgtactgcttgaaaccccggtcattcttgaaataaaccgattaagcatttcttgcttgttcatttccaaagtgaagaaatcaacctcaacatctttgtcatttgtcatagcttgataagctagatttaccgaaaacgccgtcttaccagttgatggccgtgctccaatcgttaacagcatagatccatagagaccaccgccaagtgacttatcaagttgcgtaaacgtcttgattccgcgtggtttcggatgagttaaggcgtctgccaactcggcagctgcttcatcaagttttccgtcatccacaacttctaacgtttgacttttagctaaaatctcccggattttttcttcattttccgaaaatggattggcttggtaatccttaatcgctacgcttagttcacgtttgtaagctaacttgcgcattagattaatatcattgttgagttggctaactgctggcgcttcgtccacaatctgcttaaaggttcggaagtccatggcttttttagtcaattgattgtacttaccataaacatctaatatgtcgtggccggttgtctctttgattgctttataaattaatcggtagtcttcgtaaccgaaccattcttcattaagtgcaacggctcccaccttttccgggtggttcaggagggagccaattactccccgttcaatatcagtgttcatttaatttctcccttgctcgttcttcgatttcttttaagtgattagcccttttggcttcaatctcttcaatgcttttacctgcacgttgaccatcgctagtagttgtagtcgaaatgttgctactcttcgaatatccatttgcttcgttaagataattaccaaaatgacttggtgcaaagattgttgtgattcttaggtatggattcatctttggatcgtctttccattgtttgcttttgaactcaacaactttagccaattcagatttggaatatccttcattgattcttgcccttatgatttttcgattggattcaacgtttttaaatctcttaccagtcttctgattgaaccattcaataaacttcccataatcaactttttctttctggtcgtccctgggcgacaaagaatctttattattatctttattaacattcttattattgttcggatgtcgttcggttgctgtgcggttgctgtgcggttgctgttcggatggagatttttgataacgctcaaacccttggtattcctcataattcagcactgtaaatagtgttccgtaatcggtactttcaatttgaattcgattttcctttacaagttgtttgattttgctttcaatcgtacttattgagtaagttttgaaagctcttttttccatatacgtaaggtctttttgtagattcctgtatgaccttagatactgtcctcgcttcaaatggatatctccaacttgcgtgccttctttagcaaaaacagcattgccataaatgtaaaagaatattctgaatttgataacatcggtccaaattggattttcaaatatttctctacttgtttgaaatgctcccttcactaacaatcaccctttttctatagatatccttttaaatttagaacggtaaatcttcgtctgaaatatcaattgattgaccgccgttagcgaatggatcagttgaacctgtttctttgtttgattctttaaacttatgttggacttctggaaacttagagatttcccaacgtttaacgtttaggttttcatattttttaccgttgtattctgattcttcgttcttaacggttaccaatacaggcttatgccataatttttggaaatagtcttccaatgaatcaaaatgggtcttgtctttcataccagctgctttggcaattgtcataatcattccaattggatatttatttgttttcttagatttaaaaatacgagtgaagatgtgtgcattgccaaatttttggccttttaaatcattacggataattaggtcaaggttaatgaattgagttccacccttagttgcatcttctgctacactattaatcactgcttcatacttaccatcagttacattcatatctttaatttctgaaaaatctaaatcgaatcctgccattatttagtaccttccttttttaatttttagtatttttaattatttttctgtgtttttattgttaaagttaaataggtcctcgatagaagccattttccgctcgtctaagcgatttttagcatagaccgtgttatcaccctcgaggatagctccacggcctccagtcttcggattaaccactaatctggcgactacatcagctaaccctaggaacccattaagtgacttgtcgcgaatgtctggtgcgtactggctaaatgtttgcccgctctctgtctcgttgtcgatcttcttctcccaagcggtaattaagatgtttacattgggaatcatgtaaattgttgtaacgattctagaaaaataattcgtccattgagaataatcttgaatctcatttgaaataccgttctttgaatttcgtccacgctccacgaaccaatctttttcaaggcttgagacattatcaatgactaagttgtcgaatgtctctccagcctttaatacgtccgggtctgataagaaagtatttaaatcttcaatcggcttagttcggtcaaactcacgtccttctggcgttccattgtcaaaacgatattgttgaatgttatcagaaactccttccaaaactttaaaagaattatctaaatcaagcactagtgttttaccctttagatacttaattgacgttgttttaccttgaccagcttttgcgtaaagaatcattttccaatctttgttttttctgaaagacatcgcactctttgttatcatctaatccaccgccttaactgataacttgtctggtttttgtcgtgctacataagggattagtgctccagtttctgtgtcgactagttgtccgttttttgatgggataaatcgaccatcagcaaccatgcgtttaattgctgacaagttaggctcttgttttactaacgcctcatcaattccagaaagtgactgcacaatttctttaggcttcgcattgtttgccttcgtaacttgccaccacgttggtttgctaggattgctttcggttcgaacatagcgccaagtagcggtttgtagttctctaccctggaataatttaagctcctcttgttcgacctcactaatctggtcgcgaagttcatcaatttgaatattgataccttctttatcgtgcttgagtttgcgcaatttacgatctaactcgctgcgcttggcttctaattcgtcaatcttcattaggttcatccctttcaaataaagcttcagtctccttgttttcacgttctagttcccatgctctttctaagcttgcgcttaactgttgattgttcatgtggtacactctccctaaggtgttttattatttttggcctgctattgccgtagcgggctttttatttttattcataatttataaactccttctttcttgtataatcgatatagataggaggtgaaattttttggaaactaaagtatttaattatcgatcaacactacaatggatgccctctgcggaaattgaaattccatcattatgtcctaggtgctcggtttcaaataaccctattttttatattgagggacacagagtgtttaaagatggtgatgtcgctttcatatcactagaatgttcttattgctcacgttggtcatttattgtgattcaaaaaggcgaaaatcagcactggaatcttttatcagtatcaccaaatagtctaaaaagagaattcgattctgctataaccaagtgctcacctcgcttcgttgaatcttacaatgctgcatataatgcagaacaaaatggttatctagatttggccggctcaggttatcgcgcttgtgctgaaatattaataaaagattgggcattgaaatattctggagaaagtaaagagcaaatttcgaaatacaaattaaacgatgcaatatcacatttttttaatggaaacatagcagcttttaatgcatctgatgtagttcgttattttggaaatgacttcactcattgggacaggccagaagactttgacgcacgcagaacattggatgaagttaaaatttatctagatattttaattcaaaatattctgctacaattaaaaattgctaacccgccagttggacgtggtcattctgtttcaaaaagtaattgaccatcttcactggagtaataatgttcaacaaatctaactggattttctgttgatccatctccttttctggtggttatgtgaataacttttaaaacctctactttgtaggggttttctttttgtagatttgcaagaacctcttctttacttagatatttcattgtcttcatacctcctcactcaaaaaatgaattaaatccaaatcgtccaaacatgtagaacatccctgctattaccaacattgctatcaaaaacctcattgctaattccctctcataatgatttctttattgtcatctataaattgcttgatttcatcggcaaacatccaccatgtaccacctttaccaccgccaccaagcgctcccttattgcaaagttcttgcagctgtttgtataagtgtgggttagctaagacgttagcggtaatccattgagtgctcttattgagcatgtagcttttcaagtcgtccattttccaaatttcgtgagcctccgctttcttcttggtgatttcccattcgatacggtcaactaagactttgtcagccggtatctcgaacttaatgttcgcttcaacaatttgagccacctttgctacctccttactctcctaacgttgtttgacctgccggtaccttgctcatctctttaataatttgtaccgttgcagtagatggttgccagttactgatgaattcatccgctttatcgaaatccttttgacgaagctgtgaccgcgtcttaacgcctgtgacctcattaattcctcggttgatatctttgtacaatttgctacgttgtggagctgatagggccaagccatgcatatcaatgtattcatagacctttctactaattcgttttgaaatatatgcatattccgttggatctagtcgctggttatccgttaggttttgaacagtattgcctaaacggtctactttcttattggtctcttctgtggcttcaaacatcaatttcaatgcttccattggcgtcttgggtaattggatacgttcttccctaattgcttcttccatattgttaaaggcttcgatgtatttcagtttgaatttgtccgccttcttaccggtgaatccaaaagcaataaaggtaaatccatcacgattcatgtaatacatcttgtttcgtttaccgctcttatctttgtattcgccctgagcaaacatcgaatcgtactgagcggaattttccgctgagctaattttgttttgaatagcttctaaaacatcgcggtgattctttccaaatacttctgctacctgtaaactggttgtcactgcttgttggtctttcatgattactaattcgttcattcttatttccttctttcgtgtgtataatttaagtagttcaaataaaggcggttagataatgattactaataagcaagctaaaattttaaaagctctacaaaataatgaaaaagtagtagttgaaaacttctatgaaatggatccaagcattcaaagcctttatgaccaaaaatttataaaatttcaacttggttataatggggatgaatattatgttgaagatgtattcattgaaccttcaggagtcgtagcgctcgataaatttaatgaccatcgaaaagataatcgttggcaaaactttttctatcccgtattagcaaatattgtttatgcacttgctgggtttgtagccggaattattctgacgtatctacattttaagtagccagataacgagaattgctccacatattccacctagtgcacctaataaaaacccactaattgctattaatccacgttcatggtcttctaaccagctttgtattttcattcttgttttccttctttcttgccctacatagataacatagggtaaaactatgtgtttcggctaaaaggttctgaaattaaattttatattccatatttttcatgcaaatattcgtaaatctcattaaccaagttttcagaagcacgtgttactgattgtttgtttagtgacaaatttacaaagcttcgtgacttaccaaatttcttagcaagtgaaccttgtgtttcaagacgtcgattatttgataaccaagccttgatagcttcggctttgttgttagtctccatgtggataaacaaatcgatcacctcctttttgtattaattattaaactttgttaagaaaaatttgccattttgtattcaatatcgtacaatgaatgcatagttaaataagcaatcaaaaccactaaactatgcctgccagctgtgttgattggtgtttttaatttgctctttttattaacaatatttcttaacaaaaccaattgtatatcattgaatacaaaacgtcaacaacttgcattcaatttaatacaagtttttttaagtgctttaggagaatactattatgacaacatttgaaagaataaataatatggcaaaaaaacgtggtataagtctgcgtatgcttgctaaaaatgcagggcttggagaaacaactatctacgggtggaaacgtagaacaccagattcagcaaaacttgaagctgttgcaaaagtcttaggagtgactgtggactatttattaggtaaagatgataaaccatctacttctaatgagcctgttgacttagataaagtactgtccgaggaaggcatggctatgtttgatggaaagccattatcagaggaatataaaaaagctctattagctatgcttagagctaataagaatagtggtgaatagtctatgcgtgatgatttacatgatgatttattggctcgtcttatttatatcgcggataaagcaggaattaagatagaaaacattgaaggcaactctgcagatcctgatgttgcgttttgcaaaagcaggattatcaatttaaacaataattttgaatgtaatattagcgttgcgtttagacttgctcatgagattagtcatattcaattctcacagcctaccttcctgtatacgttctccccgttcatcaagaacaaagaggagcgagaaactaatatacgagctattcgaatgattgctaaattaatctacaatgaagtaccaaatgaacgcagaaattgggcaaactttatgagtgaatttaatcttcctagttggtttgaaccattagttaaggaacttatttacgattaattattaaccctacgtccaaatactgatcgacgttaaaagctgaacatatttttaggaggagtttcataatgaaactaaagattaatatttggactgggattttagatattgttaatgctgttgtgttcgcatcatcatggtttgtgatattctcaactgctttttcagatgcagcaaacggcggtaatgctactgatggagttggcacattcttttatgtgatggctggaattggagtagttttaaatattattgcactcattcaaagtaaaagacatggaatttctatcgttggtgctgtacttggacttattggtaatgctctattcttagtaagtggtgcgctagcttttccagctatcgtattacttatcatcggaactgtatttatctttttacaacatcccactaagaagagtatagattcaaataattcaaacaatcaacctgcttaatatatgcgtctcccactccggtgactagatacagtccgactctgtatgtgggaatagtagttactacaatatatgcaataaccaaaaaagccacatcccctaaccgccaagtaagatgttagaacatgattggccgatcattgcagctaacatccccggtattttcttaggattttttacattctataccgcgttacattaatactttatttacaaaggagcgaatagtttatggaaacgagtattatggctatcattggaataattatattttttattggagcattaataataactcttggtcgaactttaaatatcttacgtttcttttttggtgatcgtagtatgtttacgcagatgttttggggaattatctttatctgcattggcttatttttaatcatacttggtagccctcagcttagatgatatcctctttccactccggtgactagatacagtccgactctgtatgtgggaaatagtagttaacttaatagatttaactacacaacaaaaaagccacatcccccactcgaccaaaagttgggatgtgactaccaaattagaaaaaccacggaagtggctcctttaatgtacgcttattttaacattgaagcctgcttccaacaacagaacggaggttcgcttttatgtcaagtattaaaaaacaaaatggaaaatggacagctaggataacctggcgagatgaggagggaaaacgtcactacaagagcaagtataattttaaaacgcaatccgaggcagaattatgggcagcagatttccagttaaacaaacgagatattgatagtgagacttattttcctgcttatttttacgattggtacctaacgtataaagaaccctcagtaactaatcggactaaagctacttacctacagctatataacgttttaaagaagtcgttgcttgctaaaaaaccggttggcgagatcacccggaaagattaccagcgattcatcaatgcctttggtaagaaacatgctaagtcaaccgtaacgaaatttaattcgttaatccatgcttgtgtcaaagatgcgctctacgataaagccattgaaaaagattttgtttacggcgtttccatggtcttcaacaagagcaagactcgcaaaatagattatttaaacattgatgagatgaacaccctatccacttatcttcgtagtagtttaaataagcattttacaagcaagtacatgattctaactgcgatttataccggcgctcgtctgggggaaattcaagccttgacttggaaagatatcaacaccacctttaataccctctctattcgacagtcttggaatgatgaagaacaaaaatttcaaccgactaaaaacgaatcgtcggtgcgaatcattaagattaacgacgatttagcacagttactaaaacagctaaagcctaagagcagtagcgtcaagatattcactaatcaatatggtacggtgccctcttccagcgccgtaaataaaacactccgggaatcattagcccattgtggaatcgataaacctagttttcactttcattcgttacgtcatacgcatgtagcgtatcttttatccgaaaacgtcgatttgtttatcatatcaaagcgattaggccattctgatatatcaacaaccagtcgagtatattcatatctaattgacgaatacaaacaaaaagctgatctacgtatcgaaaaatcacttgataagatttcactgaattcaaaaaatgtgcgaaaaattttatagcaccggagtagcaccgaagtgcatttttcatataatattctcattttattctatctaacaaaaaagtggcttaacaccagtgtttctaaggtgtcagccccttttacgacgtttcataagaccttctaaaaaggtactaataaggagagtacaggatttgaacctgcgcgccggtattaaccggttcgccggatttcgagtccggtgcattaccactctgccaactctccataacagaatttattatatcagatgaattattaacccgcaacaccaatcaagtatttttttaaattttatcatgaactttacccatgaatattaacacccttttaattattttaaaatcgcttaattctagttaattaaactctttagcggtttcatcaaatcaatacaatcgcacctccttcttcaagtaagattagctgacctttatgcctatataaagtttatttagtactatttttaaaacattttaccgaataacgtaaatatagcactcctaaaatatccgttatcgaaaacatttctcgttgataaagcatttatcgtgtataattatatataacagtaagtattaaggaggagctaaccatagattctaccaaattaatgaacaagcgcgatttgcttgcgtatcaattactccaattttttagtcagaataacgtaaaaccaattagtacctcctcgttagctgaaatcttcaacacgactccgtacaaaattgaggcttccatcgctactctgaacgctgatttacaaacaattactgctaatgaccacagtgtttacgtaagtgaaaaatcatataagggaatttggagcggacataacctttttcaaatcattgtcgacaaagtcaaattatattatattgaacggtcgactgcttttcgtgccatggaatatttattgttttataacgacttggttacccccaaaaaatatattcccagggctttctcaagccgcgccgttttttatcgtcaactaactttagttaaacaattactaactgatgagtttaacaacttaacaatccaaactgataaagaccgggaatttcagattcgattagaaattattgaattatacgaacaaatttataagggattaaaagagccctttcccgaactagatccattaataaacgggatttttgatagcttaacgccctttttaaacatcaattacaacacggtgaaaaatttaaattatcaatatttctacggatttggatattacgccataataaccacaagtatgttcgtttttcagcacctcatccgcttgatgataaacgctatgataaaatttatcacgtcttaaagcagaccctaggctggcactttaagctaacccattcggaaatgctttttttgtacggttttttattaaatcaagattacttagattatgcgggggtcccaaaggatacgtgcaactatcaattaattaataaaattacggatgattttctaaattggatcaaatcgtttaacattttagcggactttccgttggaagttgaacaatctttaagaaaagacattactaacgtcaatttaaaattattttcgtactacgcggaactactagacgcaacttacaaaaattcaatccataccttacgagaaaactatcctacgtttgatattttaattcagcaattttggcaaaaacttgctgcgcaacccgagcttaaaaaataccatcttaataagtacaacttgtactatggttacatgttggcattagctaataacattcccgctaaatacagtcgcgaccgagttagagtggtgattgatttttcaaagggcagcctgtattcccagtacgttgataatacgctaaaatccttatatggaaataacgtaattttgactaatcatttagaaccacaatccgatctcttcttatcagatacgtattcttacaaaattaaaattccacagctgatttggaaatcatttccaacagttgcagattggaccaacttaattaccctaatcaaggaaacccgatcagcaaaagctcggcaattttttaaataacaaattaaaagcgtgtaagacaaaaatcggctagtttgcgagaattaactgaaaagcgaccgttatgaattggcataacggtcgctttttgattaagcaaaactaactgatttttagcacatattttgcctctattggagccaaaataccaaaatagctttttgagaatccttgaaaaatatttctttaactttgttcaagcccccctccagctcatcagttaaaaacatccttaatcgatattcaaaattttacgtaccttgttaggcaccttgtccttgctgatctcgttaggtccctttattacccgttttttcgaaatctcagccttaatgaccgcgctaggagtaaacggcttaaccttttctcccgatagttcgtaatctagcgtacgcttttcaccattttttaaaacgaacttaaatttataatcgtaagcgtgttcgccagtaattgcttttccatcgtcatcagtagcttgttttttaacgggaacttcggcaggaaccaccgcgtacgccgtttttgcttggtaggtgtcttcgtaatacttccatccaaaaataatcactactgctgcaactagaattgctaaaattcgtcccgcatctctcattttgcattctcctatctaataagtcattaccaacatctaatgtttgtaatgaggataccatttctcggtttgccattacaaaaataatggcttctgacatccagaatgattgtcggattaatcaaaaacttactggccaaatttaaaattgtgaatgtagtcttttcgaacacaaaaaaggacgaccttacagatcgtccttccttaaatattaataactaaaaattgctaattcttacggctttgaataaaccatgatacaacagctactaagattaccgctccgataatcgaaggaattagtgccattccagctaaggatggtccccatgttcctaataagctttggcctaaccaagcaccaattaaaccagcaacgatgttacctaaccaacctgctggtaaatcacgactagtaagcgcacctgcaattgcaccaataatagctcctacaattaatgtccaaataattcccattattacgccccccttcattgcactaataataacaaatgttcattttatacacaaacaatatgcactaataacgtattttgtaaaaaatctgctgagttctcctaaagtttcatgcttatttttctgggagtttgttacttcaaacggtcttaatagtaaaatctttccagtgctgtataattttattaggaaagaaaggaagttattatgaataaatcaagagttgaagcctttactgatgctgtattggcaataattttgacaattatggttttagaacttaaagttcccgattctagtcaattaagtgcgattttaagcgagttgccataccttttttcatacacggttggctacctcctgattggagtggcctggtatagtcatcattacatgtttagcaagactgccggcatttccaaaagagtttattgggcaaacaatttttggatgttcacgacttctttcatccccatggcaactgcctggattgggcaagatttgaaagcacagggaccggaaattttttacgccattatcttttctatatggaccgcggcttacttggttctaagctacgtaatttcaaatgacgacataaaaagaaaacagtataaaaaagcccatgacataagaaaaatgaagatatatcggtatttgacaaacataaaatatatgacaatccaaaccactgtcctggttatcatcttagtttttaagcctgaatttttactagtggtagttttatggcaaatattggcattcgccatctggaataatgatgatagtgacaaattattttaaagaatgtcatgcctaccttcaaagcaaaacctagcattttcatggatgaaaacttacattgctccttttttaattaacccataaaaaagaaactgcaaaagctaaatctgctggtgttttgcccttaataaagtcaaaacgtgcgccaaaagtcagttggttctgtttaacaaaaaaaacgatcgttacgccaaattcaggcataacgatcgtttttcagttaatcctcacaaactaaccgacttttgtcgcactctcgttttcattttaacctactttatctaaagtagctgtttattagtattttattgtagttttctaggctgcagaacgttttgcgttgatatagttaacgataaacgtcaagcccatcaagaccactgggtaaaccatgtaacgaatcaagtctaagtagttcgtactcttccccgcaagttgaagggtcatcatcatcgcggaatcttgaggaatgaccatcgaagccgtaaccgcaaaaatggaaatcactccggcgagcaccttcttatcaacttggtattggtcacctaattccttagcaatcggtgaagtaatcaaaaccgaaatattgttattaacgattgccccggtaacacagaaactcaaaattccaatgagggcttcacaacttgccttgctcttgatatgccgggtgaacacgtggaccatccaatcaattccgccatagtgccgcattaatgcaaccattccgttaaccatcatcgcaaagattgctagccagaacatgctttccattccgttaccaatcgcctttgcgcacgcaaatagggaagctttacccaacgccattccaattgcactggccattacggtacctaaagctagtactagtactacgtccattcccatgacagccaaaattaaaactactaagtaaggcaaaatggtaattatgttataactgccagcatgaatattgctagcactgctattatttaaactcattaaagtataaataataatcgtgattaccgctgctggaacggcgatcttaatttgccataaaaacttatcacgcattcttgcgcccactcccgctgccgctgaaatggtagttccaccgatcattgagagtccgtctccaaagtacgaaccggtgattaccgctgccccagccattcctgcgtttaagtgtgcagctgctactagcgaaaaggtcactggcgccatggttacgatcgtccccgtagaagttccgatacacagtgaaatgattgccgcaatcaagaagattcctggtaccagaaattggcttggaatcaacgaagttcctaaattaacgattgaagactgtcctcccgaaattgctacggctgaagaaaagccccccgccatcattacaatcaaagaaaggttcattactcctgcatttccggcgttgtttaggtagatgttcattttcttggcaaactttgcccgcggttcgaagaaaattaaagcaaacaacaacgccactaaaattgctacctgtcgtggcatgtacgaagacggatccttggcgcctttaatcgtaaagaccgctaagcagcctacgtacagcaccaaaaaaatcagtaatggtaacaaaccagccgcgccataatctttgcgcgttttcttttccattctcaaatccccttaaacatttattggtctagcacttatctataataccaaaatcccgttcaattaacataactactaaactaaagttataggttaccattaataagtaaatttttcaaataaaaaccctctgtaacaggtagttccgagaaaggcgctcttttctcctgaatcgtcaagtaattttttcaataaaaagaggctgagaaaaaataaagtaatcctttttaaggatggattttttggaaaatcaggctggaatgttgcctttactatcatagaagcaaaagtcaatttttcggttcaatccaaaaacgaccattaaaccaaattcaggcttaatggtcagttttcagtaaatgttcctaaactacccaacttttgtcttcctctttacttaattggctagtctttttgggcatttagatactgcgtaaataccgtaatatacatcttaataaagtttaaatataagtccttttcaacgtattcatcaacttggtgaactccgtcaccggtcggcccccaaatcgcaaatggaaaaccttcatccttatcccttagcaaattagaagcatcggtgaccgccggaatcacccctggtttaattggcgcaccacgaaattcgctaccgacttgttgaattaattccatcagccggctttttccagttgtttccaccgcatcctgagtcatgtaggcttccaatttaacttgcgcgcccgcgtcgttttgctgatcgactaatttttgaaagtcagcaatcacctgttgattggtaaaatttggaatcgttcgcacgttaatttcagcttcggccattgccggaatcgaattaacctggttcccccccttaaaaattgtagtatggaaggttaacggcccaagtaattcattttcaactgcggaatcacggaaatggtgattagccgcgtgcaaaatttcaattaacggatcaatagcgtttttaccgtcttcgggcatcgaactgtgtgcggacttccccttagaagttaacctaatatctaaggaacccttatgtgaaaatgccggatcatagccacttggttcgccaatcactaaagcatccacgtcgtccatcagtcccatttcagcaattttttgcgatccttcttcacccacttcttcaccaaaggtggccattagccgaatggtgcccttcttcagcaggcggttgtgcttaatttcaatcaaagcgattaccatagctgctaagccagatttcatatcagccgcgccacgtccatacaaacggccatcacgttccgttagttcaaacggattactggtccattcagttgggtcacctgcatcaaccacgtccatgtgtcccgaaattcctagaaccgggctgcctgaaccaatttccgctaacaaatctgcccgagtgtcactatagcgaagaactttagcgtcaatcccattttcctttaataatttttgtaagtactttgccaccgtaatttcgtgatcgttagtagaattaatcgcaattaaatcccctaaaatcgctatacaatcctcatttgtaaataccggtcgttttaattcaatgtccattttattcctccttgcgtgcacatcttagtgaaaacgtcttcatcattaattgaatgcattttatcactaatactcgttaatttacaagaaagaccctctaaaggattaatttctggaatgtggtgcgttaagttgctgaattagtttttgattttggtaattacgataataatagaacgtaaggatatgcagtattaaagtaagtatcaagatttcccaccagaaaggcaaaaccattttaagaattttactagaaaaaagccctagtccaccaagaagtgcgccaaaatttattaatgttgtgcagccaatatttctaagcgccccccatgttgtgtagttccatatgtacggatagataacgccaaatacactcccgccaataatggcgattaataagagatgccataggtaactaggtgtcatttccaaatgcgggcaaaatagttcaattactactatcaaccaccccatgaacagaaagctcgtctgaaaaaaagtatgttttagttgagttatcaaattaacccctccttcacttttttagcataatgccggctaacgatgaaactttccgcatttttagtatgtacttctatacgtgcatacgtcgctttcttaaattcggtaacctggtccatattcagtatcgttgaattattaatccgcattaaatttttcaacgccaatttttctaaatctttcaaccttcccctgatatagtagacttggttatttaccgtataaagtttcgaaagatgatccatcgcttcaattagataaatctgagaaatatcaatcttaagccttcgttcatttttgggattaattacttccacctgatctttaaagttaaaacttcttgttattttgctagcgtactttttattatcgggatgtagagtaatggtagctttgtcaattacttgttttaaatcccatttaaactcaaggtaaatcattaaaagcctcccttcattgaccaaggttaccgtcttttaggggaatccacaatatttctaatttttgttgcaaaaacgcttcctaagttgccaccttgccttactagtacggtttaagactgagcactcgaaaaagaggctttaccacatggtgattaaagccccttcaatccttgttatttatatttttaaatttgagcgtcggttttgctttatcgttctgcttcaccaacaattttattgatgtccatgcctaaagctctcgcaactcgagtgccgtaatcatgatcagcgtcataaaattgactaatttccagccgtttaatttcgtcagatttaacctggcctaaagctcccttaattgtgtcgattaaccgatctttttcagctactgacattaggcgataaaggtcgcctgcttgagtcgtataatcaacctggtattcataaggttgtgccatcgcttccccgtccaccttgaaaggtttaatggaagcatcccgatcttcagtaggtccgtcaaaggagttgggttcataatttacttccggtccctgcgtggccttcatagcgccatcacgttcataattgtgtaccgggactaccggacgattaatcggcaagtcttcaaaatttgctcccaaacgatatctttgcgtgtctttatatgaaaatagccgaccttgcaataatttatctggcgaagcttcaattccaggaactaagttagcaggtgacattgccgcttcttccacgtccgtgaagttattagttggattttcatttagcaccatctttccaaccttaatcaatgggtaatctttatgagaaatcaccttggttacgtcaaagatgtcccacttatagtgaaggcctgcttcgtacggcaaaatctgaacgtagagcgtccacgatgggttctccccttgagcaatggcgtcatataaatcatcttgtagatagtcagtgtctttaaccgtggcctcggctgcagcttcattcgtcatgtttttaacgccttgatctgaaatgaagtggtacttgacccagaaggcttcacccttttggttaacccatttaaaagtatgggagccataaccgttcatcgttcgataagatgctgggagcccccggtcacccattaaataagtaacctgatgcaacgattctggggaatgggcccaaaagtcccactgcatgtcctgagtacgtcggttagtttggggatcccgcttttgagaatggatgaaatcaggaaacttgagcggatcgtttacaaagaataccggagtattatttccaacaatatcataattaccttcctgagtataaaatttcaccgcaaatccgcgcacatcgcggaccgtgtctgggtagcccttttctccagctacttgggaaaagcgcacaatcaagggggtttgtttgccaattccgttgaaaaggtccgccttagtatacggactcatgtcattttctagcttgaaataccccttcgcaccagcacctttggcgtgcacaacccgttcaggaatccgttcccgatcgaaatgggccaacttctccagcaaattgtagtcttgcatcaataccggaccgcgacttccagcagtctgcgtatgttggttattggcccacggttgtccagcctccgttgttaatttttctgacatctctattcgacccttctctaaaaattttagtagatctactattcaataaaactaataacgttatttgccacgaattataacacccgtcctcctaataaagaagcaatatgccttccgttctcacctttgacccgcaatggatatgcattatcaaactgcttgtatacctagcgttacagtaatttattccgtaattgcttcaactcgtcgaaccgcatgttggttacgtaatggtttaaccattattaaaattaaacatcccacaattagtattccaataagtaccagaggtcgccataaatcagtccaactaaccggatgaattaaccaatttgtcgggttcaaaaggttggtgggcgaccatttcataaatcctttaagctggctaaacagactgctaattaaaacgccaacttcaattactcccgcagctaaaaatggtgcgccagaatatatggcaatcgtacttgccaaaataacactcgttacaatgcctaacgcttgtaacagtaaacttggccatactaagtcgaaacgaatggtgctgctaaagaaagcccaatccacataaactgtccaaccagcccccattaccgtgcctaaaaccacacaaattaatcctgccgccatttttggaaaataaattggcccagcctttttggcacgcgttaaataaaaaagttgttgtgcgggattttttcctaaagtacaagcatccgcaaccaaatatgccatgataaaaagtactacttgctccgtactttggaagtaagaagtcatcaaactatcccaagtcggagatggaagctgaatactggcaacactgccgccaccaaatttttctaccagttgaccactataatatgccgataatggtgctacaacccccattaatgcagcaatgagtaatattaaaaacatccgctgttttcgaatccactgtcgtaattctaatttcatttagctttctccttatcttttgcgtgaatccaccgcttaaaagcatggttaaggtcttgactacttcgattaatcattatcacatcatcagctaacctacttaattcgcctagccctttttcaaaatcttgtgctggaaactcaatttgatgtcgttgaatctcctttaccacaatttgacattgctgtaaggcagccactacccgatccttagcgttaaccgatttaactaatatttcaaccgaatcatccgttcctgcgataaaatctgtcaacgctcctgaaaaaatcatttctccacgattaagtacgagcaatcgttcggcaatttgctggatatcattaagtagatggctcgaaattaccaccgtcgtagtttgtgctatttcattaattagacccaacattgcctgtcgaccgaacgggtccagtgcactggtaggttcgtctaaaaatagcagttggggttttaagatgttggcagcggcgattcctaatcgttgcttcattcctcgagaaaatccacctactaaccggttttggtgttccgctaagccaacttgttgcaacgcagttaaaatttgtttctcatttatgcgttgattatccaagcgaagtgactgttgtaaaatttcacgagcagttaaatatttttcaaactcgggagtatctgggcaatatgccaattttgccgtctgatcgattaagatttgtccatgccctactggttcttgaccaaaaatagcgtggatgagggttgtttttcctgctccatttggcccaatcagacccaccactcccggtcggttagtaattttaccgttcaccttttttaaagctgcgaaatccttgaagcggaccgttaaatcatgaatttctactaaattacccattttaccaacttccttcccgtcgttctaatagataatatgcgatcccgcctaccggaattgctaacaatgtcaccactatccaaccccatttaggtaagtaatgcgttcgtgaaatccgacaaatatcattaattgtccaaaacagataaatcccaccaactaaaattagcggaacaataatctttaaataagccattattggttctccttttcctaaaactaattgcctacctcctttataaatggtgacgttgggtcgttagcaaacatttttactcaaaaaatactattcaactgttttttctccaaaaaagacgttaagtcgttcttaaaccaaaccagaaagtgcgccaaaaggcagctcgtctttgggtattaactaaaaagaccactatgcctgaatttggcataatggtcttttcggtttaaacggcgtgactagttattcatttttaactctacgtgtaagggaccagaaaatatcattaataagcgaagcactaattatttttgattcgtaatcaaattagatgcgtaaataaattactcttcgccatcacgcttccgttttctaccccatccgaagaatccaagcaaaattgtcagcaaactaagtaccccaacttcactcataatattagaatctgcttcgttagtttgtggtaaccgaccacgtttcacaagcgtcgtccgttccttagccgatatctggttatcctcattggttctcaccgcgctgactggttcacctggaaattgatcactcttattatatccattcgaagtgtctggagtagccgctgtcccgtcaacttctccgctgttatccgcaggaagcactggatcttccgagcgctggttttcattatgatcaccatttggaatttctggctgatttggcactgaatttccattatcaccgtttggaacttctgggttagctggaacctggttattattgtcatcatctggagtttccggatcgactggaacttggctatcgttgttattatcatccggagtttctggatgatctggtgtcggattatcatgatcatcgtctggtggtgtcacttgatgatcgtcgtcggttacgtgataaataacgttgacaacaaaatcatttccaacactattcgcatccatcgctggaacttctggctgatctggttcgtagccatcaaccactggcgaatccacttcagggaagtttccatccgctacccaaggatcataggttatcgttgtcgtaccgtcttgattgtagtgaacgtggcctttccgggtgtaatgaaccgtcgccgtctgatccggagccacttgcttaccatcttcatccacgtaatggatggtttcggtgacgtccctattcaaatcgtttacgtccactcccgctggatagtcggggctatctgggtcagatggatccactggcgtatccggtgatgccggatttgatggatctatatcataattagaatcgtggtaaataaccgtaatttcaaaatcagcactcacgctgtccccgtcaacttcggcaactgttgactcatcaggtaccatgccatcaactaccggcgaatccactgccggataatcaccatccgctttccacggatcgtaagttacttctgccgtgccatcttggttgaagtgcacgtgcgctttccgggtgtaatgcaccgtgaccgtcttatctggggcaacttgcttaccatctttatccacgtagtggatcgtttcggtgacgtccttgttcaagtcatccacaccgcttggataatctggactatctggatcatctggatcaaccggcgtatctggagataccggatccgatgggtcgacattaatatcggagccatggtaaatcaccgtgatttcaaaatcagcactcacgctgtccccgtcaacttctttaaccgttggcgtatctggcaccataccgtcaactactggtgaatctactgaaggataattgccatcggctacccacggatcgtaggttacttctgccgtaccatcctggttaaagtggacatgtgctttccgagtgtaatgcactgtgaccttctgatcgggtgctacttggttaccatccttatccacgtagtgaatcgtttccgtaagatctttattcaaatcatttacgtctacgccacttggataatctggactatctggatctgatggatcgactggtgtatccggtgcaatcggatgatctgggtcgacatccacgtcagatggatagtaagttactttcacttcaaagtcgtcattcttactattgccgtcgacttccgcaaccgttggcttatccggaaccatcccgtcaattaccggtgagtctatcgctggatagtttccgtcagctttccatgagtcataagttacttctgccgtaccatcttggctaaagtgcacgtgcgctttccgggtgtaatggatcgtaaccgtcttatcaggtgctacctgtttgccctctttatccacgtagtggatcgtttcggtgacgtctttatttaagtcgtccacatctacgccacttggataatctgggctatctggattagacggatcaaccggtgtatctggagatattggatgatccgggtcgacgtccacgtcagatggatagtaagttaccgttgcctcaaaatcacccttcacgctgtttccatcgacttctttaaccgttggtttatcgggaaccatcccatcgattaccggcgagtctaccgctggatagtttccgtcagcttcccatggatcataggttacttctgccgtaccatcttggttaaagtggacatggcctttccgcgtgtaatgcaccgtgattgtctgatcgggtgccacttgtttaccatccttgtctacgtaatggatggtttcagtgacgtctttattcaagttgtttacattcacgccagctggataatctggactatccggatttgctggatctaccggagtatctggcgcaattggatggtctggattgacatccacgtcagatggatagtaagttactgtttcttcaaaatcgtcagccttactattaccatcaacttccgcaaccgttggtttatcggggaacatatcgtcaattactggcgaatctaccgctgggtaattttcatcagctacccatggatcatatgatattttagccgacccatcttgattgaagtgaatatggcctttacgggtgtaatgtaccgtgacggttttatccgatgccacttgcttaccatccttatccacgtagtgaatcgtttcggtaacgtccttattcaaattatttgcgtccataccacttggatagtgtgggccatccggatttgctggatctaccggagtttttggtgcaattgggtggtctgggtcgacatccacgtcagatggatagtaagttactgtttcttcaaaatcgtcagccttactattaccatcaacttccgcaaccgttggtttatcggggaacataccgtcaattaccggcgaatctaccgctggataatcctcgtcagctttccatggatcgtagctaatcgttgccgtaccatcctgtttaaagtgaacatgacctttccgcgtgtaatgcaccgtaatcgtccgatctggagctacttgtttgccatccttgtctacgtaatggatagtctccgtaagatccttatttaaatcgttaacgtccatgccagcaggatattctggactatctggatttaccggatcaaccggtgtgcctggcacaattggatattctggatcaacatctacgtcacttggataataaaccaccgtcaaggtaatgtcttgattcggttcccctggtttagcaacggtttgtgcttcaatgtgcgcgtgatcagccacgtaaccatcaactatgggggtgtcgaatcccacaaatttattgctggtgtctggttgccattcacctcgtgaaattacagagttgttcacttcatcaattaccacttcacggtggtatgttaacgtcgcactggtatccgggtaaacagttttcccttgattgtctacgtaatgcaccgtttcattgaccgtccaagtagtttccttgttccattcgggatcatccggatcaaccgtccggtgtttatgtctcaaataaatcgtaaagtcattagcaccatctttagccgaccaagtaaaatgaaccgtttgcccatcaacgtacccattcggattattttccggatcgatttcataatgtgctggcacattgattacaaaattgccgtcttcgtcagtagaaccgtttaggctacccgtactaactttcttattatcttcatcatcccaataggtgaccgaacccgttaaagcattgggtgagtacgtcaccgtcacttcaattccgcccttttctctgagttcgtcgtcgatgattgttttatcaaccaccctaatatcgggtgtataaccggaaattttaggagaatatactgggtcaaaataagtattttcgccatcagcaattttccacggttcccaataaatttcaccagtatccggattttgatgtcctttccgactgtaatgccgagtctcggtatggtctggaagcatctggccgccatttttgtttacgtaatggatggtctgggtaacgtcttggtcttcattgattgttttaaatggcttaattacgtacgtatctgccatgcttggattataaagatccatcaattcgtgtgatgtatattgttgcttacctagaggattatcttctgttcccccggcgaccgcgacccaccggttaaaagtatatataaaagagggctcacttaaatgtgcaccggcaattttagttttcttgcctaaaaccagtactctcaagttagacatagcggtaagcattctatcgtatctagtaacattagacatatcaatatgtgaaagatctaatcttgaaactccacaagcttcaaacatataattcatgttagttacgttggacgtgttccaatgcgataaatccaagttttttaaatttgcgcaactatcaaacatactttctaaagtagtagcacttgatacatcccaatgggaaacgtcaagctccgtgagatcgttacaaaaatcaaacatccgtttcatgctagccatattagacgtattccatttagaaacatcaattttttttaaacgaatacatccttcaaacattgattccgctttgtttacattggccgtattccatccggaaacgtcgccaatgctttctaatgaactatcctttgagaacatatagctaaaattgttagcgttcgatacatcaaaattttcaattttgtatacattttttagcttagttaaaccgccaaataaatgaccaacttctttgttagccttaactttaccatcaaatgaaatgttagtgatgttgtccttatagtcaagccacatcgaccgattattggttgaatcaaattcgccctcaccaaaatgtagcataccatccgcatcgatataccaggcgcttgtaccaaaggttccgctagcgacgttgctgctaacatttttaggatcctttttcacatccctttttggcgattgtcgatcatcaccaggcgtcttggcttttgttactgacttagcttgcttttcacccttggttaaagtgttttctgaactggtcactttattattcgaactagagtccgtagtagctacatgctccgtcgaattggacttgttaaccgcgttatcggctatggtgggagtgtctgcctgcttttctgagctagctgatacttgtgaatttggaatggctttcgaatccgtttttgttcctgatgttgcatttgaattaaccgtttttgtatccgctttcgaatcgctgtctaaacttgtttgcacatcatcctcagtctgcttaaccggttttgtcgttacatcactattagtcacccgcgaaggttgggttcccgtttgattttcggttacttgacttttagtagttactgccttctccggaccttgtactgcatcacttggtcgagatttgactcccttggtaacggccggtgtcagagcggatgattgagccgttgtgtctgcagatacacttggtgccgtaacattcaaaccagccactaatcccacaatagctaatccgctaaaaacccagaatttgccatctttatacattttataatgttgcttgacttcgtacttcattagcttaatcctccaaaaaatttccgctgttacctaatctccgctctctagttgtagctatttttttataagtcagataagtacacgcatacttctaaccacgaatttatattttaaattgaaaatttaaaccccattacttattgagaaaatgtatttttaaggtggactctaaaaatacattatttattgtacatgccctaataattttaccatattttaagtaacgagtataaattaatttcacggtgaaaacaagctcagaagtactggttttagtgctttttatgtaaaagcatcgcgttctgcaaaaatatttttttcacgtaacagtacctatatccttaataatttcctcaaaaattgatgtttttttagagtctactttaaaaaaacactatttcggataaaaactattttggcctctttattcaagccctataccatcgcattacttagctgatcgatctttacttattgcattttgcttaccgtcttagcatctgatattttttaaacacaacaaagcgcctacggatttttctccgtaggcgctttgttttaacatttattaaagcaaattcaatactcttgtaagctaagtttatttattctaagttctttagtactccattaaactaagcatgtcgtaatcacgaatcttttcgcgtccatgcaagtctttaagttcaattaagaaggcagtgccgactactaccccgccaagctgttcaactagcttgatggttgcggcaatagttccgccggtggctagtaaatcatcggtaattaaaacccgttgccctggtttgatggcagatttttccaaatataacgacgactttccgtattcaagtccgtaggaagctttaaccgtttcagttggcaatttacccttcttccgtgcgggagcaaagcccacccccaaggcgtacgcgactgggcagccaacaataaaaccgcgtgcttcgggtcctaccaccatttcaacctttttttctttagcaaagtcaatgatttgattagtagcttctcggaaagcttctccgtttcccattaaaggtgaaatatcccgaaaaataactcccttttctggaaaatccggaatacttgcgatgtaatcatgtaaatccaatgccatttaagacactccctcattctcaacgtttagtaactgggttagcatggttgccaattgatcaccgttactataaagtagtttttcctgcgtttgaattaaatccaaacgcttttggtagattggagcttcagataattggtgagtttgaacttcgtcatttatcaaaagctttccttgttccattttaacaaaatttagttcaaagaatacttttaccataaaattaaccttttcttggtcaatttttaattgttttcctagctgtaacaatgccgctttagttaatggttgccgtttgaccgccgcaaaaactgtcgcaaattcagtacgacttggcatcccacttgcgtagtaatcagtttggtggaaaaagtaagttgtaatttgagttggttgccacttttgcaaagcctgtcgtagaacttttaaactaggcggacaatcaaccagtactacggcttgatgggcctgaattgccggggaatcgtaaagataaagctgacggcccaagttttgtttttcaattaaacttaatagtttgggattgaaaaagatgtactgttgctcatcacggaacagattcttagctaaattagtggttcgctgatcaaccacttgcaatccgttaattttcaaatcctcggtcattaattgtagtgttacattcccccgccactcgttaatgctcaacgttccggccaggtcaatggtgttggataaatgacttaatttatccgcgatctctccgcgttggaacgcaatggctgctaattgttggccagcttgatttgccgtgaattttaagtgagcttgattttgaccaattgccttcacatcggtaacccgtacgttggtaattgccaatttaggcaccggattatccattccaaacggacctaattgcttaattttgggtactaagtccgtggaaagctcgctaattgcaaccgtagcatctaaattcaactgcggccgttgccgaaaatcgagttgggcttgttccgcagccttttcaagttggtccgctaaaactggcaaattagcctctttaacggtgatcccaattgccatgtgatgaccgccaaaaccttcaaaatgctcacgcgccggattcaaggcttcaaaaaggtttaaattggccacgctacgcccggaacctttatatacgccatcctggttttgatcgcttaacacgatggttggtttgttagtcagttcgactaagcggctcgcaacaatccccagcactccctgatgccaatcgtggccgctaattactaaggtctgtaaatcgcgatggtcttcatctttagcaatttctgccgccacctcataaatctcgttaactaacccttggcgtttagtattggtggcgttaatgtccttagcaatcgcggtagcttgttcctcgtcaaaggtcgtcaataattccacggcttggctagcgtctcccaagcgaccaacggcattaattcggggtgccacggtaaagccgattgtttcttcatcaatctgactagtctcaacgcccgccaccgcgattaatttttgcaacccgattcgggaagtttctgggattagctgcaatcctagtttaactaagaggcgattctcgtcggtcatcgaaactaagtccgcaattgtaccgattgcgtataagtccaaaaactcttcgggcacttcttctaatagcgcacaagccaccttaaacgcaactcccacgccagataaatctccgaagggatattctccttctggatgtcggggatggacaattgcgtatgcgttaggcaattgatcgggcatttcgtggtgatcagttaccaccacgtccacaccgtgctcttgcgcgtaattaatggcttcgttgcccgcaaccccgttatcaaccgtcacaattagttgaacctgctcatcgttaataaaatgctggtactccgctaagtttggaccatatccatccttaaaacggttcggtacaaaataatttacgtccgcacctaactgagcaagggtttcatacatgatggtcgtactcgtcaccccgtcagcatcgtagtctccatagaccaaaatcttttcgttggcttcaattgcggacatgatccgttcgacagctttttgcatgtcgtgcagtaaaaacgggtcgtgtaccacactttgatccattgccacaaaattggtcatttcgtcggcagtccggaaaccccgggcaactaggattcttacaatgattggatccagctgggttgctttagctaactccgcaatatccacatccggcagtgaaggtacctgccaattaaatcgactatctttcattaagtaacatactccagttatttccggttaatgattggactgttaaccagtccgtcacctaaacgcggaaagatttgataaaatactgctcctaaagccattaccttaggaacgtttacttcgcgcagattttgttcaattgctctacgagttagccacgcaacccggtcagaactaatgacgaagttttgcacgcctttaagatacttaccgcttggatcagcaatgttaaaaaagttcgtatccattggacccggattaatcgtgtgcacccgcacgttccgccgttttaattccaagcgtaacgcgttcgaaaagcccactagtccaaacttcgccgcagcataagtggtggtcttagcggtagcaacttttccagcaatcgaggcaacgttaacgatgtctgccgcctcaccgacgtggtcaaccatcagcggtagcaacgcccgcgttagcttaatggttcccgctaaatcagtgctcaacgttcggtcaatttcggaaaaatcttgattcaacaacgttttaaaataacctaatccagcattattaaccaacaggtccacagagcctaaatggctacgaatccaacgccccgttgcttcgatttgcgcttcttgggttaaatcacaagataacgtaaatacttgccgggcgccacatttgaaacagtcctgcgcggtttgcttcaacctatctgaatttcgccctaaaaggaccaagttatcgtaataagggcagttcaaaatcgcaatttgccggcccaaaccacttccagcacccgtaattaccgcagttttcatcaaagatcatcctcctttatttttcctaacttcctaccaaataggccacctcaggcctttacggaagtggaacgtcaatttcatcaaaatcttgaaccactttagtattggcaaaaattgtacaagcatctttttctagctgtttagcgagtttaccagtgtaacgagctgaaatgtgcgttaacaatagtttttttacctgacacttttgagcaattcgggcggcttgcatattggtcgaatggtaatatttccttgccaaactaccctcctgcttgccaaacgtactttcgtgcaccaaaacgtcggcgtgataagctaatttttcaatattggccgtctgacgcgtatcaccaagaatggtgactacccgaccaggttgcggcttgccgatgaaatctttgccatcaattacttttccgtccggtaaagtaacctgtttaccctgcttaatttccccgtaaatcggtccagcaggaattgccatttcctttagcttatccaccaatagttctccgggatggtccttttcgcgaacccggaatccgtagcttttaatccggtgatctagttcagcaacttctacaacgtagttcgcatcttcaaagagcttgccacccttcgtaatttcgacaaaccggatgcgataagccagtttagtttccgaaatccgtagcgccgtcatcacaaaatccttaatccccgctggcccataaatggttaattcagaatcgccaccttgatttgagcgactactcaaaaaaccaggcaatccaaaaatatggtctccatgcaaatggctaataaaaattttgtcaatctttcgcggacggatattagtttttaaaatttggtgttgggttgcttccccacagtcaaatagccaaacttcgttactttcatctaataatttcaatgccacactcgtgacgtttctaaaacgaccggggcttcccgctcccgttcctaaaaattcaagttgcatactttcacctatacactgccttaacatccattttttacttaatttaattgtatcactagcatccgtttttcttttaagctattcttattttagcagaaccgcttaaagaatattgaggagggtttcactaatgaatttaagtaactttatcaaatccaccgtggaacttcattccaacctgattctcaagggcgaacaacaaaaggttgtttccataatcaccaagctaaccctcaccaatgacggtcaaaccattttactgcacgtggctaaccgaccgtcaagtcattccggcttaaccttaggccaattacgcgcccaaacccggttggctcagtctcaagccaagctttggctggtaaatcccacaagcggactaaccagtcccctctttggctattacctgcgtaaacaatttttaattctcaagtgaaaaatcagtgattaaccccgcacaaatgttttgttaatttgtgatggtattcaatcactgatttttgctattctacaaattcaaatacaaagtctaaaatctgtacgctgtccccatttcgagcacctaagcgccgtagttcatcatcgattcccatccctcgcatttgccgtgcaaagcgcaacaaactttcgtcgtgggtggtatccgtcatcttaaagagcttttcaattttagctcccttaattacccagacaccgtcttcgttgtcgatttcaaagtccttgtccgcgttaaattcgtaagtcttatcggtcgaatcggctgaattatccttaactaccgttggctgaggcgtcgattctaagacatcggctgtccgagaaatcagcttgctaaggccttcatgcgtaatcgaagaaattgggaagatctcaaaatcacagtaacgttcatcggcccgaacctttttctcgaattcgactaattgctcgtccgcactcggtaaatccatcttggttggcacaataatttgccgccgcttaattagatcggggttgtatttttctagctccgcgttaatctgttcaaaattagtaaacggatctgcttcggtaagcccactcatatctaccaggtgaagcaacacccgagttcgctctacgtgtcgtaggaattcaaacccgagccccacgccctgagaagctccttcaattagtcctggaatatcagcaataacaaagtcacgtccgtcatctaactgaaccatccctaagttaggtactaaggtagtaaagtggtattcagcgatcttaggttttgcactagtaactactgataacagcgttgatttgcccactgatgggaagccaagcagtccaacgtctgccaaaactttcaattctaactgcaattccagttcttcgcccggttcaccattttcggcaatttctggtgccggattccgtgggttagcaaaatgcatattaccccggccaccccggccacctttggcaactactagttcttgaccattttctgttaaatccccgattactcggccagtagttaaatcccgaacgattgtcccacccggaaccataattactaaatcttcagcactccgtccggtcatttgcttattcatcccgtttttcccggattcggccttaaacttgtggcggtaacggaaatccattaaggtgcgcaaacccggatcaacctttaagattacgtctccgccgcgacccccatcgccaccggcaggtccaccattaggaacgtacttttcacgccgaaaggcaacgattccgtttcccccgttaccggccttaatatttattttaacttgatctacaaacatgtttttctcctaatcttttttaactgcgttaaccgttagtcaccgcttcaccgcacttagcgaaattttaatcgttttagcaaccttcgcagagattcccaatgcttcgatttcttcaattttagcgtcccgaatcttattcagtgacccaaattcccgtaaaagcttgttacgtgtttttggtccaaccccgttaatcgaatctagttgcgatgataacgagtttttggcgtgcatttgccggtggaaagtaatcgcaaaccggtgcacttcgtcttgaatccgttggactaggtaaaatccctgactcttaggatcaagctgtacccgctggtcttgatcaccaaagattaaatctgcggttttatgcttatcattctttaccattccagcaaccggaatgtgcaaactaagctcattcaccaacacatcgcgcgcggcatttaactgtacatctccgccatccattaaaatcaaatcaggcagcgattggtgttcctttaatagtctaacataccgacgccgaattacctcccgggtactggcagcttcatccgcgtgatcaacagtattcagcttaaacttgcgatacatcttcttgtcgggtttgccgtcggtaaagaccaccatcgccgaaactaaatcggctccttgaatatgtgaatggtcaaaagcctcgatccggtgaccctcggggattcccagggcatcggtaatttccttcatggctcccacggttttgctttcgtcaagctctaacaaacggaacttttcttctaacgtaatttgggcattctcgcgagccaaattcattaagtcccgcttttcccctcgtttaggcgtgcggaccggcactcctaaaatttcgctaataatttgattgtccaatccttctggtaccaaaatttcattaggcaacactttatttttattattgtaaaattgcaaaatgaacgaagaaaattcgtcagccgcatccgaagcaattggaaacaaccgtttctcgcgcttcatcaaccgggattgacggatgaagaaaatctgaatggataaccatcccttatccaaataaaagttgaacaggtcccggggggtgcggtcgttagaaatgatccgctgcttttcaacggtaacttcaatgtagtgaatctgatccctaatttcagctgcccgttcgaattccattgcctcagaagcttgctgcatttttgcctgcaacgactttttaactttagcaacgttccctcgcaaaaaggacttaattttagcaatctgttggtcatattcttctttaggaacctctttaaagcaggcccccaggcattgccccatgtggtaatacagacagggccgtccttgatatccattacaacgccgtaagggataaaccttttctaaaaaatgaagcgtttcttcagctgcgtaaacattcgggtacggtccaaagtagtatcccccatcacgccggacgttagaaacaatttgcatccgcggatccttttcatttgtaattttaatgtaaggatatccggttccctttttcaacttgatattgtaatagggctggtacttcttgattaacgtaatttctagtaaaaatgcttccttatcactggcggtgacgatgtagtcgaaatcagcaatttcacttactaatttagccgttttaccttcatgactgcttttaaagtacgagcgcacccggttttttagattcttcgccttaccgacgtaaataatttgactattcaaatttttcatctggtaacagccgggtttgtccggtaacaaagccaatttatgctcaatatgctctgacgccaaatcactgcctcctagtttacataattactcgtaactcataacattatactctgatttaaccataattatcaatcaaaaggaaccattcccattacatagtaaaacccccgccgttaattgcaaaaatcactttgggggttttaaaattagtcgggccaattagtttattgcaagttaattttcgagagaaaatcctgggcccggctagtttgtggctgagcaaaaaagctatcgggagttcccttttcttgaatattagctgcatccataaaccaaatctggtccgagaccgatttagcaaattgcatttcgtgagtaaccactaccattgtcataccggattgggctaaatcccgcataactgttaaaacttcgccaaccatttccggatctagcgccgaagtgggctcatcgaataacattacagccggttccatcgctaacgcgcgagcgatggcaacccgttgcttttgtccgcctgacagatttcccgggtacgcatccgctttatctgccaagcccaccttttctagcagtttttgagcctggccccgggcttcttcttcaggaatttcctttacccgtcgtggtgctaatgtaatgttttccaacaccgtaaggttaggaaataaattaaagttttgaaaaaccatgcccaccttttgccgcacttcttcaatttcacgtaagcttttttctactaggttctgtccttcaaaaaccaccgcgcccgcagtcggcctttctaacaaggttaaacaacgcaagaaagtgcttttcccggctcccgaagggccaatcacactaatcacctcaccttccttcacctccgccgaaacgtcttttaaaatcacgttctgcgcaaacgatttagttaagttttcaatcttaaaaatagttttcgtcattagttaaacttcccttcgtaaaattttaataaccgcgatagcgagaaagttaaaacgaagtaaaggaccatcgctactaaaattggtgcaacgccccgataagtatctgattggacaatttttagctggtaaatcaagtccgtcaccccaataatggaaacaatcgaactttccttgattagggaaataaattcattgccaagcgctggccaaatattttttaaggcctgtggtaaaactacgaaacgcaaccggtcttgataatttagtcctaaactttgggcagcttcgacctgtccttcatcaaccgaattaattcctccccgaatcacttcggcaacgtaagccgcactatttaaggaaactgcgatcatcccagcagtcagcgccggtaaattcactacaattcccagaccaaagtaaaccaacatcagttgcaccattagcggagttccccgaacaaattctacataagccaacgcaattgcccgcaggctcgtgtgtcgacttaagcgcattaaggctagcagcgctccgattattgaaccaaaacaaacgcccactaacgaaattaagatcgtgtatcctactccaagtgcaaagtacttccaataatggatcatggaggtgtctacagtattgccttttaaataagttcccgctgtttttaagtattctggtaaccgtttttgcttttttatccgcgcaatggtctggttaattttagcttttaaaactggagagtccttaggtaaggctaccgctgtgctagtttcgtcatcattcaatttaaaatgggcgttgagaatctttaatccccggttatttgcggcgtaggcctccgcggtgggcttttccattacgattccatcgaccttattagtttgcaaggccaaaatcaaatcagttcccttctcaattccccttaccgaagcccccttaatttgctttttggcgaggttatattggattgaccccgtttgggcagccaccttccgttgatgaaacgagtttttatccttaaataaatgaccgtccttttgattgataataatactttgaccgccttgataataaacgttagaaaaatcaaccgatttccgtcgagctgcactaggattcattcctgaaagaaccatatcaaccttgccagtttgtaatcctactagtaaggaatcaaaatccatgtttttaatttttagttttactcctagatcatgggcaatatctttagcaacgctgatatccattcccacgtccttactttttccattactagaagtttgaaactcataaggcgcgtaatctgggctcgttcccaaaacgatatatccccgctctctaattcgttgataagtggggtctttcgtcgtagcgtgcaccgtgtccgctatggcaactcccgtactaatcaaacataatgaaaatataatgaataaccaattaaaaaatgtcttctcttttctcatcgcaatctccttattcatgtaatatttattaatatacactatgaatactcatttcggaagaccgtttgcgttattttgaattattattcataataatctgaatattagttatggaaatgtatatttctgacaattactaatatttttggtatgatatgcgcaagggagtgattatcaaatgggattaaccgtaaaaagaacgaccgatttagaaaaaatgctggggcaatttactaatccagcaaccaccgctgaggaaaaaaagaagaaagataaatttttagctaaagataaagacaaaaaaggacaaaaaaaataaccatcgttaccaacttgcttcatttcacgaggccattggtaacgatggttttttattttttatttaaagctgtgcgggtaccgttttgctaagtctttaatgtttttttgggcaacctcttcaaagggaatgtctgcccactgtgcgacttgggataaataccaaagtacgtcgcccatttccttggttaactgttccttatctaaatcagcgccccggaaagtatagtttttaactaaattaactacctggccgctttcacccgctagccccaaagcacaattcgttaatacttgttcattgcctaaaagggttttattagctttcttttgatactcgttaaattccatttctaatcacccatcctatcttcaatccattgccaaattgcgtccttgccaaacttagtttgcgcagaaaacatttgaaacgcgtcttgctgatcaaaattaaggactttttttatccggctttcatgctggttccattttccgcgggcaattttatcactcttagtagcaaccactaataccggaatatcatagtagcgtaagtattgatacatggaaatatcatcatcagttggatcatgccgagcatccaccagtgaaattactcccttaagttccttgcgagaagtcaaatatttttcaatcatccgaccccatttttcccgttccttttgggatacttttgcatatccgtatccgggtacgtcaacaaaaaagagttgatcttcgacccggtagaaatttagtgtctgtgtctttcctggttgtgaagacgtccgcgcgtacgacttccggttgatcaacgtgttggtcaacgaagattttcccacgttagaacgccctaccaaggcaatttcggggtagccttgttcgggatactgttcaggctttacagcactaatttgtaactctacattatggacttccattaaattcccaccttccaattccgcctttaatcataacacggattcaaaaaaaagaaccaggcttaagtaattcacctagttccaatttttgaaattacgatgcttgttcgttggttagttccacttctggttctacgccgtcaaccaccgttttcttgttaaccgtaactttagcaacgttatctcgggacggaatttcaaacatgatgtcccgcatcacgttttcaataatcgaccgcagtccccgcgcccccgtatttcggttgattgcttgttcagcaatcgcgtgcaaggcttgtggggtaaacttcaattcaaccccatcaagggcaagcaaggctttatattgcttaactaaggcgttcttaggctcggttaaaatccggactaagtcttcttcagttaatttttctaaagcagttaaaattggtaaacgaccgataaattcgggaatcaaaccaaattttaacaagtcttcagggattacttgttgcatcaagctcttactttcatctaacgaagtgcttgcattcgttccaaacccaatcgtcttatcgcctaagcgattctttacgattgtttcaattccgtcaaacgcacccccgacaatgaataagatgttggtagtgttaatttgaatgaattcttgttgcggatgtttccgtccaccttgaggaggaacgttagcaatcgtgccttccaaaatctttagtaaagcttgttggacaccttcacccgaaacatcccgggtaattgaaacattttcgctcttcttagcgattttatcaatttcatcgatgtagataatcccgtgttcggctgcttcaacgtcataatcggcattttgcaaaagcttgagcaagatgttctcaacatcttctcccacgtaccctgcttcagttaaagtagtcgcatccgcgattgcaaacggcacgttcaagattttagccaaactttgagccaagaaagttttaccggaaccagttggtccaattaaactgatattacttttttgtaattcaggaccatcatccttagcatccgcctgggccattttgttaatccgtttgtagtggttatataccgctacggataacgtctttttagcctcttcttgaccaattacgtattggtcgaggtaatcaacaatttccgcaggagtcgggatgttagtgatttcagtgggtttcttttccgaagcaagttcttcgtcaatgatttctttacataggtcaacacattcattacagatatatacatctggaccagcaataatcttttttacttgatcttgcgttttaccacaaaaagagcaagcaatttggtcagatgtctgttgatcatcatacaatcctgtcacctctcaaatatttatacaaccatcatagcagaatccctaaggatacgccaatttaaacgttttgctagctgatggcgcatttatcctaaataagtagaaagaggctggaaaattaccttttccaacctctctagtaccaccgttaactctttaaattaccggtggacaattcgtagccaacttggttacttcctactttaaaaaattcaattatttcttagcactcttcttagcttttgacttaggttcttcaattgcagaatccttaatcaagtcaacagcttgcttaattgctacatcatgtttaaccatgtcagcagtcaatgcagagcgaactgctttttcttccatgttgtattgttcagctaagctcttgtattcagcatccaattcgtcgtcagaaggatcgatcttttcagcttcaacgattgcttcaagaactaaggttgtcttaacccggttttcagcaccttcactaagttgttggcgaagttggtcttctgatgaaccagttaattggaagtacatgtctgggctaataccttgttgttgcatgtttgcaagatattggttaacttggcggtcaacgtcttcacgaagcattgcttcaggaatttctttgatttcagcattgtcaacggctgcttggattgcttcgctttccttagcttcgtcagctgcttgaatcttacgttccttgatttggtccttagttttagccttcaattcttcaagtgaatctacgtcttcatcaacgtccttagcgaattcgtcgtcaagttcgggaagttccttagtcttgatttcgtgaatcttaaccttgaatagcgcttccttaccttgaagttcttcggcttggtaatcttctgggaaggttaccttaacgtcaacgtcgtcatccgtgttgtggccaattaattgatcttcaaaacctgggataaaggagtttgaaccaagttctaagtcgtagttagtggccttaccgccatcaaaaggtacgccgtcaattgaaccatcaaagtcgatagtcactgtgtcgcccttttcagctggtttgccttcttttaagactaattcagcttgttgttcacgtttcttttcaatttcttcgtcaacttcttttgaagttacgcgagtgctttgcttgattaccttaacacccttgtattcgccaagcttaacttctggcttaacggtaacaatcgcgctcaatacccaaggttcgcccttttcaagcttttcaacgtcaacttgtggttggtcaactggttcaataccagcttccttaattgctgctgaataagcatctggtaatacgatgtttaaagcatcttggtataaagcttcttcaccataaagtttgttaaaaatttggcgtggtacatgtcccttacggaatcctggaacatttaaactcttcttagtacgttgaaatgctttgtcaacgccttctttaatcatatcagtaccaacttcgaaagttaatttaccttcgttagtacctgttttttcccactttgcagtcattgtgttccctccgacaaatgatttatttcattacaattctggattgcatacgcttataatcttaacgtatataattcaaaaagtaaatatgaatataacaaaaaaaacccgcaagtagcgggtttttcgcgggactaatgtaaatattagtcgtcgatttctgatacaacaccggcaccaacagtgtgtccaccttcacgaacagtgaacttagtacctttttcaatagcaactggttcgataagttctacagtaaatgtaacgttatcaccaggcataaccatttcaacgttgtcaggtaattcgataacacctgttacgtcagttgtatggaagtagaattgtgggcggtagtttgagaagaatggagtatgacgtccaccttcttcttttgatagaacataaacttcacccttgaacttcttgtgagtttggattgagccaggagcagccaatacttgaccacgaacaacttcgtcacggttgataccacgtagaagtgcaccaacgttatcgccggcttcaccaacgtcaagagtcttacggaacatttcaagaccagtaattgtagtcttcttaacgtcatccttaagaccgatgatttctacttcgtcaccaactttaacttcaccacggtcgatacgacctgaagcaactgtaccacgaccagtgatcgtaaatacgtcttcaacaggcatcaagaatggcttgtcagttgaacgttctggtgttggaatgtattcatcaattgtgtccataagttccatgataactttttcttgttctgggtcgccttcaagagccttcaaagctgaaccgcggagaacaggaacatcgtcaccagggaaatcatattcagatagaagttcacgaacttccatttcaacaaggtcaaccaattcgtcgtcatcaacaaggtcagtcttgttcaagaatacaacgatgtagtcaacaccaacttggtgagcaagaagaatgtgttcacgagtttgtggcataggaccatcagttgcagcaacaaccaagatagcaccatccatttgagcagcaccagtgatcatgttcttaacgtagtcagcatgtcctggggcgtcaatatgagcgtagtgacgcttttctgtttcgtattcaacgtgagctgtgttgattgtaatcccacgttccttttcttcaggagcagcatcaatatcagcgtaatctgaagcttgagctaatcccttttctgacaacacttttgtaatagcagctgtcaaagtagtcttcccatggtcaacgtggccaattgtaccaatatttacatggggttttgttctttcgtaatgttcttttgccattaatacgaacctcctgtatgtcgtaagaatcactcagcattcaaatgaataactggatcctttaaaaaatattatactacatcctccacgaaaggcaaagcaccctcagagaatcctctagtattgtataataatcgcctttattttgtaaactaaaatattataattatttggcttttttattaactagccataatactgttcatgattttgtttaagtcgcgaaattgtttcacctcttttccagccagaaactgggcttgcaatgctgccagccatcccgcagccgtggcaaaaacccgctctggaaagggaaatgctaaatcgtacattaaccccgcttgctgaatcaataactctgcctgaaccggatctgcactttgttcaattaatcgcataagttctttacgtaaacgaccgacatcaatttgggctgggaccacccgatagcttttttcgtcaagccaaataaaatctaattcgcgttcaacccgtaaatcaaccaggtcttttagaattgaaacgcgggtaagttggtttaagtacgggtcgactaagttaaaacttgctgcccgaatatagtttttttgtggcaagtggtatgcttgcttaattgcttttatctgatccgctagttgacgatcaccgagatgataaaaatggcgttcatcggcccgcacgctttccggaaaatcttcctgatagcggacttcggcttcttcgaggcgcgtcaccatcgccggtgttttcatctgctgatcggctgacgctaaagttttccacgccacaatgaaattattagtagcaattaacgcccctaaataatccgcaaaaactcccggatgatgcaaaaaattggtcgactgatttgcgaccaattgtaatgcttcagaatattgttgattagcaacgtaaaaatggtttaataattccgcaacctgggtggtaggcgtcttttcgtcaagttcttccaaaatttggattgcttgggcttgtttaccatcatcccagagttctttagcctgggtgagttgttcatcaatttccttcattattttttcttactaacctttttagcttttttatggtgctgattaacttccataatcactggcaaaattaccggacgccgcttagtttggtcgtaaaggtacttacctaatttgtcgcggacatcttgtttcaaatgcccccaatcaaattctttgttatctaagttagcttgcacggttttcttaaccagtttagaactttcttcaattagatcgccgcttgctttaacatacacaaacccttttgaagtgatcttaggttccttaataataattttcttcttccgatcaatggtaactaccgcaacaaacactccatcttcggaaaggatttttcggtcccttagcacaatgttaccaatgtcaccgaccccgattccatcgatcattgtattgccaacttcaatacccttaccatggaacatttcaccatcctggtactctaaaacgtcacctttattgacgatgaaaatttgttctggtttcattccaacctgttcagctagttcttggtgagccgccaacaaacggtactcaccctgaattggaatcaaaatctggggcttaattaaattcagcatcaactgtaaatcgttacgacttgcgtgcccgtttgcattagcgcggtcagaaatcgacttaacttcggctccagcccggtagagcatatccttagtcttcgcaaaggttgtttccattgcgtgggaagggttggtagcaattaaaactaaatcaccctgctcaattcgtaattttcctcgacgacgagaagccattttttgtaaggctttgattggctcgcctaacttacccgtttctaaaacgatggtttcttctggagcaagcttatcaagtttatttaacggaacgattaggtcatcgtctggaatattaatcttattcaatttaatcgccgtattaacgattttttctaaatcgtgacccgtcaaaacaactttgcgtcccgactgaacagccgcgtcgattacttgctgaattcgtaaaatattcgatgctacggaagcgaccactacccggccttcgtgatacttgatgatttcagcgatgcttgctgcaatttcggtttcgttagaaggccgttcaaagttttctgcgttagctgaatcactcaataacgcaattaccttcttagtaccaatttgggctaaccgtccaaaatcagtcgcgtatccatctgtagcggtttgatcaaacttgaaatctccggtgtatacgattcgtccttcatcacaatccaagacgattcctaatgaatctggaatggtatgcgtagttttgaaaaacgagaccgtcacgtccccaaaatcaatttccttcttctcgtccaccacgtggaagtttttaaatttgcgtaagtcggggtcatcattgaccgtaatttttgccaacgcaattgtcatttccgaaccgaataccggcacctcaatttccttcaaaaagtaaggtaatgctccaatggcatccgcatggccgtgggtcaagaacaccccgacaattcggtctttattttcaactaaatacgagaaatctggaattactatgtcaattcccaataactcgttttctgggtacttaagcccacaatccaaaatataaatatcattatggatttcaactgcatacatattttttccgttttcgcgaacgccgccaaacggaatgatttttataacatcactcattttttcacctacattaaatattctttagtttccgcacaatttatatactgctttaattttagcatagattaattgtcaaaaacaaaaagcacgcaggaagactttggcgttcactttatctatacggcaaaatttatctaacaaatttctctaaattgactacggccagtgcttggtctgccgttaacacattagtaaaacaccccccatttttaatgccgctcatttagcaattaggaggttttttatttaaaaatttacttttcgcttccaaataaaaagcagtctcgcgctctggagactgctccaatttaactaactattttaggatttcaataatttattaaccagctgattaagtcaacttaattattaagcagaactccctcgtatttttctaaggcaaacaaaaaagccccgcatcgagatgcagagggctttatctgaccaatcttaacgacgaaggccaagactcttgattaattcacggtaacgttgtacgtctgtcttacgtaggtaagcaagtaagttacgacgatgaccgatcttcttcatcaatccacgttgtgaatggaagtctttccggtgaacacggatgtgttcgttgatttcgttaatgtctgctgtcaaaactgcgatttgtacttctgcagaacctgtatcgccttcgtgacgagcgtattttgcaataatttcgttcttctttgcttgtgaaattgccattttatccacctcattctttaaattgcccaagactgagtaaatcgtcggcagatcgatagactaagtaatgggtttgcttttataagcacatcctagtttaccgaaactcaaaacttttttcaagtttattcgagcattgcattaataacgtactttctgtataatactactgttgtattaagcatactctggaggtgaataatatgccagttatcaaatctgcaatgaaacgtgttcgtacaaacgaaaaagctgctgctcgcaaccgttcgcaattgagcgcaatgcgtaccagcatcaaagcatttgaaattgctgctaagaacaacgctgaaaacgctaatgaacttttaaacacagcttacagccgtattgaccgtgctaaaacaaagggtcttatcaaggctaacaacgctggacgtaagaagtctcgcttagcaaaaatgcttgctaaataaaaaagcaccggtgatccggtgtttttttattgccatccatttttaaatttaactagaaacaactcaaagagttcctgcgggggtctttgggttgtttttaattgctcttctaaatcaagcaatccgagaaaagcacgtttgaggctagccatatcaaattggcgcaccgcctgcatagctaatttaattcggtacggatgggcctttaattcttgagcaagtttaccttgagaaaatccccgttccgttaaaattttaacctgtaagagtaaccgaaattgactaactaaggcggcgttaattcgcaatggttgctcttggttaagcaacaagacggaatagtccgcaatcgactgtcgcacatcccccttcatcaacaccttaatcaaatcaaaaacattttgggtcagacttttgggaacgagtttttgtaccgcctctaggtcaatatgcttcgaatccgctgcgtaaacggtcaatttttccaattcattaatcacttgcgctaaattatttcccgttcgtaaaatcaattcttcgactgccgggctggcaatttgaatttgacgctcgttaacaaactgttgaattaactgccgagtatcagcctctttgggcgggttagcgtcaataacggtggcctgctttttcaaatctttgacgattttttttcggccatccaatttctcatatttagcagcaaacactaaaatagtcgtgggttcgggttgcttcaagtaattaattaagccgtccaaattaaacttaactttagttttttcaccagttagaaaaaccggattattagcaatcaccagccgatagtccccaaaaaatggcgaggattgcgcatcgtctaataacaagcctaaatcggtattttctaagtcgtacgttccaacattcatcacttgctggtcttctgggattaacgcggttagtatttttttggctgcgttttgaatgtagttatccggcccttcaaccaaatagattggctgaaggttacctttagcaacatccttttttaaatcagtaagtttcattgaacaatgcttccttttttatcaattcctaccttccatcttcccataccattgaaaaaatatctataagaaatcatcccgtaatcttgggtagaaacgaccggaattcgtaatcgttgcaggcgctcaatcacttccgcatttggatggccgtaccggttatttcgtcccgccgaaacgaccgctaatttaggggaaattgcggataacaattcaggcgaattagcagtcttgctgccatggtgtcccaatttaaaaatgtccaccttaccaaccaattctggattttgtagtagtttctgttcaccactaatgtctaaatcaccagacaataaaattctttttccgccaaatttaccttccagcactaaagaatcttcgtttgcgcccttccccggccgttccggatataaaatttgcagcggtagtcgggaaacttgagcaccttttaaaacctcaacgatccgggtttggtggagatagggcaaaatttggtaacggaagttatccgttttttctaccccggcgggaaagagcagctgttggacctttaaattttgcaaaaccgcctttgcttctccaatgtggtcaacgtcttggtgggtcaaacaaagtgtatcaatcttactaatgccgatgctttgtaaataattaattgaactattcttagcaattgtagaagtctgcttttgccgggagccaaaccgtaacttaccacccgtgtccaccatggtcaccgatcggttaaaaggctcccgaattaaaatactgtctccttgaccgacgtcaaagaacgtaacctctccaaaaggcagtaaacgaaaataaactcccgtcgctatccaagttaaccaataaactttaaaaagtcgtttcttcaaggtctgtgcatccgtggatacaattttaagtgcaatcactaaaagaaacatcaccaaccagcgactaggctttccgattagtaaaagtcctggaagctgatctaaccgttgcaatccccattctatcccgataatcacctgattaatcacgctggcagtgagtgggaaacaaaaagctattaaaacagccgggatcactaagcttgaaaaaagtggtacacatagtaaattaaaaaggaccgtcaaaaggtgaattttgtacatcgaaaagaggataatcggtatttctatcaaaaatagtttaaatgaaatttttaaactgctagtggtactttgactaatcaaaactagggatagcaagtaacttagctgaccacccatttgaagcagcacgaatggattcagccatagattaatcaataaaactatgcaccaggcctctacgccacccccaaaatccaatcgtagtcgttgtgccaccagcttaattaaaattagtgtgactgcccgaaaaaggcttgtacttcctcctccaagcacgaaataaatcggtaaaactaccatttgtatggtaaacaaagtttcccgatcaattcgcaaccagattcctattttttcaatcaacttgatgaagtaaaaaacgtgtaatcccgaaatacaaaataagtgaataatccctaaattacgcagtttttcactattttcttttagaaaatcggtctgctcgcccaaaatgattcccgcgcaataactacgcaacggttctgcaaactgctgacagcggtctaataacttcttccgccagtgatgcatccatgcttggtaactctttaaggggagttgtcgaacattgatcagctgcgtcttgtttaagttatagtaaacctttttaccgtacataatgcggcgaaaatcaaattggttcacgttggttggttgcgctaacggtcccagatttcccgcaacttctagttgtaaatcttgcgaattattttggaagctttgctgtaatttgggagactccagtgggataaaagcctgaactccttggtgatcaaaactattattaaacgctcggatactgatcccatcttctcgaattttgacctcatcagggtgcacgtttaagattatccgcacattttcataacttttctgatgttgcccgataaaatgactcacgtgactaaaatgccacccaaaaagcaatcccaacgtcacaacttgtaccactgggaaaagctgccgcaaccaacaaacccggccaaaccaaacaaatagcaatactaaaaaaactattgaacgagtaaaaacgtatcccgccagcaaaaagatcgtcaccgttgcccaaattaaagaactactactttccatcctttaataaagttttgatatcgattttagctaaatcttcgtccgtaaatttaatttgcttaacggcaacgtttttacgtttcaaaagtgctactgcataagggtcgttattatagtttcgtaaataattaattttcacgatgcccgtttgtaaaagcattttggtacattgcagacacggaaagtcggtaacgtaaatctccgctccgtcagttgccacgccaaatttagagcattgcaacaccgcgttcatttcagcatgaattgtccgcacacaatggccatcaactaagtaacatccttcgtctaagcaatgcacgtcgccgctaaccgatccgttgtatcctccagcaattacgcgccgatcgcggacaataattgctccgacagaaagccgtttgcacgtgctccgtagcgataataatagtgcctgtgtcatgaaatattggtcccaatcaattcttttatccattttaaccatcctttttaaaccgtaattgaatcttttaaacctgcaaaaattttatcaccaattccttgaacctgctttaaatcatcaatggttttaaagccaccctgttcttcccgatagctaataatctgatccgcctttttatctccaatcccgtttaacgttaacaaagcatttttatcagccgtattgatgtttactaactcaccagccgatgaagaacttgccaggctttcatttccagcattgccagcggttcccattaactgcttaggatcaaagtccttaatttctcctttaatgggtatgtacactacctgttggtcacttaattgtaaagccatattaatgtttttgcggtccgcagattcagtcaatccgccagccagttcaattccgtcgacgacccgcatccccggttttacttcataaactcccggttttttaaccgcaccctttacgtccaccattagcttctgcttaccagctgatttttgaacactatcagtcgaagggttgctagttacagagctagattgagcttccgaacccgccatcatcacttctgagttttcttgtggggactgcacattattcttcggccgtagcaaactaacaactaacaaaatagccgccatcaagatgcttcctattataattggtttttggtatttttcccaaatttcttcccacattttcacccctcctcaactatatatacaaaaaaagaccggaatttcttccagtctttagtttatttattttttagtcgacttttaagctgtaactccactgcttccggtactaacccgtggatgctaccacccattttcaccacttctttaattaaacttgaagaggtaaagttccatttaggatcagctggcaaaaagacggtttcaacttgttcagctaaaaattggttcatttgtgcgacttgtgtctcaaaatcaaggtcggcggtgttccggacgccacgtaccaaaacgtccgcatttaattctttaaaagtatccaccgtcaaccctctagacgtggtaaagctcacgttctccaagtcctgcatcgccatcgtcaacaagttaacccgctcttgaggagaaaataacggctgcttattagtattaatagcgaccactaccaccagctcgtcaaagattcgcgcagcacggcgaatcaaatccacgtgtccgttagtaaccgggtcaaaacttcccgcataaagtgccttcgtcattatgttttgcttccttacttaaaatattttatctagctacccgccttgtagataacaatcttagtaataccgtaacgttgctcacgtgttttagctaaccagccaatttgggcgggcaattcgacttcttcactagtttcacagacaatggtgacgtctttagcaagtaaatctagctccatcagggacacaatatcttgggcgatggtttgcaacgcgtatggcgggtcaaaaaagaccatgttatacgataccgcctgcttcgctaaattatgaatcacctttttggtatcacccttaattatctgaaactgctccggatgtttcgttacctgtacattatcccgaatagtcttaattgccgccatttgcttatcgatcaaggttgcttgttccatgccccgcgaaaccgcctcgatagcgagtccgccgctaccagcatacatgtctaaaacggcgccaccggtaaaatatggtccgataatgttaaatacattttccttaattttatcagtcgtgggccgggttttcatccctgggaccgcctttaaccgtcggccaccaaaatcaccagaaataattctcattgttcatcttcctctgttatcgtatagtcctcatcgtagttgactcgcaaatcagcgcgtggtgaaatatacgccgtacgcacaaaattaaaactgcgaatttttttcagcgtttccgctgcgtcagctcggttaacatacaaaatcaagtaatgcatctctttggacaaataattaatatcccctagcttcttcaaagccgtaactttttttaagtgactaaagaaaattacgatgctttgccgttcagttatctccatttattttgcttccctttgctctattctttggcttcttttttgtgaagcactaatatttaacaaaacgccaatggtggcagataaaacaatcatactcgaccccccgtagctaataaagggaaaagttacccccgtaatcgggatcaagccggtaattccaccaacgttgaaaaaggtttgaactactaaataagtcgcaattccgtagcaaattaacgtatcgtacatccggtttgacttggtacctaagataattgcccggaaaataatcacgaagagcaccgaaataatgataatcaccataattaaccctaactcttcagctaccacggacatgatgaagtcggtatttgcttctggcaagtatccttttttctggatactatttcctaagccaacgccaaatatcccaccattaccgagtgcgtaataagaattaactaattggtttccggctcctttggatagttcaaacgggtgtgcaaagccgaccaacctttgcagcatgtaattggaggtgttgacgtcaattttagaagctaccgtcgtcaacaacccaaaaaagactgccaaacccgcaaaaattattgcaacactttgccgataatttttgccggctgccaagaagagcacaattgcaatcgctgcgttaattgtggaaccccctaaatcgtgttccaaaaaatttagtacgattagcccgaatacaataacggccgggctccaggtcgtcttcgctgaaatctcgtcacctaattccatgcggtgctggtgcaacgacaagatattagctaagtaaagaatgatgaacagttttaagtactcagccggctgaatcccaaacgaaccaatataaatccaaccagtggctccattagtgttagggccaaagaaaattaagtatattgacgccaaaaatagtgccacaaatgcgaacatcaaaattttcttacttcgaaaaacttttttgttcatcaaaaagactagcaaggtaatcacaaaaccaacggctacccacaccgcttgcttcagcaaatagcttttagcgctaatcccattttgaatatagtagtctgcactggccgaatataccataatgatcccaaaaatacttagcaacacgtatggaaaaacgacccataaatctaggtctggaagccgccgctttaatttttgcggcagccaattgataatgctttgcattgttatccacctttatcctaataatactgttctattatatcctatattttctccggaaaattaaaaaggggccgagaaaatttttcccgaccccttcttaagaagaacttaaacagcgttattttctaacgtgtttacgtaaacctgatattcattattttttagcagccattttacgtttcttagccgctttttcacgttcgttagtatttaagatttgcttacggagacgaatattttctggtgtaacttcacagtattcatcttcatttaagaattcaagggattcttcaagcgtcatgtgtaatggtgctttaaccttagcaatatcttcagaaccagcagcccggacgttagtttggttccgtccccgggtgatatttactgaaatatcattttcccggctgttttgaccaacgatcattccttcgtatacttcggttccggcatcagtaaagattaccccgcgatcttggattgccatgattgcgtatgtggttaccttacctgagttaatggataccaaagtaccgttacgacggcctgggttccaattcttaatcactggtagatattcttggaaagtatggttcataattccgtatccccgagtcattgaaaggaattcggttgagtacccgattaatccgcgtgaaggagctaagaaagtcaaccgagtttgtccgtttccggttgattccatgttcttcatttcacctttacgttgtgaaagtgaatcgataactgaaccagtatattcatcaggagtatcaatttgaactgattcaaacggttcgcacatcttaccgtcaacttctttaaggataacttctggacgagaaacttgtagttcgtagccttcgcgacgaagcatttcaatcaagattgaaagatgtagttccccacggccagaaacaacccaagcaccgggatcatcagtatcgtcaactcgtaaggaaacgtccgtatgcaattcttgcttcaaacgttgttccaattgacgtgaagtaacaaattttccttcccgaccagcaaaaggcgaatcgttagttctgaaggtcatttgcaaagttggttcgtcaatccgcaaaactggcaatgcttctgggtgttcggcatctgcaacggtttccccaacgaaaatgtcttccatcccggaaacggcaattaaatcaccggccttagcttccttaatttccaaccgtttcaagccaaagtaaccaaatagcttagtaacccggaagttcttcttactaccatccaacttcattacggtaacgttatcgccaaccttaatggtaccgcggaatacccgaccaattccgatccgacccacgaaatcgttataatcaagcattgctacttggaattgaagtggttgatcagaagtatcttccggagcaggaatggtcttcacaatcgtgtcaaaaattggtttcatcgtgtgttcttgttctgcaggatctgaggagaagcttgaagttccgttcaaagctgaagcgtaaaccactgggaattcaagttgatcttcgtcagcaccaagttcaatgaacaagtccaaaacttcgtcaactacttcttcaggacgagcaccggggcggtcgattttgttaactaccacgattggagttaagtgttgttccaaagctttcttcaatacgaaccgggtttgcggcatggtaccttcaaatgcgtccacaactaacaaaaccccgtcaaccatgcgcatgatccgttctacttcaccaccgaagtccgcatgtcctggagtatctaagatattaatttgcttgtcgccataacgaacagccgtattcttagaaagaatggtaattccacgttccttttcgattgcgttggagtctaacgcccgatcttcgatttgaacgtgttcatctaacgtgtccgattgttttaacaattcattaactaacgttgttttaccgtggtcaacgtgagcaataatcgcaatatttctaatatcgtctcttaatttcaaaatttgtttctccctttcgttttgcaatggctttacataaaaaaacctgtgactcattgttcggtcacagcacaagctcattttactatgttcattatagtagcaaatgcctttttcgtagcaactagtacaacgcccgattttagcatattaagtgggcttccgtcaatacggtcaaccatgagtcccaataccatcgctaaagcgtttccagccgcaaaatcccacggtttaagcgtggatgcatagccgacttgcttacctaaaatcactcggctaaattcaattcccgcacttcctaagacccgtgaacctaagctttgtgcctcaattgtttgaaaattaaatttatttgcaattaacatcggaccgcttagccctaccaatccctctgctaacggcagattttccggcgaggttagtttcacttcgttacaataggcggcacccagtcctggccctccatgtagcaatcggtcacgcatcacgtcataaatataacccaaaattgggtgtccgtcctcatacaacgcaaccattacggcaaagtcttcaccctgttttacaaagttcatggtaccatcgatcggatcgattacccacactaaaccagtagaatcagtgatttgacgttcagtttcttctgccaatattttagctggctgcaataacggttctaagaaggcaatgatcctttgctggttttctttatctagcgaagttactaaatcacgccgccccgttttttgtccaacagcataatgtttttgcatttgttctaaaataaattggcgatcctgccgcaaaaaatcacaaatttgttgatcaatttgttctaattgggttttagtgatatccattttcggtcaccttaataatttttacaccttcatcacgaagttgtttaactgcttgaaacggctgcattcctgaattttgttcaaattcacgataaattcgtttctcttcacttttattcggaaccacttgccgaaatttgtcgtaggcgttctttaacgtttgctttttaacgcccttttgatagctttcttcaattttagtaaagaaatctactacgtccgtaatctcttgaacattccaccgttcgtccaacggatagctaaaattttccttaattcccacaatgctacctcactaaagatttattttgtattctctttaatctatattatacttaatatcagacaaattggaggtttttatcttgattaaaatgaatgatatcacgcgagatggtaatccagttttgcgcaaacgggccgaaaagctgacttttcctctcgatcccaagtatcttaaagttgctgacgaaatgatggaatacctaaaaaacagccaagatcctaaaatcgctcaaaaatatcatttaagagcgggcgttggtttggcggctccccaaattggcctatcaatccaaatggcctcagttttggttcctggaccagatgacgagattatctttgaagaaaccctcgtaaatccagttatcgtcagtcagtccgttcaagttgctgcacttgacgaaggtgaaggttgcctttcagtagacaaagaagtccctggctacgttccccgctacgaccggatcaccattcggtaccaaaccgttgaaggtgaagaaaaaactataaaactacgtgattaccccgcaatcgtatgtcaacatgaaatcgatcaccttaagggaaccctattctatgatcacattaacaaaaaggatccattttcaattgacgataacgccattttgattggttaaagatcataagaatgacaaaagacgcaggtttctccattattttaggagaagccctgcgtctttttattttctataatttgcttaagtcctttaagtaatttttagtttgctcgttaatcaggtaaactacatcaacctctaaaatgtttttgtttgcccataaatctgaaacacgcaacatcggttcttggtcttccattaaatctttcctttgacaatactgtgttagccaataatcaattcggtcacccacatctctaaaattgccctggtcgttaagtttaatcttgtagttaaaccccacaactgcctgtccccaaacatctgctacagacgtaccgcgcttagtaaccaatacaaaaccctgagaacgcatttgctcagccacgaatcccatggcctcatcaacgatggtttcgcctgagttacggacaatcgtcgctgctttcgaaaccctacgccgttttatataaaccattagcgctaacactgccagcacaagcaacaatcccaaaatgattaatttcattgaacgtccgtcctttcaaaaccctaattctatacttataagtaccgctgtgataaaatattctaagatgcgttgtagtaatacaacttattgaacgggaaaaactttatttttattggaacacatttttattgaagaaggaaggaaaaaacatgatctttaaaatttattatcaagaatcaaaaaaagaaatgccacgccgggagaacacacgctcactatatattgaagctgactctcaaccagaagcaattaagcgtgtcgaagaccacaatcccgattttaacctcgaacaaattgaagttttagaggggaaagcccttgaatacgaacaacaaggggtaaactataagcttgtggagtactaagcgatgggtaagattaatataaaaaataacgagacggccgtttatgcaatcggtggtctaaatgagattggaaaaaacacctatggaatccaatttcaagacgaaattattgttgtagatgccggtatcaaattccctgaagacgaacttttaggaatcgattacgtcatccccgattatcaatttttagtcgcaaaccaacaaaaaataaaggctttagtgatcacccatggtcacgaagaccacattggtggaatcccgtttctactacaacaaattaacgtgccaatctatgctagtccactagctgccgccttaatccggggcaaacttgaagagcacggattgttaaaaactaccgaaattcacgaaattaacgaagataccgtgattaagttccctaaaactagcgtaagcttctttaggaccacccattctattccggacactcttggagtagcggtgcacaccccttctggcgtgattgtggaaactggtgacttcaagttcgatctcacccctaccacccaccagccgcctaatttacaaaaaatggctaagttaggtgacgaaggcgtactgttattgatgtccgatagtacgaatgctgaacgtgacgaatttactaaatccgaacgctgggttggtaaatcaatccgtaaaatttttgaagaagttcaaggacgcatcatttttgcgacctttgcttccaatatttcccggattcaaatggccgccgaggctgcgctgaagcacggccgtaaaattgcggtctttgggcgctctatggaagcagcgttagttaacggacgtgaactaggctacttagatattcctgacgaagcgttggttaatgctgaagaaatccggcacctccccgctgataaagtattgattatgtgtaccggctcgcagggtgagccaatggccgccctaagccgaatcgctaacgggactcaccgacaaatttcgattgaacctggtgatacagttgtattttcaagtaatccgattcctggaaacacaatcagtgtaaataacgtaatcaacgaattggaagaagccggagcacgagttattcatggtaaagtcaacaacatccacacttctggacacggtggccaagatgaacaaaaactaatgctccgcttaatgaaacctaaatacttcatgccaatccatggcgaataccggatgcttcaattgcataccgaattagctcacgactgtgacatccccttcgaaaatagctttatcatgtccaacggggacgtcttagccttaactaaagactctgctcggcgttgcggtcattttaatgccggggacgtctatgttgatggtaatggcattggcgacattggtaacgtcgttttacgtgatcgtcaattactctctgaagaaggtttagtggtcgtcgtggccaccattaacctcaagaccaaaatgattgaatcaggaccagatctattatcgcgtgggtttgtttacatgcgtgaatctggggaactcattaatgaaggacggcggcgaatgtttgccacgattcggcaagccatgcgcaacccccacgctaacgaagcttcaattaaccgggcaatcattgatgatttacaaaaattcctgtacgaccagaccgaacgtcacccggtaatcattccaatgttaattatggattaaaatttcaaacaccgctaaatcaaaattagcggtgttttttaatatccaaacgcttgcaatgcggcttaactactccacttaacttgcctacccctcccctgcgcaacaatcctgctaaatttcactattgaaaattgattccgtgctaacgagaacatacaaaaaggccccgctagtaaaagcggagccttgagaagacgactgttagtcaatcttatttaactctcccagcaaagcttgggtagaagtatgatgaaattgtttgtactttaacgttttgaccaaaggttggtgcacttgcgtattggttgttaccaaggtaaataccaacgtggtaagttgctcctggagtaccccagaataacaagtcacctggttgagcagctgaaactgactctttgttaacgtatgattccattgctacggtgtagcttggtaagctaatccctgcagcatgttggaatacgtaagatacaaaaccagagcagtcaaatcctgcaggtgtcttaccgccccaaacgtaaggaatggtgttgttagctaacgaagtagccaaaccggtaactgatcctgtgttttggacgttgctagttgctgcacttgatggtgccgctgatgaagcgacgtggtttgttgaagctgcaggagctgcactcgatggtgctgccgatgaagcgacatgattagtcgttgcaggagcacttgatggtgctgctgacgaagcaacgtgatttgtagctgcaggagcactcgatggtgctactgatgaagcgacatggtttgttgctgcaggagcacttgatggtgccactgatgaagcagcttgttgttgcttactaatttgtggagcagctgaacttgctgcttggtttgcattagcagcaaccgaagcactgcttgctgcagaagcaggtttgctgtagctatggcttgctgcactatttgcttgagtagaagaagctgttgctacactacttggagcaactgaacttggagctacagagcttgctgcactcgaagtaactgcactacttggagtttggctagctgcagaactgctttgtaccgctgaagaaactgctgcactattggaagctgctgattgagtagcttgcgaagttggagtttgtacttgtggcttagcagctgaacttgctggtgctgcaggtgctgcaggtgctacatatgtactgtgtgttgaaacggtatttccactaggaatgttaagttgttgtcccacaagaattaatgagctagtcaagtggtttgcttgcattaaagcgttaactgaaacaccataacgctgagcaattactgaaagactgtcgccactctttaccgtaaccgagccagcctttactttgtcactaacacttgttttgggttcggcgttgttcttttctggaatattgatttcttgaccaacaaaaatcaagtgactgttttgattaatgttattcaaggattcaatactcttaatggaaactccgtatttttgagaaagtgcccaaactgtgtcgttcttttgaaccttcacagaatcagcatgcgcaactgcttgtgaaccgccagcaacaagtaatcccgcaccggctactccggcaagcaataatttggacgcatttgatttagatttagataccattataagtttgtccactccttaaagttttcgatttatatattatttcattcgactttattcaaaataaattataattggttttgcacgtctataatattagcatttttcgccaactttgaaaacactatttatacatcagatattcaatttttctttaggaattcttataaaccccttcaatacggtgtttaacaaaacttaataaattcaaatttttttgtcccgcttttttgataaaaagcttaatttcaagcatatttagctagcgttacagttttgttacaaaaaaagcatattgttacaaaccttgtaacaatatgctttattgcattaactatttttatgcataaaatgaatatttattagttattagtagtgcgccgtggcttccagattcccataatgaaccctgcaactactgccccaattaagactgataggacgtagaagagcttgtgatccgctaacgcaattacccaaaggccaccatgtggtgcaggaacgctaactttccaaagctgacttagtccaccaccaattgctgaacctacaatacttgagccgattactcggagcggatcagccgtagcaaatggaattgccccttcggtaatgaaggaaattcctaatacccagttagaaatccccgcttcgcgttcttgttcagtgaacttctttggccagaaagttgtcgcaatagccgttgctaatggtggaaccatcccacctaccattacggccgccattagatcaccatttttggttgacgtaaaggccgcaatcgcaaatgcgtaagccgctttattaaacggaccacccatatcaatcgacatcattccggctaagacagctcctaagaggactgcattaccagtacccatgccttccaaaacgccagttacccaagcgtttaccgccgcaaataccgggttaataatgaagaacattaaggccccaactaacaataaactgacaattgggtagaatagcatcggtttcaaaccttctaatgatttaggaatgaagcggaagaacttctttagcgcattgacaattaaaccagccgcaaaaccagcgatcaatccaccaatgaaacctgaaacactattagtatgcataatgcttgccgccgattgggtagccatgtaaccaccaactaccccgggcattaacgcaggtaaatcaccaattgattgagcaataaacccagctaaaattggaattaagaacgaaaaggcgtaattaccgatatcgtttgggaaggtgaaccataagctggttgccgaagtatatcgttcaataaagaacgaaatcgccatgataatcccaccaccaactacgaatggtagcatgtgagaaattccgttcatcaagtccttatatacttcgttccaaaaaccgcccttagattcatcagcagcatcatcgccatcggcttggcttgcatggaacgtgcttgcctgatgattttcgaccatttcaattaattcatcagctttgttgatcccatcaattaccggccgatttagcaagggtttcccattgaaacgcgccatttcaacctttttatcggcagtgacaattactccgtctgcacgttcaatatcttccttagttaaacgatgctttaccccttcggaaccgttagtttcaaccttaatatcgattcccttatctttagctgcttttttcaaagctgcttccgccatgtaagtgtgggcaattccgttaggacaagctgaaaccgcaacgataaatggtttttgggttgctgaagtttcttcagttgcaggagccgcattcgttgcaggagcttcttcctgagcgtctgcagcatcttcggcatccttcgccgcttccgcttcttcaaacaatttaatcacgtcgtcagcactttccgcttttttcaacttcgcaactaggtccgggttgattaacaaactggaaagttttgccagcgcttgtaaatgggcgttattcgcgccctcaggagctgcaatcataaagaagaggtggactggttgtccatctaaggcattaaaatcaacgccttgactgctcttagcaaataacacggctgcttggttaaccgcatcagttttagcatgtggcatagcaatcccatcaccaattccggtggtggattctgcttcccgatctaatatccctttaagatacttcgcacgatcggtaacgactccttcagccacgtacttatcaatcatttcgttaatcgctgcttcttttgaatcagcttttaaatctagaatcatcaaatttggtttgagtagatccttaattttcatccttcatgcctcacttttcaaaaatttcaattgcgttagcaacttcatcaatcttagctttggtggcaatgtctagtgaaaaggccgttgcactgccacaagctaagccttgtttaaaggcccgttgcttatcgtgggatttaaccaattctccaacaaatccagcaagcattgaatcacctgccccaaccgaattaacaacggtgcctttaggtgcaaaactgcggaaaacctgatcctcagtaacgagcatccctccttcgccagccattgaaatcattacattttgagcgcccatttcaattagctttttaccatattcttcaatttggtcatcggaagttagctttaccccgaataaatctccgagctcatgattgttaggcttaacaaccagcggatggctatccaacgtatctaacaaaccttgtcccgttgtatcaaccgcgaagctcgctccattttggccgattttcttgataatgtcatcgtacaaagtttgtggtaagtttgctggaacactaccggagaaaatcactacgtcgcctgccccaacctggtcgaacttggccatgaattggcttagctcttcatcgtcaatattaggccccaacgcgtttaattccgtttcttgttgagcgtgaattttcacattaatccgggtgtcttccttaatgccaacaaaatcggaatggacccttaattccgtcaaggcgttagccacaaattgcccggtaaatccccctaaaaatccaagggcggtattttccacatctagttcattaagaatccgggaaacgttgatccccttccccccaggaaacttacttgcagacttcaatcgattaactagcccaacttgcatttcgtctaagctgattacgtaatcgattgagggattaagcgttactgtataaatcatttttgaacctccaagtaatttagttgctgatcagtttttaaccattctggacattcgtcagcaatgatggttacgtcccgtaaatcagcaaaccttgcaaaagaagtctgatcaaatttactacagtctgccaaaacatatgcgtcccgactttgttcaattgccgtggatttaatttgcgcttcctgaatgtccggagtggttaacccttgaacacggtcgattccgttcgttcccataaagcagcggtcaaaacggaaagtacgcaaccgatcgaccacttcagcgccgattaacgctcgggtcttgttttttagctgtccgccaactaagtaagtctttatatcaaaatcagacaataagctagcaatcgataagccattcgtgaccactagcaaacccttgagttccgctaaataagcaatcattgaagcggtagaagtaccagcgtccaaaaaaatcacttcgttgtcttggacaagttccgcggcccgtttaccaatttcattcttttctagtaagttcagtttggactttactcgaaaatcagtttcatcttgtaaattggtttctaaacgagctcctccataaatcctcttcaactttccggctgcttctaggcgttttaaatctcgccgaacagtggagatagaagcgtcgttttcttgcataatttcattaaccttaacgaattgacgttcttttaacattcgcaaaatgtttttctcacgcagttctgtaagcattttcatcaactccctaaaagaatatatcatcattcttcgccaaaatcaatcaaaattgttcaaaataattcatttttgttcaaaaagattcaaacgagcgtggatttttatattttcatcctctggtatcggattctttacaaagttacgcgcaaaaaagtgacccgggaaaactaaaaaatcctttttagggtgaaactataaaaaatttaacgggttgcctttaatagcgtcaaaagtcaacccgttccgcttaacaaaaaaacgaccatatgccaatttaggcataatagtcgtttattaggtaagacgcacaagctagccgtcttttattttccataaactattagtttaaattattcaaattcctcttcaatagcttctttaggatcctttggccggcgtcttttgatcttaattcctaacagatcaataaagaaggccaccgtaggaattcccacgattaacccccacgttccaatcatctttgcgccaatgattaacgtaatgaaggtgacaaacactggtaaatctgtggctcccgccattagtcgaggatgtaggaaatacgattcgaaaaagtggattaccgccactaacgctaacacttcgactactgaaaccaatccatttgccgaaaaagccacaatactcaacggaattaaggagatcaacacccccgcgaccggtatcaagcctaaaacaaaaacaatgatggccatcaacaagagtttaggaatcccaattatccataaaccaatcaccatcagtccggtattaatgctacaaatgattagctgcgtctcaatcacggttcctaaaattaaaacgtactttcgtaacaaataatatataaggttaaatagcccttggtatcggctatgtaaaatcgcgtgtccaaactcccgtaagtggttgtaagttaagttgaaaactaagcttaagaataacgcaatcatcacgtgttcagccgcaatcccaatccggcctaattggttcaatcccgacatggcaaggtgctggctgcccttaaccgccgtggtgttttttgcaatttcattaatgattccttgaaaatatttgttattaaaagcatcgctgttaatcgcttgcccaattaacgcggggatcccctttaattggtcataaagcattgatgcggtgaaagaaaataccacggccgcaaacgctaacaataccgagtaaaaaatcaaggtaccgagcggttgattgacatgcagatactttcgaatatttttaatacccacgtgggcaacaaacgagaaaatgacaatcagcaaaatttgcgacataaacccgcgtaaaagatacacaattaatagcagagccgccaacgttgtccagagttgtaccgacttcttttgccaaatccttactaaaacgtccattattttcctccaattatatcttaaagggcctgcacaaattataatctgttgcaggcccttttggaaaatatttattaatatttaatggttatttaattagtttttgcttttaaatagcggtgcgagcggttcgttgttgtaaatcatcttgattgcgttccctaataaaggtcccactgataattcgactaacttttcaaagcgcttctcctcaccaatcttaatggagtcggtaacgatcactttagatagcttggaagcttgtaaaatttggggtgcgttccgcgaaaagattgcgtgggtagctgcaccataaatttcagtagcaccagcattatgcaaagcttcggccgaaattgtcagccgggttcccgtatcaatcatatcgtcgatcactaaggcaacttttcctttaacgtcaccgatgatctccgtaggaatttcgttgaggttttccgccgattcttcgttacggttatcaataatcgcaatcggagttcctaataattccgccatgttccgtgcccgagagacactcgcgtggtctggagaaacgaccacgaggttttcagaatcaaaattatgttcttggaaatagcttgctaacaaaggcgccgccgccaaatgatcgactggaacatcaaagaatccttgaatctgcggagcatgcaaatctagagtcaatacccgcgtaatgtcatcatcttccaacaaattagcaattaattttgccgtaatgggttcccgtgaacgagccttgcgatcttgacgggaatagccgtaataaggaatcactacgttgatctgccgagcactggcccgccgtaatgcatcaaccatgattaacagctccatcaaagaatcgttaatcggatccgaaattgattgaatcacgtacacttccgctccccgaatactttcttcaatgttaacttgaatttctccgtcgctgaattgcttaatggttgcctttcctaatggaattcctacttcgtttgcaattttttctgctaacgcccgattcgaatttaaagagaatattttcattcttctttttgctttgctttccacggctaaacctccaatttttatctaccgctattatagccatctttagttatcaacttcaacaaatacttaaagaaaatcccggggagtcaccccgtccatcccaatcatcggatcgatttttccggtttctaccagttgtttagtcaaaagagttggttcatctccgctagttgcgaaagtttccgtaacttctggctttgtaaggatcgacttacgctgaggttcccctgcttcgctattttccgaagccgttttgggttcagacttttctgcaattggcttttccgttatggtaatttccggattaagtcgcttaactaagccagtttgccggttagccgattcgttttgtacagcccgttggtaagcttctacctcacctagtaaaatgatggagtctgacgcccgggttaaccccgtatacaaaaggttgcgctgtaacatccggtaatactggcgtaccatcggtaaaatcaccaccggaaattcgcttccttgcgatttatgaatcgaaacgcagtaagctaacgtcaactggtttagatcattttttccataggtaacctcgttgccatcataatcaacaattaactgcgcatgaccctttcccgctttttcggtaactattccagttatttccccgatatccccgttaaaaatattattttcaggtgcgttaactaactgtaaaactttatcaccaatccgaaattgccggtgatttgcttctaaatatttagggtgatcagtttgcggggggttaagcacccgttgcaaatgacgattgatttcatcgatccctgcggctccgcggtacattggcgctaaaacttggaggtcgtttttagacagtccccgagccaccgcgcgttccgcaatttgatcgattgcatccgcaacttggtaagcactcgccttaataaacgatttgtcaggacgattttgggtaaaatcatccggcatttctccgttttgaatgctgtgcgccatttggataattgaagaatcctgctcttgccgataaattttagttaatgaaattgttggaattttttgactacgaatcaagtcactaaaaacttgtcctggtcctaccgacggtaactggtccttatcaccaactaaaacaacttgcatttcggcgttaatcgctgaaatcaaggtattgaacagccccgtatccaccatggacatttcgtccaccacgagaagttctccccgtaattcctggatttgttcgtcgtgtaaatcgtcattcccgttcaagcccaataaacgatggatggttttagagggaacaccggtaacttcactcaaccgctttgcagcccgaccagtgggagcagctagttgaatgggataatcctggtccggattggcgttggggtcaaggtctagatcgtgcagttccgcaaaactattgattagtccctttacaatggtggttttaccagtaccaggccccccagtaataatggtaattccgtgagacaacgccattctaattgcgttattttgagtttcgtcatactcgagcgcaagatgttcttccgcgcgtttaattgcccggtcaaccgctttttcgttaaccttaggaggattcttaagcagatgctggagctggtagccaatcgcttcttccgcttggtaaagccattttaaatagatttggccgttttctccaaccacccgtccttgtttacccaactcaagtacttgttcagcaatcttttcagcattaatttcgtttcccaatagctgctgtgccctttgcagcattacttccgcaaccatgtaagtatctccggtgctgttacaccactcttgaatcgtggctaaaataccactttgtaagcgtcctggaaaatcaaccggaaaatttagctgctgtccaattgcgtcgacacgcttaaatccaatattttcgatgtcattagctaactgatacggattttcttcgataattttcaaggtatcttcgcgatattttgcaattacgttatcggcggttttgcctgaaatccccaaatccgcgagtttgatcaggatcttctccatcccattggattcagctagcaccgtttcaatcacgtccgcctgcgcgcttgataatccgatatccctaagcacctgggcattatccttaattacgtcaatggcgtccattcccagttgtttaacaatcttttcagcagttttctttccaatccccttaaattgcgagcccgcaaaatattcaactaacccttccttagtatctggccctaaccgactagcctggcttaattgaatctgggttccgtacttggggtgttccaccaatttgcccttaaattggtacttagctccctcctgaacttccgccatgttgccagttaccacaatttggggttccttccaatcaaagtcttgatcaaccacgtcaatcaaaaccaccttaaataaactagtgggactttcaaaaaagacggcgttaaccgtcccggttaactccaccattttattcatggaagttgctttttttggaggtgctgctgaaccttcatcaccaaaaaggtttagtttctcaaatgccattaatccgcttcctttgacgaatgcaatagtttatcaatatcgactaggcgttgctttgctttactgaaaaattcgggatcaatttgtttagctttggcaaagtaatcgttatctggttgctgggtcaaggtcatttcgaccactccccggttaaataataatttcgcagtatttttatttttcaacgccacgtcgtaatatttttgggccgcttgagcctctcccattgctaaattgatatcgcccattaattcattagtctctggatcttgctgatgctgttcgagtgcagtcaatgcaaaggcaaaggctagcttatactgactttgtgcgtaatacccttgggcaatcattaggttagcgtcgtgccggtattgaggatctttaacggtttgaaatgtagcgttggcccgctcataaagccctgttgcgtaataaacattgccgagcccgtaagtaagtaaatcttggctaggttgatcactaaaaagcccccgtgctttaactaggagttcttcagcttgatcaaaactttgctgtttaaccaaaaccgtggctaaagcataatagttttgggcattgtgtggatcttgatcaattttttgaatcaattcgtgaactaaattttggttttcttcattttcttttttttccgtcatcttttcaccttaaatcacgtctgtaggatccgtttttttagttaagtagctagtatcgttccagtccaagagccggtacgtctttccctgatcctgggtttctaggatagtggtactagtgttggcgaggccgccccgtttgcgtaagtcgggtaacggaacctctaataacgcgttaataatcgcgtttaacgcggctccgtggcttacaataattacctggtcatcgtcgccaggattggattcacaaatccgtaaaattgctggacgcattcgttcaatgaggtgttgaaaggtctctcctttgattcgggcggggaaatagcgttcggggtggttacgaaaagcatccacttcttcagcatatttcttttcaacgtcgacaaatttcattccctccatcacgcctaaatcaaattcccgtagacgactgagaattgttaaaggggttgcgtgaccttgcaattcatccagttcgtgttgcaaagtggtggccgtcacccgtgcccgacgaagcgggctagcatatatgtggcggaactgctggggtgctaaaaaagcggctaattgcttaatttccgcgtagctttcttttaaaagcggagagtccccctttgctccttgataacgcccttctaaattccattcggtctttccatgtcttacaaaatataattttgtcaaatctctcgtccctttatcaatgtgtttacccactattttaacattaaacgctaaattggtaatagtaacgctagccttttaacggcaaagaaaaaggccagggaaattttcccccgaccctatttggtattctttttaattgtactgaaagtcgtctttgctaaacttgcgttatcaaacacggaaaaatcagcgaacccttttttaaacgtattgcaattgttgcttgctctcgctataggcagcatcaataattccgccaccgatgcactcttcaccatcgtaaagcacgagggcttggcctggcgtaattgcccgagcaggctcgtcaaaatcaacggtaaccttcgagaaatcgtcgctgaaatgcaccgtcactggaacatccttagcacgataacggaacttagccgtgcaccggaagtcatggccgcgctcttcgcccaaccggtttacaaaatgcatgtcggaagcgtccaagctagcggcgtaaaggtgcggattatcaaatccttgaccaacgtacaggatattcttggaaaggtccttaccaaccacgaaccaaggctcgttgttcttagaaccgcccccaattccgagtccgcgacgctgaccgatggtgtagtacatcaatccagcgtgctcgcccttaacttcgccatcaagggtcatcatcttaccaggctttgcaggaaggtagttgcttaagaactcacggaagtttttctcaccaataaagcagattcccaccgaatccttcttatcgtaaactgccaaaccagcttccttagcaattgcgcggacctctggcttaaccatgccccccaatgggaacataacccggtcaagctgttcagcactaagttggctcaagaagtaggtttgatccttattactgtccgtagcgcgcaaaaggtgctgatgaccattttcgtcgcgctccacttgtgcgtagtgccccgttgccacgtaatcagctcctaaactaattgcgtagtctaggaaagccttaaacttaatctcgttattgcaaattacgtcgggattaggcgtccggcccttcttgtactcgtctaagaagtaggtaaagacccgatcccagtattccttctcaaaattaacggaataataaggaatcccaatcttagcggctaccttagccacgtccttgtaatcctcggtagcagtacagtatccattttcgtcagtgtcgtcccaatttttcatgaacaccccaacgacgtcgtagccctgcttcttaagcaaataggctactacggatgagtcgacaccgccgctcatcccgactacaacacgcgtcttgctgttgtctgtcattatatatcaccatcatttctagagattctggagaatcttacgattgaaggtcgcaataaatccagtaaattacattctataacaatcaattcggaaattccaccgttaacaaaaagttagtaaaaattattcttgcacgaggacttctcgttccaatagttggtcaataatgaaatggtattgctccactaagggttggtcctgttcgcgcttaaagatgtttgctttttgcattccgttagcggtcaccgtactcattttaaatgctgaaaaatcaggtttaatcattatttttaacttaatgccctggttgtacggcgaagtagcatccaacgaccgttccaaaataaaggttccgttgtttttagtagtgaatcctaagtcagttaacgtataacgcttcaagttttcgctaagccggtaaacgtgggggtctccggcaatggtaacttctttagtaaatgccatgcctacatctccttacttttgttttaggtgctttaaacgctcctcaatagcaataatctgctcacacaagtagtctacatcttccgtggtagtgtttttaccaaagctaatccggattgattccccgatgcgtggtgaatcagctccgtacatcgccgtgagtacgtgggaaggttccaaactccccgccgtgcaagctgaaccgccggaaattgcaactccggccaaatccaaattagtttgcatcacgtaggtagacatccccttcaaccagatgttaaagacatgttgtaaattatctggcgaaagtgagccattaattgcaaaatcaacgtcgtggtctttaagctgctgaataatttgttgcttaaagccggcatagcgtttttgtaaatctgctttagtctgctcatccagcaaacttaccgctttagcaaatcccgcaaggttagcaacgttttccgtaccagcacgacgcttatcttcttgttcacccccgcggacaaaactatcaaagttaactgcttcatttttgtacagaaaaccggtcattttgggtccgttgagcttgtgtgccgaagtggacaagaggtcgatatgatcccgcttcacgtcaatatctaacaacccgtaagcttgaaccgcatcggtatggaaaaccgcctgatgatcctttaagatttcaccaatttcatggattggcatccggcttcccacttcgttgttccccgtcataatgctaactaagatggtttggtcgttaagagcttccttaaactggtctaagctaattaccccgtcttcgttaacgtctaaataaactacgtcaaagcccatttcctctaaatgagccatcggttttagtaccgacggatgttcaattttagtggtaatgacccgcttaccaagcttacggttacgtaaagccacctgcgtaatggcggtattattactttcggttccgccactggtaaaaattatttcatcatcgtttgcattaatactttgagcgattacgtgacgcgcttcgtccaactgggcccgcgcttgtcgaccaaagccatgtaaactggaggcattgccccagttattcttgagttggtcagcaatgacatccactacttcaggagcagtcggtgtagtcgccgcgttatctaaatatacttgtttcacgcttgcttcccttccatcttaaataaatcaattagcatgttggcagaacgttttcctgcctcaatgataaattcatcaaaggatactccagcttcgtcatcccccgtgtcagacattgcccggaccacgataaacggcttatggaactggtgggcaacttgtccgatggctgctccttccatttcacaacataacgcatcggggaaatggcctaaaattgcttggaccttttcttgactcgcaataaattggtctcccgtgacgattaatccagttttcacgtttaagttagtatcctgagctgcttgtttaaacttttctattaacgctgaatccgctgcataacgggcaacatcttgttctggtaattgaccgtaagcgtacccaaacgcagttgcgtccacgtcatgataggcaacttccgcagacaacaccacgtcgcctaccgcaagcccctgtccaattccaccagcagaaccggaatgaattaacgcatcgactttaaaattagtaatcaaaattgcagcagtaatcccagcttcaactttgccaattccagagcggactagcacaacttcgacatcttcaatacggccttcgtaaaaaatgaccccgttaatatccgtttgtttagttagctcaagattttccttaagcgccttaatttcttcttccattgcgcaaattacgccatacttcatcttcttttccacctatcctataaaaaataaaacgagaaatactaatacaattcccaccgctaaaagtgcaattgcaatgttgagtttctttgctaaagcgcgacttttttcttcagcaatctcgtcggtactaaaccgctgttcgcgactcgtccgtaaccgtgattcatttttagaatcttcatttgcagaagtttcctccggcgccttttgtgcgtgaatttttttttggtattccgcacgggtttgattctttttgtccaaaaaatcacctactttgtggtcgcctgccaatggtaaattgcaagcaccgtttttgcatcttcaattttaccgtcttcgattgcttttagcgcttcggatagtgaaagttcaaaaacttttaagttttcaccttggtcccgcggtaatttatcttccaccggttttaaatcagttgccttataaaccgtcatgtattcgtccgtaaagcctggcgcggaataaaagccgaccattttttcgatctttccggcagcgtagcccgtttcttcgtttaattcacgcttagcggtttctaaaaaatcttcacctggttccactttgccagcgggaatttcaatcgttggtttagcaactggtgcccgccattgtttttcaaaaagggctttgccgtctgcagtcagcgccaagattgcaattgcgtcctggtgtttgactacgtctcgattagccaacgtgccatccggtaactctaccgtttgttggtaaacgtcaacaatttctcccttataccgggaaactgacttaactactttttcttctaaatccattaatcctgttctcccttacgaaatacttttacagccaccaatcccttgggaccctcagccaccattaactggacgacctcgttttcatctaaagttttaaaatcatcggattgtaccgcactataatgtacaaaagccttttccccgttgtcaagctcgatgaagccgtaacctttggttttatcaaagctcgttaccgtaccattttccaaattgcccactccttttattatttaataccatcataatcgtgagaactacttctgtaaattaaaaaagagactgaatttttcagcctctaattttagagcgttagttacgggcaaattttttcaaatatacccgtccttttaaatctaacgacgccctatttttcttcaaaaccttcggtaactgcttccggatagtactttgtaacgattgccgcacagctagcacataaggttgggaagtgttcgtcactaccaacatccgtcttcgtcattcggcaccgttcgcaaacttctccgtcagcaggtgtgatttgaaccgcaacttgaccgtcaaaacttgccgcatcttcaggagcttctgcgaggtcccgaacttctaattgcgaaacaatcaagatcaaccgcaagtcgacgtttaattcgtcaacaacttgcttagtagcttcgtcaaggtacaaggttgcctttgcttccattgatttaccaatcatcttttggtcccgtgcttcttcaagagcctttaagacgtgagaccgtaacttcttgacggtttgccacttagctaacaggtctgctgccccggctaattcttgcacttctggcatttcagcaagctggacaaattcttccggttcagagaggaactgccaaatttcttccgtagtgtgtggtagaactggcgtcattaacttcgtcaaaccgactaaaatttggtagaagacggtttgcattgaccggcgtttcaaactatcttccggttcaatataaacgacgtccttcgcaaagtcgaggtagaacgcggaaagatccgtaatgatgtagttcatcaacgccttgtaaatttcaatgaaattatattggtcgtaatcttgccgaatttccttaactaattcgttaaaccggactaacatgtaacgatcttctggttgcaagtcagcgtaagctacggtattagcttgaggatcaaagtccgccgtgtttgctaataggtaacggattgtattccggatcttcttgtaagaatctgaaatctttacaaagttatcttgcgaaacccgcacgtcagacgatgaatcaatggaaagtacccataaccgaatgatttcagcacccatctttttaatgatgtctgctggcacaattgtgttacctaaggacttactcatcttatggccctgtccgtcaagggtaaagccttgcgaaatcacctgcttgtatggtgcgtgacccgacatcgctacactagtaatcaaactagagttgaaccagccgcggtattggtcagaaccttccaaagttaggtcagctggatacttcaagtaatcgcgttttgccaaaaccccttgatgtgaagaaccggagtcgaaccaaacgtccataatatcggtttccttggtaaacgttccgtttggtgaatgttcgctagtgtagccttctggtagcaagtccttagcatcccattcaaaccagatatcagaaccatgtttttcaaatagttccgcaacgtgttcaatcgtttccccattcatgattggcgtaccgtcttcagcgtagaagattggtagtggcacaccccaaacccgttgacgagagattacccagtcgccacggtcccggatcatgttgtggagtcgtttttgaccccattctgggaggaacttaacgtcttttaacgcgtccaagatttgatcacgaattttgtctaccgaagcaaaccattgtggagtagcccggaaaataattggcttcttagtccgccaatcaaacggataactatgtgtgtaatccatctgcttaagcaaagcgttagttgcctttaacttgttcaaggcaatttcattagcatcttcgtagaagaccccttcaaaatcaggacccgcttcagcagtgaggtaaccacgatcatcgactggtacaaaaatatcgaggccgtattctttgccaacccggaaatcgtcttccccaaagccaggtgccgtatgaactaatcccgttccagaatctaaggttacgaagtcccctaacataaccactagcttgcgatcactatcaaacgggtggagcgccgtaatgttttctaactcctgcccgcgaaccgtcttgatggtttcaacgtcttgccacccaaattgttcagcagcgtaactcaaccggtccgtggcaatcacaaatttgcggtcgtcacccgcgggtttcacaacggaataatcaaaaccagcatcaatggtaattccttctgaagccggaatggtccatggagtcgttgtccaaactacgaagtaagtgtcttgatccaagacgcccttcccatcgcttactcgttccgcataaaaagcagatggcgaagtaacgtcgtgatactcaacttccgcttctgccattgccgattcggaagaccatgaccaaaatacgggctttttaccgcgataaatcaagcctaactcaaccattttagcaaaagtccgaatttcttctgcttcaaaagatggttgcaaagttaagtatgggttatcccattcggcagctacccctaaacgcttgaagtcttcgcgttgcttgtcaacttgttttaaggcgtaatcgcgacataatttacggaattcagccgtcgacatttttttacggtcgtggccttccttagttaattgttgttcaatcggtaaaccatgcgtatcccaacccggaacgtatgggctccgaaaaccactcattgatttatatcggacgataatatccttagaaatcttgttcatcgcgtggcccatgtgaatgtttccgttggcatatggcggcccgtcatgaagaacaaaacttggcttgccctcatttaatttttgtcgttgttcataaactttgttttcaaaccaaacgtcttcgcgcttcttttcgtttaccggaagatttccgcgcattttaaacttggtttttcctagatttaaagtatctttaacccgcactaaaatcactcgctttcctaagtattattcttgaaattttagacaataaaaaagactccatccctactagggacgaagtcaaatcgtggtaccacccaaattcaaggacgttaaaaacgtcctcctcattttcccataacggtggaaaccgacaacgtctactaaatacttcaacgctgcactcaaaagtgattgtccttctaactagcagactaacctcacaccaacgttagctcgctgaactgctgattgctagaagtccctctttttttacgttttattttttaggatttacgtggaacccttggtcagtgggtttcccctgttcgttaggttgatcttctggaaagaccaccaccgtttttagctcatcttctttgggctctacagcaggtgtgtccggatcaattttcccaacttcttctgagtgtacactgttttcctgaatgatgtcaagcgctccgctattccgcattgcttccttgatttcaccaatcgttagcaattcatcagaactcaataagttatcccaatcgcgtcccttgatcatttgtaattgtgattcaagaagtacttccagcttttgccggaaactacgggcttgtttcttcaagtcgtcagttgccacaataaccttttgagctttgccagcagcttcgccgatatagccgtccgcttttttgtgcgcatttttgactactacttcagcttctttttgagcttctttagcagtgaattccgcttcccgtttagaactaattttaaccttatccgcggcatcttgggctaccataatcgacttgttcaaggattccttcatctcgtcgaaatattccacccggctcttggcttcggctaattggcgccgtaacgaatcaatttcatcatgcaaacgccgttgttcaaaagcaacgtcatctaaaaattcgtcaacttcgtcggggttatacccgcgcattttgttggaaaagtgtttttgttgtatatcttgtggttcaattgccatctgaataaaacctccgtaaatcgctacctagttttaattaaatctagttgggtttttagcttatctttttttgttttacctaaaacttccacaagcttaatcctaccatattttcgaactgaaatgacatcatttctcgcaattattgtgtctgctttttcatcaatcatccagtttaattggacttggcggtgctcaatcagctccttggcacggtgacgagagatcgaaaaggcggtggccactatcgaatccagtcgtaacgacgcaagcgtcacttgcgttctttcccagtcattaaccggtgtaagaatctcggatggggctgccagctgcatccgcactttaatccggccaattcgcgtaatctcatttgaaaagaacttctctaattcaccgttcgtggccacttgccaacggtcttggtaatgaacaatatcgccaaacgtatcccgttgaatcccagaattcgctaacgtgcctaaaatctggcgatgttccaattccgcgaatttaaccggataatcaatttcaaatattttaactagaaaatccgctttttccggaataaagtattgggggtaaatcaagccccgctggttttctgcattggtaaatccaccaaaaaaggacaattgtaattcttcatcccggttaaccagcgtcgttaaaatgtgctgctgccttggatttaaaaagttggttaaaatggaccggttttgatccttggcttcttgcaccagcgcactgaattcttcaattaacggttgttcatccggacggaagtgctgaccaatcggattatccataaaccgtcacaccaaataacagtgcttcaatgtaggtaagtccgttagaacacaattctaatactaacagagccagaattggcgaaaaatctattcccaaaattggtgggataaatctaaaccagctcatgtatggctgacaaattttagtcaaccactggccaaatgcagattgataggcacctggaagccaggacatcaatacccaaataaaaatcagcatcatgtaaatttggattgcccagtgtagtaattgaaaaattaacgcaatcattatttttaatcactcatttcttgtcattatgcaataaatgggcttgagccctgctcaaacccatttaaatacaaattattttctacgacgtttgaaaaatggaggtgtatccaatgattcatcgtcagaacttgtattgttattatcgttaaacgcattaaactctttcttttccacgttcttaaattcatcatcacttggcgatgaagggcgaacggtagaagagttatttgattgccgaagttgccaatcaccaaatggatcgtttgcagcttgagtattttggttattcgctgctccattattattaaggttatcagtcgaaccagccccgcgcatttcagtgtttgctgaaatgttgtttgtattcgcagtgtttacactacttgggttctcaaaagaggtgcgtgctggttgacggtgtaaagacgctctaccagcttttttatcaatcccagtagcgataaccgttacccgaacgccatcctttaactcttcgtcgatggaagtaccaaagatgatgttaacgtcatcgttagccgcttctgtaacgatttgtgaagctgcttgagcttcgaacaaggaaaggtctgggccaccagtgatgttaagcaagacttgttcagcaccatcaattgatgtttccaacaatggtgaagagattgccttcttggttgcttcttcggtccggttttcgccatttgcggaaccaattcccatcaaagcggaaccttggttttgcataactgtcttaacgtcagcaaagtccaagttaacgtaacctggtgaagtaatcaaatcagaaataccttgcacaccttgacgcaaaacgttatcggcttcgttgaaggcttccatcattggcgtcttcttgtcaactaagtcaagcaagcggttatttgcaataataattaaagtatctacgtgttctttaaggttgcttaccccttcagcagcaaaacgcgcacgctttgggccttcgaaagtaaatggacgggtaactacccccacggtaagggcaccttgttctttagcaattttggctaccattggtgcagcaccggtaccagtaccgccacccattccggcagtaacgaaaatcatatctgcgccttctaaagctgaagcaattgtttgttgactttcttcagcagctttagcaccaacttcaggagttgatccagcacctagtcccttagttaatttcggtcctagttgaatctttacgtccgcatttgacgcttgtaaagcttgcacgtcggtgttagcaacgatgaattgtacccctttgactccttcagaaatcatccggtttacggcgttaccaccaccgccaccaacaccaataactttgatgttagcgcctttactcttgttatcatccattgaaaattccatgtttaattcctccatcgttaatgttagtcaaagaaatcactaaaccattttttgattccatcgaagcgattggatgtcgcttttggtgatgaattacgttcaaccggcttagagcgttcttgcgttggttcagagtgctttactgttgcttgagcacgtttaaatttaggtttctcatccacaacttcttcttgtggcgtctctgaaactgtccgttcacttgaaaccatcgcatttttcgctaagatatcaacgtcgctcatccgtccttcgtaatttaggatagctagcgcctgcgcaaaggcggggtgtctcaatcccatttggtcaggaacgtataatttagcgttagtttcgaaaattctttcaactaacttttcgattccaggaagggctgcccctccaccggtaatcacgattccacctggcatgtccagtgcaccaattttatctaattgcttcttgatattagttaaaatctgttccaaacgtgcttcaataatctcactcaagtactcttcatcaaccgcaaccggctcgttttggccaaccacgttaaccgggaaggtttccttaccggcttcgctagcaaccgcgtaaccgtattgttgtttaatttgttccgcgttatctaaagaggtgttcaataccactgagatatccttggttacaaattggccaccctcttgttcgacaaaagtgtacttgaggtggtggtcatgaatcactgccaccgtcgactggcctgcgcctaagtctaacgtaattgtaccaaaatcttgttcaccatcatttaagattgttttacccagtgctagtggattaactacaacgtccaccaagttcaatcccgcttgacgaaccgcactcttcaaattatggatgattgttttaggtccggtaatcaatccgccgttcatttccaggcgaacccctaccatccctcttggatccttgataccgtcgaaaccgtccacaataaactcatccggaagcacatctaccacttcttgttccggaggtaaattatgtacagacgccgcattagaaacttcaatcacatcttgattattaatctcgcgtgaactatctgagatagcgatcattccccgtacgggttcgattcttaataaattagctggaataccagccactacatcttggatttgaatatttgctttgcgctctgcagtttcaatagcccgcttaatggcaatcgctgccttatcaatatcaacgattacaccacgattgactccatctgagggctctcttcccacaccaataacgttcatttgtcctttgacatattcagcaacaataacttttattgaggtggttccaatatccagtccaacgtaaattcctgaattatccataataaaggaacctcctagtcgtttaactgtttcatttatatacttatcacatatattaattagtttaccatattcattctttatttagaacgcagaattccactaaaattacagcttatttcaactaattgccggtcaaaatggttcttagtcttcttagtttccatctgggttctcttcatcagtcgctgtaaaaccttgcacactattttgcgtagcccgtcgttgttgggtttggtagtcaacgttgtcaattgaagaactacttgatgaatctgctgatttactcttcgcggaggattcaacacttaatgaatttttttcgctaccggacgattgacttccctcttccgtcgggtcagtcgacgtcgaactagttgacgattcatcactttgcccccgcggatacgagtatgcaccgacttgtaggtccacaattcccctttttttcatgcttgctgaaatttccgggtagtacttcattttcttagcaaaggtatttaaaaccgcatatacttcattaccgtcattcataaagaagtgcaactggtgtcgttcttttttggttgccgtatagtcaacttctgcaacgtcgttttgcacttcattaggtaacttcgcgtattcgctcaggaaacgtttcaaaacctgattatctttaaactggcggaaaaccgggtaatcaccatctggttgggtagcactttttttagataccgtgccgtcttgtcgaactgcgtagtagtatttgttgcgcaccacgtatcccattacggcgttttcacgcactttaattttgacgttacctaataacgagaccgagatttgagcatcctttaaatccggtagcttgtgaattagccgcgcttcgtcgccccgttccttaaaccaggtcgccggaatcacgtcatttttccttacggttactttctttaaaatgtcacttttttccacccgtttattcccctgcacggcaatggtttgcacccggctaatgggagcgcagaggtagatcgtaattaaaatcaagatcccaatcaagctaagcaaaccaattttaattcctttaccaatgtgtaaaggctggcggactttcttttgagttaacttattacgctttttccccgggtgcttttttgcagtaccacgctttgcgccacctaatttagaactctttttagtccggttacgttggttatgctctttttgataacgggcccacggggttagattttcatcatcttttttctttttcattggcatcacccgttaagctttgattactgatttcaaaacggcgtacaatttttctgctgcttgcggctgtcccaattttttagtattttcggccatctgcttacgtttttggtcatcgagcatcaaatcatccaacttagttaacagcgtctttgaagttaactcattttccgtaatcatttctgcagcgtgttgatcgactaaactgcgcgcatttttagtctggtgatcatttgtgacgtacggacttggaattaaaattgacggaattcccagggaagtaagttcggctaagcttgttgctcccgcgcgacctaccacgactgccattcgaggaagcattgccggcatatcagcaatgtacggtagcaccgccacttttcctttataaggagttaggtcaacgtccttagttaagttatcaaaatgaactcgcccagttacgaaaatcgtttggtaattacgttttactaattcattcaaagattgcatggttacttcgttaattttttctgctccacggctaccgccaaaaattaacacggtgggcacgtcatcttttaagccaaattggtttagcgattgcggagtaattttaactacttcggttgctcgcggattcccggttaaaaccactttttctttgggaaattggtccgctgctgcttcaaaggaaattgcaatcttcttaacaaacttacttaagaacttattggtgacccccaccacgctattttgttcgtggatcaccgttggaatccccatcatgctggcggcaaatactaccgccccactgacgtatcctccagttcctagtacaacgtctggtttaaactccttaatcattttacgcgccttaaccacgctactcaaaaacagtcccactgttttaaagttttctaatgataatgaacgtttaaatccttgaattttaatcgttttaaaatcgatccccgcattgggaacaattttgttttccagtcccttatgcgttcccacatacagtactgctgaatcgggttcgacttcccgaacttgtttaataagggcaagtgctgggtaaatgtggccgccagttccgcctcctgaaaccatcagtctcatttagtgacatctcctttttccttcgataaattttctacggcggtgatgaattcatcgccccgttcttcaaaagtttggtattgatcccaacttgctgcagctggtgaaagtaaaattacgtctccaggttggctgtcttcaaaggcgatggcaaccgaattcttaacccgcgggctgtccttaacgactttaacgcccgccgcctgtgcagcttcctgcatatgcgcagcagtttgcccgttaacaatcacttccttaacgtggggcttcaaatcagccaccagtcgggtgtagtcgtctccccggtctaaacctcccgcaatcaagatgattggccgttgaaaggcctttaaagccacctgcgttgcttcgatgtcggttgcttttgaatcattatagaattggcggccggctaaggtttttacgtattgaatccggtgtttgaccccgctaaaagtttggagaacctgcttaatatgtttattagcaaccccttcaattttagccacagcaattgccgcgagcgcattttcaacgttctggtccccaggcaccccgatttcatcggccgccatgatccgttcatttttgaaatataattgaccatccttggcgtaggccccgttttcaactaaaccttggcgggaaaacggaacgacctgcgccgcagtccgttgcgctaattgttgccattcaggattatcccagttaatgacaaaataatcatctttggtttggttctccgtgatcctcatcttgtcattaacgtaattttcccgagttttgtgccaatctaagtggttagagaaaatgttgttaaccacggcaatgtgggggtgcaactggtcaatcccggcgagcataaagctagatagctccattacgatctggtcgttagcagtagctttttgcactaccgtagtcgcaggaaccccaatatttcccgccacgtatgctgcatgatgatcttgctgatctagcattagttgaatcatcgtggtaacggttgtttttccgttactaccggtcaccccaattaattcgctgtccatcacccggtatgccaactcaggttcggcaatgattggcacgttttgcttcttagcagctaccaaaactgggtttgtatacgggattccgggattcttgacgattaattcaatatgatgctgagccaagattccctttggatgactgcctaaaatcatttggacgtcagcctttttaagttgttcaatcagttcttgcggttgttctgcttttgcgtcatttactaatacctgcgcattcagtttacgcaacaaaagagcggcactaactccgctctttgccatccccaaaacgagaatattcttatttgctaaatcctttatctctgctaatgctttcattctataatctccctaccaaatgctaattaacgtaattagcgcaccgatcaatccaacaatccaaaagacggtgtcgactttccattcactccaacctaacatttcaaaatgatggtgaatgggactcatcttaaaaattcggcgtccggttagcttaaaggacagcacttgtaaaattacgctgagggtttccaatacgaatacgattcccaccagtagtagtgacaattcttgattcaaaatgatggaaaccgcccctaaggcgccgcccaatgctaaggaacccatgtctcccataaagaccttggctggtttgtggttaaatacgagaaaggctaacattgcgccaaccaccgcccagcaaaatagcatcactgcaggttgattgagcttcgcagcaataattgcgtaagtagcaaacgcaatcgtcgataaaccagcaactagaccatccagtccgtccgaaaggttgactgcattggaaaagccaactaaccagaaaattacaaatagtgcgtaccaaccgccaagatgccaaattccgattccggggattgataattgcaaggctacgccagtttctttaatgacccagtaaaaaatcaatccgccaatgatttggccaagcagcttttgccaagctttaaaaccttcgttttgccgctttaataatttaatactgtcatcccagcaaccaatcaaaccgaattctaaaagaacgaagaggagcatcactaggttggtggtcaataaatggaacgccaacccgctgatgatcgcagccgcgataatggccacgatgaaaactagtcctcccatcgtgggtgtcccagatttcttttgatgccacttggggccttcttctcggatcatttgcccttcgttccgtgcccggaaataatggataaaactgggcatccctattaaagtaattacggcacttaagccgcccgctaacaagttactcatttttcttctcctatgctattttttgagtgttaccgtcatggtcattcctgattgaagcgtagttcctttggcgaccgactgaccggctacaaaacctttaccttggtacttaacttcaatgttaaacattttagcaagtttaatcacgtcgtttttggaccatcccgtaaggtccggcatggtaaccgttcctccggtattcaaaagaatccgctggcccactaacaacttactaccggccgattccgattgtgccaaaatccggcttccattacctaaccgaaccacagctacgttatttttacccaattccttcaccgcgtcgtcagcatctttaccaaccacgtttggtacttcaatggaactatcaatgtccgtattcgcagtggatttatcttgttcaagggcctgcttcatcactggcccaaaaatttcatctagtaactgggttgccgtcttatccgcaggcaagtttggttttttcatcgtaatgtacatgatgtacttcggattttttgcaggagccatcgcggctaccgaatacaggtagctgtcgtcaccagaagcgtagttcccgttacttgcaacttgcgccgtaccggtttttgccgcaatccggtaacccttcagcttaaagtcgctcccgattccgtatggtttataaaccacatcttgcattagcttacggacttctttagtagttttagctttcactggacggcccacttttttggttttcatttggtaggtcgtttttcccgtgttggggttcaccacttttttaacaaactgtggcttcaccatttgtccattattagcaatcgcggtgaaaccttgcaacatttgcatggccgtcacgttaattgcttgcccaaaggcggtgtccgcttgctcaattggatagtcaaactgcatgctacccttggattcgccttctaaaccagagttagttgattctagtaggtggaatcgtttaatatacttcttccaagttttggcacccatcttttgttccaaatgggccattgccacgttactagaaagggcaaatcccttttcataggaaattaatccccagccttcccgcttccaatcgggtactacctgtccatcgatttcgtaggtacccgacttatacaactcatctgggtcaaaattaccactatcaattgcagcagcggtggtgaaaatcttcatggttgagcccggttcataagtatcctgtactaaaccattattccaagctttggacaagcctttcttagtggaggcgttaaacgttggacgttgggtagttgctaaaattgccccggtcttagcgttcatgatagttgccccgatcgactcaggatgtgcctgagactgtactttgctgaccgtgctttccatgatggtttgtaaccgttgatctaaagtggtgtagaccgtgcttccatcccgcgccggacgttccacctgtgatcccggcaattggtaaccaaatttatccttttgtaaggatttttccccatcggttcccgtcaactgcttgttcaacatcttttcgagccccataactcctgaaagttgcgtggtatcgctccccttttcttgagactgttgggcaaagccgattaagtttgaggcgaaaaccccgttaggatataagcgcgcttcggaggaaacgaagttaatcccggttaatttgtatttttcaattttttccttagttgctacggaaatgttatttcccgcactcccaaattccacttggaaagtcttgggattactaggactcaaagtttttaacgcttttttgtagctaattggtagatacttgctcaatacacgcgccgttttctttttatcggttacgtacagcggttggcgatttgggcccacctgctttttacttaccaccgcgtaaatcgaatatgtactagtatcctcggcaatcgggttcccgttggtatctaaaatggaacctcgtttagccttaatagttttattgtccgtgtatagccgtttggcttgactgctgagattgacgctttcaatcgtcttattaatggcaatataagaaaagcgcccaacaatcactataaatactcctgctacaatcaataaaaaccattttccaaacatcatccgattgtgctgagtttccgtagtattagtcgttcgcttttttgggttcatcatttatttacattccttatattctctgaattaagagaaaggcctgcctttttagcaactttatttagccgattttggtcggataactgattaacctcttgtttcatagttgtatttttgcttgataaggccgttgtcttctcttgtgttgcttcaagtttatgctgtgcattagataaacttattttaccagaaacaacggtaagcattaaccctaccaaaataaatccgcaaaatgttatcaaaaacttttcaaacttcgacaagggcagttgtcgagcagttacaacctcccgggctttttttaattcttttttccctactccggcaattgaagttggttcgttaatcattcttgaacgaccagcataatcattattttgagccattggcgtctacccttcctgtaacttttcaataattcttaattttgcactatgtgctcgacgattttcctttagttcgtcctcagaaggaacgattggtttacgattaaccaatttaaaatgcggttttttatcagctggaataactggtagtccagccggtaaatcaccaatttctgtcttttctttaaacatgcgttttactaagcgatcttccagcgattggaacgtaatcactgaaatccggccgttgtcgtttaacaaatctagggcttgttccaatgattcttctaaagcccctaactcatcattgaccgcaattcgaattgcttgaaacacccgtttagcggggtgaccgcccgtacggcgcgctgccgccggaattgcttctttaataatctcgactagttccccggtagttacaatggggtgttgctcgcggactttttctattcgccgtgcaacttgctttgcatacttttcttctccataacggaagaaaatccggaccaaatcgttgtacgaccattcgttgactaccgtttgggccgttaattcttgactctggtccatgcgcatatcaagcggtgcgtcatagcgatagctgaagcctcgctgggcatcgtcgaattgcggtgaggaaacccctaagtcgtataggatcccatcaacgtgatcaattcctcgttggtttaattcattttttaagtttctaaaattagccttaataaaggttacttgctgatttgctatgtatggtgccaaatgatcttgattgtaatcaatcgctgtttgatcttggtcaaacgaatacaaatgacctgtagagcccagcttagataaaatcaactgactgtggccgcccccgccaagggtacaatccacataaacgccgtctttgcggatattcaatccagcaacggtttcttccaatagcacggtggtatgtttaaattctgtcatttatatcacaatccaaaatcaattaaattttcggcaatatcgtcaaagttcgcttcagtttcttcgatagcagcttcccagcgggccttattccaaatttcaattcggttagaaacccctactaaaacacattctttttgcaaatctgcgtggacccgcaactttttaggaatgataattcttccctgcttatcaaagttacattgggctgcatcagcaaacataaaacgaacaaacgcccgattatttttcttattagatggtagttgactaagcttttcttcgacgagtttccattcactcaagggatagccaaataagcatccatctagccctcgcgtaattacgaaatcctcgcctagttgatcgcggaatttagatggtatgatcaaacgtcccttgttgtccaatgaatgttcgaattcacccatgaacatgaaaccgcctccgtcaactaaatctataacaatattaccacttccccccactttccaccacttaattacaaatgttttttcccaattttttattaaatttaaacattctgtaaaagcttgatacgaatagggttttcacttgttttacgaggtggagaaaaagtgggggattcatccctggatttgcctaaaaaaattacttattgtagaattgctgtaaatcatgagaaagtagtgtttttaaatgtataataataaaaagaagaaaaagagcggtctgcaaaaggtcatcatggtctttgtttggattatgattatcttgaccctaggcagcgtactttacgccccccttgcccaactcctgggtgcttaaacatctagatataaaagagacgagcgtgggacaaaagtcgggtagtttgcgagcattaactgaaaattgaccatgatgcctgaattgggcatgatgatcaatttttggttaagcggaaccaactgcttttggcacccgttttggctctattgaagtcaaaatgccaaaataaaaacggttcatgaggaagtttcacctcatgaaccgttttttgtttagagacttttggcacagtcccgtctttttgaaattgtcctcaaaacactaaggatagctattgctcatctttagtacggtaaactttacgcggcttactaccttcttgcggaccgatcaccccgttttcctcaagctggtcaatgatccgcgccgcccggttgtaaccgattcgaaacttccgttgcaacatggacgtgcttgctcgttgcatttccgttactaactcaacggcttccggataatattcatccaattcgtcagtagcttcagtttcggcaacttcttgatccgtaacgtttagttgatcatcgtattctgcagtttgttgctgcttaacaaaatcaacgatttccttaacgtcgtgatccgagatgaatgctccttgaacccgctctggcttgttcttgcccattgggaagaataacatatctcctcggccaaggagcttttcagcaccgttagaatcaataatggttcgtgaatcggttcccgaggctacggcaaacgcaattcgggaaggtacgttagccttaatcaatcccgttaccacgtcaaccgaaggccgctgggtagcgataatcatgtgaattccagcagcccgcgctagttgagctaaccgaataatcgcatcttccacttcgttagaagccaccatcatcaagtccgctaactcatccacaattacaacaatgtacggcatttttggccgttttccgccgtccgctgcattttgttcctcaatgaactcgttgtaacttttaatattacgctgattcatttccgcaaacaaatcatagcggtgctgcatttctgcaaccactttatgtaatgctttagcagcctttcgcgcatcggtaactaccggagttaataagtgaggaatgtcattgtaaattcccaactcaacctttttaggatcaattaaaatcaacttaacctcgtcaggtcgggcattcattagcaacccggtaataattacgttaatcattaccgacttccctgaaccagttgccccggcaattaacaaatgttgcatcttaactaagttagcttcgactaggttacccgaaacgtcacgcccaatgggtacttttaacggatcatctgggtgcgctggttgggattcaatgatatcacggaacgaaaccgttgatatcgtccggttagggacttcaattccaaccagtgattttcctggaatgggtgcttcaattcgaatatccttagcagccaaagccaaagctaagtcgtccgccaaaccaacgattttgctaaccttcaccccaattgctggatgaatttcatattcggtgactgatggccccattttcacgctttctaccgaggcgtccaccccaaaactattcaaagtgtcctgtaaaatttgggtgttctttttgattgaatcgtattctgagctttggtcagcttgcggaatttcggttaacaaggttgaagatggcaaccgatagttaggattcaacttattctcgctttcaaatcccacttccgggttagcggttggttgcttttcctgattcttaggcttccgcggatttcgttggttattggttgaaatctcaatcttaggctccgcggggtgctcaataccacgagtcccatcgaccaccggttcttcggtagttggctctatgcgcgtcccttctgacttaacggactgtttagtagcaccatcctccggcggcttcctctccatgggggttcgtttaacatccggtttgctaatcgtaaagtccagctgttcccaccagtccaaaacgccgcgggttaatgcccgaattccttcaattaaccgctgtgtaatccaaagaattgcgagacccgtctttgatagaacttcatcaaaaggaatgccaaagaggattactaagcccaccgtcatcaaaacaattgctaaaatggcgctgccaatctcactcaacaagaagtgcgtgccgctatagaagaccgcccctagcaaaccgcctccaatatcgttagtggtgatttgttctaaaaaggatcgttcgattccctcaacggtccgggcaacaaacccactttccaaatttagtccgcttgcaaaccggtactcgacccaaagcaaataaccaatcatggttaagctaagcccgattacccggtcgctagcgcctttaaaccgtagttcccgtcccataaatagcaggtagagcccataaaaaaatagcaatacaaaccccagcgggcttaggctccccacaaaaatccgaaacatattggcaaccagcattcctaagaatccccggccaaaataacctaaaagggcaaccagtacgtacgccagccccaataaattttgggtagggaggctttgttgcttctttcgtttgcgcgttgttttacgccttttctttgcttttgccatatctaaccctatttcaatttatcattttcgtattcatgactaatttctaagttaggaaactcctgttgtcgtaaaacttcgtatatcacaattgctaccgagtttgataggttcaatgcccgaatatgttggtcattttgcggaatacggattgcacaatccgcatattggcgcataaaggcctccggtagtccagtcgtttccttcccgaaaagaaagtagttatccacgtcgtcttcagctccagtataatcagcttgagtataagcttttgaagcaaatttagaaaccacaaaaagtcgttttcgatccttaacggtcgctaaaaaatcaggtaagttatcgtggtaaaccaccttaacgctatcccaataatctaagccggcccgttttaaagtcttatcactgatttcaaaacccagtggcttaattaaatgtaataccgcgttagttcccgcacaagttcgggcaatatttccggtattagccggcattaacggctcaaataatacaatatgatttgtcatttttaatctccatttagtcttaaaattaaaaacgtagacactcggtattgcgcggcgagtatctacgttcgtgaagtccccgaatcgtttcaaacgaaatcccttcgatatccgcgtaacacgggctccatccgcatactaacactacttttttcattctgcaaattagctattgttcgtaaccgcctacccgacgcttgaaaagctcaaaaccgtggataaacagtacctttaacactgcataagcaggaatcccaaaaatcacaccaaccaaaccaaacatttgtcccgacgctagtaaaaccaccaaaatagttaccggatgaatcgctaggttgcttcctaaaactaatggtgaaatgaaacggccttctaacgtttgttcaattgcaaaaacaatcagcaccttgaccaacatcactggcgagatgaacgcgccaattactatggaaggaaccattgctaaaaacgaccccaagtaaggaattaaatttaaaaatcctgccgcaactgcgagggtaagtgcaaattttagcccaattactaagtaaccaataaaaaacatcagggccacgaagaatgcgaccactaactgtccccggatatactgacttaattgggtattaatttcaccaaggatctggagaaattggggtcgataccgtacgggaaaagccttcgctaggtattctggaaggtcatgtccatcccgcaataagtaaaacaggataaacggcatggtgatgatgccaatcaccaccttcgtaattaagctcaatacgcttcccaacgaagtgaccgtattattggcaacgctcgttactttctttgaccacgattgaatagtttcgctactaactccgtggaattgcttttgaaaatcacctaagcgtgggtcatttaagataccattgattttttctatagcagcgttccaataatctggccagttttgaattagcgctgcagtttgttcccgaatcacgggaatcaccgccactactccagcaacgattaagatagccaccccgacaaaaataatactgatggaaaccacccgtttcattttaaagcgactttctaaccgatcaaccaacggattcaacaagtaatacaaaacgcccgctaaaataatgggaaatcccacaattttaaagaagtcttccaacggcttgaaaatccaggtaacttttgaaaacataaataaaattagtaacactaataacacgatgatcaaactaacgaccggccggttattgagtactaactggttaaaccacgttctccacctaggtactttaggcttgcgttccatcaactttcaccgtccaatcacttgtattgaatagtttcccccactttaaagtcgggaaaaacatccgggctaaggtaaattgcgctcgccaacggctgttcaggtacctctttaaaaaccagcgtcgtgtgaccaatgctttgcaaattttgatttaccaaactaccaacaaatttaacgtcataggtttgttcaccaattacgatttgtgaacccgcttttaagttaaattgctgatcattatctttttcaatttcttggacaaccgcaattttctttaaatctggcgttgcggtttcgtcaaacaaaattgctaaccgatcttgcttagcaattgcctctggtccaatactttttaccttagctgaaatcatttaacacaccccttactcattatgattttattgtaccatagtggggttctcacaccttcagaaaacgtattcaatccgtgaaatatgctatacttaacggtgagttttacctagagaggagcacaagtgctatgattgaaaccattttattaggtacctacaccaaacaaaccagtgaaggaatttatcaagttgaacttgatacaacccaaaaacaactccaaaacttacaattagttgctaaagtagaaaacccaacctatctaacggtaagtcaacagcaaatgctgtatgctgtcgatcgttaccaagatcaaggaggtgtttcggtaactcaactaggcgaccgttctcaagttttacaacatttagtacagccgggaaccccgcctgcttacgtaaccgtagacgaacaacgtcacctagtttttgacgctaattatcacgaaggcaccgttcatgcgtatcaaattcaagccgacggaacccttaatttagcacacacctttactagtcaaggctccggcccgcgtccagaacaaagtgaagcccatccccattacgtagatcgtactcccgatgagcaccttgtggtctgtgatttaggttgtgatgaagtatttattttagattatgatgcagccaccggcttccaaacggtttctaagtacgaaactgctccagggtttggcccgcggcacgttgtatttaaccaacaaggaaacacggcttatttagttggtgaattggcaagtgaagtagaagtgcttaattaccacaatggtgaatttcatcacgttcaaacgctaaaaaccatccccgacgactgggagcaacataatggagccgccgcaattagaattactagcgacaaccgtttcgtttacgtatccaaccggggccatgattcaatcgccgtttttgcggttaatgacgatggcaccctcgaactaatccaaaattgtgccattgcaggtagcttcccccgtgattttgccctaaatgctgacgagcgttttcttgtttgtggcaaccagaccaccaataacttgagcttatttgaaagaaattccgagaatggtaaacttaaacttattcaaaaagactttgccgctccagaagtggtttgcgtctactttaaataaaaacgaggttaattatgcttaaagaagttccagtagaaaattacactgacattccccgggcaattgccaacggggctaatcgaattgagctttgtgacaacttagcggtgggcggcactaccgtcagtcacggggtaatggcggaaagccagaaatacgctagcgaacatcacattccggttatggctatgatccgaccccggggcggcaactttgtttataacgatattgaattaaaaatgatggaagccgaccttttccaagcacaacagcttggcgttgacggtgcagttttcggtgcattgactccccaaggaaccattgacgaagaggcaatggaacaattaatcggcgctgccggtggtatgcagatcaccttccacatggcttttgacgcgattccggttgagcaccaggccgctagtattgattggctgattgaccacgacgtggatcggatcttaacccatggtggtccgttaactaaacccattgaagatacgcttagccacctcaaggaaaccgttgaatacgctaagggtcgcatcatcgtaatgccgggtggtggcgtcaccgttggtaacgctgctgaaattgctgaacaacttcacgttcccgaactacacggctcgaaattagtttaatcctaaaataaaagcatcgtggtaattcccctgattcatggaattatcacgatgctttttatactattaattaacctgtcctagtgaaagttcgctaagcaaattgtcgcaatgttaaagtaaattaaaattgaaataatatcactaacggtggaaatcagtggtccgctagctacccctggatcttgacctaacttttccagaataatcggaattaaactacctaccaaattagcgataaaaatagctccccacatggctgccccaacaattatgccaagcattaagttgtgttgccaaagtaatactacgacgaaaatcactaaaccagtaagtacactagttaaaagtcccgttagaatttcatttaaaataattttaaatccactattgtcatcttcgtcatttgccaaccggcgcattgcgaccgccaaactttgagtacctgcgttaccagccgtcccggtaatcaaagtgatgaaaactgccagtacgccaaatcggtcaagaaccccttggaattggctaattacgaccgcactgatcaatcccaagaataacatagttactaaccaaggcatccggctcttgaaagctgcccaaggattttccgacaggtcttccgtaccaaccccggccaaccgtgaataatcttgggcggactcttcgtcaattacgtcgatgatgtcgtcaacggtaatgattcccaacattttattgttcttatcgactaccggtatcgcaataaaattgtagtcccgaatttgagtggcaatctcaacttggtcttcgttatccaataccgacaccacgttggtattcataattcgtttaataaatacgtcgtcaggattaacaatcaagtccttaacggagattaccccaattagttggttagattcgtttactacgtaaatgtacgaaatagtttccgcatactgggcttcttgcttaacctggttcattgcggaaccaaccgtggcatcgaccgctaccgaaataaattcggtagtcatcaacgctcccgccgtcttatcttcgtattttagcagctgccgaacgcgagccgcatccacgggttgcatatacgatagtaacttgtgcaacttatcattgcgaaccgcccccaatacgtcggcttcgttatcatcatacatcccgttcaacaacgctgccgcatatcgcggagtcatttcatctaagtattccgcaatcaaatccggctcatcatcgatttcgtcaaaggcgtctgccagttcatctgggctgaggtattgataaaccagttgccgttcgggaccggttaactccccaaaaaaacgcccctgatcataattatgtaagtcaaggaaatcttccttgaaactctttgcgtcttctttatttagttctaattttaatttatcaaaaatcgcttgagtattatccattattctttatccttttctttcttccaatattcaagcatgtcatttggaattggcgcttgtacgtcaattttctttcctctaaacacattctcaaacttcaatgaaaagcagtgcagcgcctgcctttgtaagttcctaaaggaagtttcgttataaagcggatccccaatcaacggatggtgaagttcactaaaatgaacccgaatctgatgggttcgcccagtgtgtaactgcactttcaacagggaatccgtagcagtctgctccagcacccaatattctgtttttgaaggtttcccattgccagcgctagccaccctgcgcttaataaaggaagctgggtccctttcaatcggggcgtcaattaatccgtgactttgtgcaaaccttcccgtcgccattgctaaataatatttttgcacccggtgttgtcgtaaatcttggtccataattgtatgtgcaaaccggtgtttggcaaacaaaactagccccgaagtatcttgatcaagtcgggtcaccacgtgaacaacctgactttcataatccctttccgcgtaataattcttaacgcggtttactagggtatccgtttgatttcgggcggactgcaccgttggcaaaaatggcggcttgtttaccactaaatagtcctggtcctcgtaaatcacatcaattggttgacgagaccgaaccacgtgagggttccctggctctggcggtaattcaacggtcacttggtcaccagcagtcaccatcgcgttagttcgcttcggctgctcattaactaaaatttttccaccattaaatttaatactttttaatagtgctcgggaaatccgtttccgtgtcaaaaaagttcgtagatgttgaggggactcatcttgaacttgccaactaaatttcatctatttgaccaataaacgaattccgcacccggttccaaaaaccagtgtgccggtatttaagaaactttaccttaggaaccgcaattccataatgtacggattgcacgtttttatctaagatacctagccgatctgccgtaaaattgtaagttcggtgataacttggtaaaggtcgaatcgtaacggtctcatttggcgctaaaattagcgcagctcccaccgtccggaaaacccggttgttaatcgaagcaatctccgccatctgcattgcttctaactgcgggtgcacgattgctccaccaaccgaccggttatatgcggttgatccggtcggggtcgaaatacaaagtccatccccccggaaacgctcaaataattgatccccaattaaaacgtccgcaactaaagtaccgtttaatttccgtaacgtagattcgttaatcgccttataattagccttcgttccgtcggtatggatcacgtcaatatttaataacggatacccaatctcggaacatccatcgcttttcagcgccttaaccaagtcgtctaactcataatctcgccaatcggtataaaaacctaaatgtcccgtatgaacgcccacaaagcgaactcgatcaataattggtaagtacttctggattgccgatagtaaagtgccgtcgccgccaattgtgattaccaccgtggggtcttgatcatccaaagcaatgtgattttcccgtaagatttggctcaaatcttggccgacttcgattgagtgttcgtcacccgaatggtagattgctattttcattttattcatcacgttgttccctttgtgctaataaaatttgtttacgaatgtctgacatttctttgtctaattcgtacgacttaacggatgccttctgcaagcgagttcgtagctctgcagggaaattaccgttaaacttgtaatttaacgaatgttcgatggttgcccagaaattcatttctaaagtccggacttgaatttcagccaagactttcttttgcccggttaacatttgaactgggtattcaatcacgatgtggtacgaccgatacccactcggcttctcattttccacataatcccgctcttcaatcacggtcatgtcggttcgttttcggatcaggtcaaccacctgataaatgtcttctacaaattgacacattacccgcacgcccgcgatatcttgcatatcctgttcaattcgttcttctaaaatttggcgccgaaccatcttttctttaatactatctaccggcttcacacgcccagtaacgaattcaattggactttcttcgtcacttcttaaaaattgtgtgcgcattgctcttagcttaacctttagctctgaaacagcctgtgcatacggcaataaaaaactattccaatcttcaatcatacggatccccccgaatcaatttaacaacctcttctattttatcatagaaacacgctcaactattttaaacattctccagagtttttcaagcaaaataattgcttttatgccataatttgttaaagtataatcagtttgacttacgtattctttggaggaatttaaatgctggaaacataccttttcatcactccgtggggtgatgaatgcttcaaatgtgaaaaggagaccattcgttattttggccgtgctgaggaaaaagtagatttaaaaatcttcccggttttaaatatgcaggttgtcttaaactatatgaagcataaccaagtcaaaaatggtaattacaacgacctatttaaccgcatgtatttaacttgcctcgattacaaggctgcttgttaccaagggcgtgctaagggccgccagttcctagttgccatgcaaaagtcagtaatcgacaagggcgaaagctattctatcgaactaggcagtcaacttgctcaacaagttggtttagacttaaccatgtttgaagatgaccggcgttctgaaatggtccaaaaggaatttaaacatgaccaacaattggcccatgaaatgggtgccgaaagcatccccgctgcggtgatctttaacgtaaaagatgaggaatatggcattttaatggatcattatgattaccagaccctcgcttcagtttgtaaactgaaactagcatctgatgacgataattcatttattcccgagacactttagcttgtaagagcaccgaaattatttttctgattaatagaatttcaagacaaattctattcagggagttgtcttgaaatttatttagccagacttattctcataccacagcaaatttaaaggctggattaagttccagccttttttgtaaaatctttccagcaatttactttctcaattcattaagattacctttcaaagcatttattttggtagatgcatccggaaaccaagtagccgcctcccctcgaaactgccaccgttgctcccgtttaactatccaatgatgattaactaagtaattccaaaattcttgatccacctcttcactaatccaaccattaacaccgtttggttcttccagcataagtaaaatacaaatccgatttaaaattggcggactcaaatgccaaaaatccgtacagttttggggaacgtgtaccacccacggacaccctagtaaagaacggcccttttcataacaaagctgttgcaccttaagataacgttgatcaatttttgttcccaacacgtgtctttcaagttggcgaacttccctaattaagttcgttgaattagttaaagaatctggtttagtttgaatactaattttagaatcatttactagcaggggctgttttaagtaggtgattttgccaaatagttgccggtaaacttgataaaacaaccacggcgtattatctgctaaagcatcccacgctaaaaaccaccacccgtagcgcgtggcgtaccgaccaaacttttgcatcgtcgctagcagtcccttttccttacagtgttgcggtcctgcaatccagtaaacatgtttactgacttgctggtaatcgtatgttctttggcgaatttccgaaaccgtgatgggactacactggtattcaatcacgtagatttcgccatgtgcccgcaccaccacgtctccacgccgtttaatacttggaaaataatattccgtctgcacttctaagcctaatttcataaagtaatctctaagtcgtgtttttccaattttgtgccgtcgactttcttcgctccctaattttggcttattctcagctacatgagcaaaatacttatttcgataacgtcctgcacatagacgtaatggccggtggcattgtgggcaatagtatctgcccttagcaattgcagtagcggctttcaccaatttccccgtttctgttaatgcaaccttcattaaattcacctctattagcaaatacgcaagctaaaagagattattcgcggaagtaaatgtttttacgcattttcataaaaatagcagctacttttccacaaaaaagaggttaaggaaaaatccgttcagatttccctaacctcaaagccgttttctagctaatcgttacgctttaaaatagtgtttggctaactctaaagcagcactatcaataattgttttcccgtgttcacgaagtacttcgctagtaattgacgtttgatcgccatactcgtacgccaaagctaaattatccttgaccaactcgggagtattttcactcatatagaaaaccaactctaaatagtaactatctttatagcggtaaaggaccgaatccagaccgttcacatcactaatcgcggccgcaattcctggtaagccttcaaaatcgttaagtttaattacctttgtttgggtgtcgtcactatcgctgccataactattaaagtctgccggatctgcatcacggctcggattgctcatattggcatcttgtccatcagtttcagcaagctttttcttcaagaaatcagagacttcatccagctcttcgttactaggtgattcgttcttcgctactgatttcattgcctcttccattccgttagcggggtttttactaatatacaattctaagccattacgatttggtaaaacttggaaagttactgcatcattgttagcaaattgatgatcagtatctacttcttctaatacagaataaaaaaagttttctatttctttgtgattatcaagcaagtctaggaaggtaactcccctttcgctcaaatcttctgagctgatcttgactcgaatggtatcttcattaattcgttccatttccattaagcagcacctccagtttaacgaaactgaatgaaaagaacccactaatattagtatatattaggttccccacgattatcccataaattcattaaaaattccactttcatagttgattcaaccatttttggtctgtaatcaaataaaaatgaagaggggccggaaaaagtattttcctagccccttagtttgaactttacctattctttttaagatctcgtcagcgaaccgacttacctaattaatcattataaattagcaatcttttgtgcccttgccaattcaagctgtcttaccttacgtggtaagaagcgccgaatttcatcttcattgtatcccacttgtagacgcttgtcgtctactaagattggacgccgaagtaacccagggttcttttcaattaaatcgattaattgttttaaagaaagatcgtctaaatcgacatctaattcttggaaaacctttgagcgccgagaaacgatttcctctgtaccgttttcagttaactgcagaacttgtttaatctctgcagcacttaaaggttcagaaaaaatatttctttccttatattgaataccatgttcttcaagccatgccttagctttccggcaagatgtgcaacttggtgaagtatataaattaaccataacgtatgtcccccttaacgtcgttaaatattacctgtcttatggttaatattatacagttttatcgggtgtttgtctagaactatttttaaatttacttataaaaaataactaaaaataatccttaattcgggattaaagtttttacttatcgacctataatacttttaaagtaaaagtgttcaatacacgaaggagctatttttaaacataaccttataccaacaaaacacttttacttataacaaaacccttataattcgataacttttccggtagccggtaattcaatttttgttggatttgctgaaaaatgttgcgtttcttctaacattatttttggatcaatctttggcgacaagtgactaattattaaacgttgggcatgtgcgttatcaaacaattgcgcagtttctttagttgtcaggtgccatttaactccttgataatcactcaaaaagttcgtatccgtaattaacaaatcactattctgcgcaaaatcagctaattgcgcgaaataacgcgtatccgacgtaaaggtaaagactttacccgtggcaacttcctcaattttggtggcaaatgccgctaccggatgctgtgtttttttaaaggaaatcttcaatccccctactttaattacatcatttacttgataactaattcccttggaggcattgggccaggttagtgcactaaaatttagcggatcttctgtatgtccataaatcggcaacgttgcaacttttttcttctcattcaattgccaacggtactgtaaaacacctagatcggctgtatgatcgtgatgataatgtgtgagtaaaaccgcgtctaggtctagtggatcgagatgcttttctaattctaagagagtagccgatccagcatcgagcaataaattagtatctttggtttgaactaggtaaccggtagtccccgtatttttacttggataaccaccatagtatcctaaaattgtaatcttcataaaatccctccatgtgacatcattaacccattttaacgcaaattaatatccttatcgaactttaatatttttagtttgtccattgtagcattataatggttataaaattggaggtgtttcaatgtttaaaacaattactacttctttcggcagctctgccgttttaaaatcgattcaaaaaaaatattcttcgcgaaagttactgctactagctaatcagaacgataacgatagcttccagttagtcgatttttcaaatcaaccgacgatttttaaaactccccagcgctacaccgtcttgaattcttttgattcaatacaaaagaactcaatttttacgtactactttttcgaacttagtacagatgcgttagatgctttcgatagtcagattgataaccttgcaggcaagaccgccactaccctactgaatttaaagccgcttgatcaaaaaccatataatcgagcaattttagaaatctcccaaaatagtgcggtcccagagtccctacaagctcttataagtaaataccgtaatcaaaattattataaaactaattatcaggttgtcgggtaggtgttattttattacttttacagtatactggtatattgaatacgaagggagttgaaactaatctttcctaccaagaaaccacaaattcttatttataacatcatatttgacttgattgtaggaatcttttttgtctactacttgaaagtttctgcaaatttgtcaacttttctacgtgttattttaatggcttttgcagcttatgatttcaccgatatgttctttagcatcaaattacttcttgaacaacgtcggcgtaataaacataaatgatgcattttaaaaactgatctcttcctatcgattattatgtctttagggagggatttttttgctaactaaccaactgtaatcttaccaaacgcccctaaacaggattactccacaacccaaacaaaaaagcctaacccaaaatgagttaagctcttatcgtattcgatcaaaaggcggtagacggatttgaaccgacgatgaaggttttgcagacctctgccttaccacttggctataccgccatagcaaataaaaaagtgtaatcaaccgtgtaaaaaatacacgataattacacgaaacaaactttaattattttaatgcctccggtgggggtcgaacccacactcccgtgaaggaactggattttgagtccagcgcgtctgccaattccgccacagaggcaactaaaaaatctaacaaactgagttccaattacgaactcaaagggcggtaggtgggaatcgaacccacgcgtgccggagccacaatccggtgcgttaaccacttcgccactaccgccatcatggcagggatagtaggagttgaacccacactgacggttttggagaccgtagttctaccattaaactatatccctatcattaataataagtgactgttattaaattaagtgaactatactgttcacaatggcgcgggacagaatcgaactgccgacacatggagcttcaatccattgctctaccgactgagctaccgagccaaataatatatataaaatggtgcaacggtcctaacgagactcgaactcgtgatctcctgcgtgacaggcaggcgtcctaaccaactagaccataggaccaaaacacttttggaatggaggatacagggctcgaacctgtgacctcctgcttgtaaggcagatgctctcccaactgagctaatcctccaaaatgacccgtacgggattcgaacccatgttactgccgtgaaagggcagtgtcttaaccacttgaccaacgggtcagatcatattatacggagagtaagggattcgaacccttgaaacaggctttaacccgtttacatcatttccaatgatgctccttcggccaactcggacaactctccaaataaatgagtgttctaataaagtaaattaggaaactccagggctaagagtaagtgttttttctataagaagtgaagcggttacttgtattttatttttataagctgtattgttgctgtgacgagtgatcaaaaaggaggagtaataatgtataaagctagtgaacagcgttatgacaatatgatttataatcgggtgggtaacagtggattgaagttatccgcgattgggttaggcctttggaataactttggtagcgtagatccgttagaaaatcaaaaggaaattctatttaaagcttttgacctaggaatcacctactttgatttagctaataattacggacccattccagggagtgccgaagaaaattttggacggattatgaaaagtgatttacaccactatcgcgacgaaatgataattgccagtaaggcggggtttgtaatgtggcccggaccttatggaaattggggatcccggaagagcattatcgcgagtgcggaccaaagcttaaaacggactggtttagattattttgatatattctacagccaccgtgcggatccgaagactcctgttgaagaaacagcattagcattagaccagctggttcgttctgggaaagctctttatgtgggaatttccaactataacggagaacaaacggcggcaatcactaggattttcaaagagttacgaacaccatttattattaaccaacctcgttacaacatgtttaaccgggacgtagaaacggacctcttccccgttttggaacgcgaagggaaggcggcaactagttacagttcattgtcgcaaggattgctaacggataaatatttacaaggaattgacgaaaattcacgcgcaaagaagcaaaccattccgttcttgagtcctgtacaagtggaagagacccttgaaaccgtcaaaaaattaaacgaagttgcgaaaaagcggggacaaagtttggcacagatggcgttggcgtggaacttgcggaagccagtggtagcaagcgtattaattggcgcaagtcgggtacagcaggtaattaacaacgtcaatgcactcaaaaaccgcgactttactgatgacgaactcacgcaaattgatcaaatcttagctgcacaaagtccgattgattgggatgcgcgttaaaccgcgtctggtagcgtttcgtttaatcctactgaaaattggtgtagaatactacgtgaaaccgtttcccgtaacagaatgaaaccaatttggaggataattatgcttaaagaagcaattgcagaaaagttccatcaaattttcaaaactgaagctgaagaagtctatttttcaccaggacggattaatttaatcggtgagcataccgattataacggtggtcacgtctttccttgtgcgattagcctgggaacttacggcgcgtaccgtggtcgtgatgatacgcaggtgaagatgtattcaggtaacctcccggatactggcattatcgaatttgacgttaacgatcttgaatacgatgcgaaatataagtggagcaactatttacgtggaatgatgctagaaattcgcgaactctctcacgattatgatcacggttttgaattgtatttggaaggtgatctaccggatggggcggggttgtcatcatctgcctcgattgaaatgctgatgggcaccattttaaacgaccagtttaacttgcggattacgccgattgaactcgtcaaggcggggcaacgtgtcgaaaataactatattaaggttaattcaggaattatggatcaatttgcggttgaaatgggacggcgaaacgaagccactttcctagataccaacaccatggaatatgactacgcaccgttagatttgaataataacgtaattttgatcatgaataccaataaaccgcatgaattagttaattccgagtacaatacccgccgtgcggaatgtgaagaagcgttgcggcggttgcaaaccaaactaaacattaacgcactaggtgaattaactaaggatgcgttcgaccagtacgcctacctaattaacgacgaaacgttgattaagcgggcccgtcacgcggtttttgaaaatcagcgaactatcgaagcccgggaagccctcaaacaaggcgacctgaagctcttcgggcggttggtgagtgcttcacacgtctctttacaattcgactacgaagtcagtgctccggagttagatatgcttgtagatgaagcttggcaatcaccgggagtacttggagctcgcatgatcggcggcggttttggcgggtgcgcaattgccctaatcgaaaaggatcaagtcgacgagttagtaaaaacggtagggcaaaaataccaagaccgttttggctatgcggctgacttttatgaagccaaaattgtcgacggcccgcataaggtttaaaaagatgctgtagatcgactaatttttaaaaactttataatttataccaaacggaaacttgatttcgagaaatgaaattcgagtttccgttttttggtctcattaatttgcgattttttaatggtaatctcattttaacggcaaactacacttttttgagcgaaaactgcagttttagaactaaaagtgtcccattatatttgcaaagtcggttacgtattataaacagtgaccaagggcccttggatcttttactttaggagattcaagctatgttaccaaaaaatcgcactttaaaagcaggattagaccacttattaactaacggaaaccaaaaaatagtgtttggagcactaaagaaactaaacattcgcccgtatcaaccggattttgaagattttttacaggaagcacggctaacctacgcccgcgcgtacgtccgctttccccaaaatctggcaagtgacttaaaggagtttcgggtatttgcctaccaagcaatctattggcggacacttaatttattgaaacgccagacgatggttaaaaactggcaaactgccgaactgtccacgaacgtgactaaccttccgcggcaataccgctgttcctcccgtgagcaacaggtgttagccgacgacttatttcaacgggtttacgcaatttgtacgcctccggaaaaacgttttttgtattaccggtacgtgaagcaattatcgggccgagaaatcgcccaacgagagggggtgagcccccagagcatttccaaacggcggcgaaaagttggtcaaaaggcgttaaagattatcgcagaaaatactaataattagttttaaggataaataaaagtcctagttatccggttttacgtaacctgggtaactaggacttttgggatttttaaatgaaaaaaggtggtggattcttatttttgtttaagaaccatacattttagggttaacaggttttaagtcaggagcttgaccttccgccttaggctctgcctgccacttgtattcgccttcgccatcaagagcttcaccatgtgcccaagcaccttggctactttcatctcccttagagaaattgtagaagtcgtaggcaatgtccttacgctctttttcgcgtgggaaatcgcttggcaccagaatcgttccaacttgttcctctagttctttgattgctgccgcccattgattttggtggtagctatcccgggcaagaagtacggctaagagatctttcacccctggatcgtcgaccatttcgtaaatccgtgccgcttgcaaacggccttgtgattctgcattaaggttggcgcggaagtcagcaagtaaattgccactagaaatgatgtatgctccgctccatggattccctacactatcagctggacgcggtcctaaccctgctacaatcgcatgttgtggattcataccggcaatcactgccccaactacgggatcttgttccattgccgcctgttggtcttcgacaggtgcatcttctagtagacgcgctaccatagtagctaacatttctacgtgcccaatttcttcggtagcaatgtcgaggatcatgtccttatacttagcttctccgcggcaactccagccctggaagaggtactgcatggccacgctcatttctccatattgaccgccaattaattcttgtaaatacttggcaaccgttggatcaggttgagtaggcttagcttcaaattgtaattctttttggtgtcgaaacataaaattcccccctattctttggtgtgatgccaatataaaggataggggggatgttttacaaatttaatgcttagagtttttactttaggttgctgaaaaatgtccagcaaaactaggtttgttgcgtaaaattaactttgccagctaatgcagtgaagaaggcccctaggtcaggatcaatttcgtcaccgtttccgccaccgccaccaccgtgggagccgctaaagaagttattcgcagcatcgtcaggcggcgctaaaggtgattgtaaacgtggatcaaccagattatgttttgcggaaaagtgttgcttagctagattttcctgtagccgagattgttgggttaactcttctactaaaacggggtgatcgctatttttagaatgagaacgttggttagcttttttagcaggttgctgattagcggtcgattgatccgcggatttgctagcggctaacgcgttcgtaaatataggtgtatcccgtttttgtaatccaacctgataagtagcgttgccggcgccaaattttagttggctgagtggcgttcctggcgaaactaaatcgtagccatgccgcaagaaacctaagatgtggtcagaaagttcaaaaggaacccgcgtattttgccaaccactgtaaatttgttggtcaaccacgtgaccatttccatcaacgaacgcaatggttaccgtgcctcgttttggagaagcagaagccgttttatgggaactagatgacgttccgtgcgaaggtttccgtgaacttccttgatggtcagaatggttacttgaatgatgatggctagccgcggaactcgaagaatccgcggaattgttcgacgaagccttaccgttactagagctagctgaaccaggttcatcagaatggtcactttggtggtcatccttaccagaaccattatcttttgaagaatggtcgtcaccggatgaactattatttgacgaagagtggtcgtcactggacgaaccgttatctgacgaagaatggtcgtcaccagatgaaccgttatccgaagaagagtggtcgtcaccggatgaaccattatctgacgaagaatggtcgtcaccggatgaaccgttatctgacgaagagtggtcgtcgccggacgaaccgttatctgacgaagagtggtcgtcgccggatgaaccattatctgacgaagaatggtcatcaccagatgaaccgttatctgacgaagagtggtcgtcgccggatgaaccattatccgacgaagagtggtcgtcgccggatgaaccattatccgacgaagaatggtcatcgccgctagatgaattatcgcctgaatctgatgaatcatccgaggcttggattaccttaacggtcaggttgtccgaacggctggcagcaagcctatatttgattttttgaagctgtcccgtagctaattgatatcccttaggcaagcgaacttgataaattcccacatcgttaataaagcccctgattttatcggtcgagaccgttttaccagtagtggcgtctacgtaactaactgtggcagttacttccgtcggatttttaggtagtacggtaacttttccggttccgacgtcgcccaacgtatagtgctggtggtaaacccagtaatctccgcccatatcgcttaactttttccgtaacgcttggataccgaggttgtttaaagtgtattggtaagtccccggtaaattggaatcctttttggtttcaatccaatctttttcaatggggactctgtcgactacttttccgtctgaatccgttagactgagtttcaatccagcaacgtgatcagcaagggtttggtcgtcagtataatactctgctgctggcaacgaaacgtttaaagtcgtatttacgtccattggaaagtcagaaataggaagtactccgtggatatttgtaaatgtaatacgcccggaagttttcgtgcgcactacttcgtggactaatttttgaataatcgttttggaaagggtagctccatagtaagtatgcccgtttaaattaatcggatggatagctcccgtattgataacttggtcgccaacggacaaagtataggttgcgttgaccggcggggagtccagcttaaacagcattactccttcagtatcgggagtgacagagcgatagcttcccaaatgattaattaacaaagagtaaatcctaccattaacttgcactgaccaacttttatctctgctggtgaacgtatttgtatcgtcgtcatagtaaatggagcttaagtcaggggtttcatcagcatgagcgattaattctgccaatggtaatcggcagtgtaaaaccgtgtttttaagcagaggggcactaacgatccccatggtagctaaggaaaaggcaaatgtcgaccgcaaaagagttgtgaactttttacttgaatttttattagacattctttgatttctccttaatcttattaatcattagtaaattggttggttaaataatgcaaaagcttttttagcccgaacattttcgatgatgtcccctaaattagtccagtcttctggtgtaggagggtcttcccaagttaattgaggttgctttacagattgcgaataaatatcggacacaaaaatatccgtattattagagatgtttgtctcaataataatatttgcatgatgaaatgcgtctaaagagttgattacatattcggtatataaatctccttgagaaaaatcaaccgccacgtaaactcgttcttttaataaacgggcggggatgttattgattaacgcaaacatataaccgtagtaaaggttaacccacttaggagcgtccagggtaatctcgtgttcagtctgaatactctgtaaaaatcgatgaattaggatgtcaaacgatgggtaagttttcccgaaaaacttgatggaattttcccgtacgaaagtagagggctcaatataaaatgaagttaattgaaggttaacgttaatcaaatcgtggcgaagggactcttcggtgtttttgtccaaagttgacgtaatggggtagtcctttagccactgaataagactgttagttaactgggttgctaaaggaaagttatttgatataacccggttgctagagtcggtaatgtaacccttcgcaagcaaaaagccgtagaaataactcatttcatacctatctagattaaaatgacggccgagaacgcgttgtaaacgttgagacaactgctgatattggtcgttactttcgtcaacatcaacggttaaggtttcgttgtagttttgattacgatgtcgaagaatccagattcgcaaaaagattgacaatttaaatttttgacttaatcgtaagggatgcgtgaaataaggttggcatgcttgaacgatttggtcaactaggtcacttagttcaggaaatggcgagtcgagtccgttgtaaaggctatagtaaaactgaaataaaagtaaccgctgatgaaattcttctcccacttttccatttttagggttgtccttagaataattagcgatgattttattcaacattttaatttgtcggtaaaatactgatcggctaattggagtgtcctgtaagtactggttaggagtctttaggttttcataaaacattaaatactcaaacacaggtaagaggggagaacgtaatacgtacaccaatcggatcttattgattactaaactggaaaggttttgtgcttgccacagccccttttgtaattcgttaatgtggatgttttgctggggagcgagttcgcgtaaatcagtgttaatggtacttaacgcagcatttaatttgtacgagcttactcctagcttgtccgcaacgtgatccatgttgacaggtgcgtccgcggcacggttgattaaggataaaatttcaaaagataattgatcttttttatccattaatagtattggatccataaatacctcctagctctcttctattagtaataataccgcttgttgaacgttgtcacgattgaatttgacattaaaaacagttggtagtaatttttaaactttatagtgttaattttgtctgacatataagacatatctgcgatacaaattgcaacgcttagcgaaaaacggggatggattagggttagctagattatttacgcgggacgggaaatctttgagtacatgtcgaattaataagttttataactatcactttatgtacgaattaagttaaattagttaataatctcaaaaagtttaaattcgactaggtaaactgatgcatagacggaaaatggtgccgagtgaccattttttctagaaaacaaaaattatgagaaatttacttccgggtgatgatatatactacctaatgtagacggggtttaccaaacgacgcgaaaaattatgatattagatgatggtttaactgcgtggtttagataatcaattgatccatttcaacccctggtttaaaaatgtggccgagctatggtcggaaacaacaaatgtagcaacgatttaattaagggagttatttttatgggcatcgatttgcgcgaattagaggtatatagtgccagcgaagcggcaatgatgtggggaaagtcgcaaaattttgttcgccatttaaaaattaacgggacaaaagtatttcctgaaggaaccattcgcaagtttggaaatagttggttggttacccgtgaaggaatggaagaagttctaggttgcggcccacaaatgaccttggctcaagcacagcgagagttaaggaaaatcaaccaagaaagaagagctaagtataagcaccaacaccaataagttggtgaggcagtcaggagacagtgactgaacacacaaaattatttctgtgatgaagttaagggtggctagttgctaagaaactggcgcagtgtttggcaggttagcaacgtagtgactacttttaaacttaactttataaagaataaactaacataatgtcccccaaatacgtgaccattttctttacgaaattggccacgtttttttgttatgtcagctattttgaaacgagatttcaaaatagacgcctatactaagtaaaaaaatgaaatacgcaagaaaagtttgcttgtgaatcgctaaagtgccttgatggttaaggctggtaaattaatattttgagcgggaaagtttgtgaaattgatactttttgtgaaatggagctataaaacgcttgcacttttgaattttaaagtatattataacaacacaagttaagttttaactaatcaaaggtataaataaagtttaaagtgatggtagcattagttacaggtaatagcttttaagggggataattcacatgggaccacaaatttttcacagggaaaatagccaagtaaataacaaagttgtcgattttgaaatttacaaaagtcggcaaaaattgcggcaaacggcagcagctttgacagatatttttaacgaagtacttgccgataaaccaatgttttggcagtcaattccggtgaaaaaacggatgtggcaagcaacggtagtgaatatctttgattttatggaaaaccggactccgaagttcgaatcgcaatagtgcctcaatcaagttttaaagattgttggccgagaatgcattcaccaaggggtcgcagtaaacttaaacaaataatttttaaaatacctttgtcccacttagtggggagtagacgcatacagaagaactttgcttttattgggggataattgcagagtagctatagcaaaccggttaaattacgtaaacgggtttcaaaaatagctaaaaaactggagttggattcttaatgtccaactccagttttattttaaatcttttttggcatttttgaagaaataaattacggaaggataattatttctggtacccgcatttatatgaccggggtaacggtggatttgctctgcgatgcagccaaaacgtgctccagaccccagtcttctccggataactaaatttcagcatcaatcgctaaaatcacgattctctgcaatgcagccgaaacgtgttcggaaacccaattccttccggttaactaaattacgacatcaattgctaaaaccgcaattaatgtcgtaatattgttagtcctcaggaattacccgggtttccgaacactctttgccccattaccaacctacccgacattttataccacacctggcccagctgagtgtggctttttgtatctccgtttaacttaattattttttggacgtggttattccaatcgtcgaaagccagtacgggatggtgatcccttggaaaataccattttaaattcaaacgggcaagtaaatctggcaccggagcaggctgctgatcatccaccgccagcggaatcgtgcccgcaggaaccggataacgtggttgtgattgagcagactgcgggcgatttgagctattagaaagcgacttacttggttgctgcggatgacgctcggcgaccgctggttgaatcgccggcgttgcccgttgtaaggggctgactggtagcgcaggatgttgccccgccggcgccaaagtaggtggcgttacaggctgggatgatgacgacatttccgaaggagtaggtttaacctccgcaggaaggactggtggcgtttgagaacgtaaatgaacttcgtaaaggtgaccagattccttaatttcatcaaaagtgagcgatccctgcggcaaatcactgctgactaagcgatagtcttgatgatcgaaggtctcagttaaattggcttggggatgcttaacatccacgttgaccgttttggaagaaactatttttcccgtccggtcgtcaatccaccggattacggccgttttcttttttaattggtaacggaccgtgatgtttaagtcggtactagcaggagttacgggcgtggccggtaccgcatccttagctggatccgttagttggtaaccatggggcaacgggtcgggtacctcggtaaaagtagcttgcgtaccactatgccaattttcagaatcccgaggattgccttgatcatccatttgaaaatcagtcgaggtattcgaaaaatagttttttgtcacatgttcagctaaattatcaacggtcacaaaggtaatgggctgggctacgtgggttggcgcaaccgtttggccatttttatcgacataatgtatagtttcgttgatagttttagctttgaagtggtatattggagcgtaaatataagtaaccataccgttgtcgccatctttgttaagtcttccccgagttggaagactatcaggcgcagtaccgactagccggtaatttttaatggaccggggctgactaacgtaaggctcgccaacgtgggggccgtgcggatagtacgcttgcccggttcctagcaaatggccggactggtcaacgtaccgtacgctaaccgttgcatggcaatggtgatgccaatgatggtgatggtgcttatttccccaaaaataatggtgcggatcggctgatgatgaggcgatcgcactagcagatgatccccagtaatctaacctcggcggccggcttgcggcctcttgcggtgcaatttgaggagatgatgccggataagttgatttgggtacttgatcactagcagctacggaaatgggggacaacataacgtttagtccaatggtcacaccgactaagctagtgatgaaccatttacgaccgtaattatagaaccgttggtagtgatttgttcccaagatgatgaaccctccagacatatttttagagttggatctttaaaaatatcttcaacaaatcatcttaaggagtttttatttatgatcgaaaagtttaaccgtttattggacgacgaacaacaattggtgctccaaatggccgaactttacatccacgatccagaaaagaagctatcaattagctatctacaaagtgaattaggcgttagccgtcaccaagtgctaatggcctttgatttgctgaaagataccgttgcgtcacttaacctgaaaaacatcgacttggcctacgatgggaaggggatcattgccatgtatggcttgacgacgtcattgcttaaacagcttttggaagaaatggcgctaaggtcgatccgtctaaatgtttttattaattcccaattaggaatttacgggactcaagcccaattcacgaaacgttttgggataagccgagcaacttattatcgcaatattatgggaatccggcaactcttcaccgaagaaattttcaactatcgttcgttgacggaagcaaggttgcgacaggtattgtttagtgtgattcaccatttttttaacggaatttacgggctccctggtgaataccgaatggaaataccaaccgttttggaacaaatttgtacggattgtgggatgtgtcttaaatacaccgaacggaagcgactggttaattttgcttttgtacaagctcaaagaattcgacaagggcacgtacttacagagttagccgatttaagtccggtggctgctgatgacgatggtcctgattttggtcctcttaaccagttttgggggctggaggacgaggatttgcgtcgggaaaaacagtacttaacgatttattgtcgagtaaacgagctgctggatttttcaattgatcaatgttgtggaccgcagctacaagaatgtttacaggatttggtggatagtcaaacggaacttttatacagcacttttgcggacgcaagtttggaaaaggcgattggccgaattaaacgagccttaactcaaacgaatgcaaaggtgttctcgccgttttactttagtgaaacgttcgtcgatcccacaaaaatgcccttttttaacgaaacttatcccgcaattgacgcggtggtaaagcagttgttgggcgaggtggctaaacgccgccagctatatatcgatcaggacgtgttgacccagttgtactacacgtacatgttgattttattggaacatttaccggtaaaatttttaagccgaacggttaagattacggtggatttttcgaatggaccaatctttacgaagtatatcgtggcgcagttgcagcagtttgcaccgctaaatattgaaattatgatggaactaacggaagaaacggatatcttcctctcggaccaatcgtttgcggaactagattgtgaacaaatgatatgggagtcgccaccgttagcggcggattgggagcagttgggagatatgattgtgaggattaagaatcagagtgttttggaatccgggtagctctcgaggataacaggattatggctccagtcgcggtttagacgattggagccataattttgttaaccggagagagttggattccaaaacacgtttcgactatgctacagtaggaagtctcgccgttaatcgcgatttaagcgattggcggcgggattttattaaccggagggaacggggtccaggagcacgttgctaaaaaattagatttttgaactgaaaaggctgaaagagttaataaatcgtttgctatattggctttaatagagccaaaacgtatgccaaaagtcagtttgtttaaccctaatcgatcattatgccagattcgagcataatggtcgatttttagttatgcctcacaaactacccggcctttgctttaaatattattctaattttggctaaaaaaggaaccgcgttgatacccggtagtgaccgattctctcaagtttttcaaatcaatttcaaaatgtgaaacgtcaggagcctttactgtcaaggggtcggattatatgatgaaaaagtactaatcgttgaattagtacaggggggatcattttgaatatcctagcagcttaggatatggggacaacgggaggctggaagaaactaatcgttttttctggcctctgcgtgtttatatggcaattatttaggtcaaaaaggatagtccctcactggccagttcaagaactaaaagcgaagccggctttcgctaaatccctactcattttaatttagaaaggtggtcgcgctgcaattaaaaagcgatattggttttggataataattgggttacaagtactgtttgtagcaaaaatggtacatgacacctacttcagtgatcgctgggccactcgatacgtggtaaaagcccgtggagacgtggttaccaacgtggactatactttaacgaaaaatcgttttagcggaacggctttaatcgttaaagatcataaagtgttgttacataagggttatggtaagcaagatgccacccatgctaacgatgtaaaaacgttatataacattgcctcgattgaaaagagtatgacttcaatcatggtggcgaaattggtgcagttaggaaagttgtcttttgatacaaagctagcccgtttttatccgacaattcctaatgctaaaaatattaccatccgcgatatgttaacgatgacttcgggattggaagcaagtagtgatccggaacgggcactaaacgaaaaacagcttacaaactattacgtgcaccatttggcggtggacccgcgaaaaggttgggattatgacgcggtgaattttcacttgttggtaggtgtgattacccaacttactcacctaaactatcaggacagtttccaacagctgattaaattacggcggcccattaaaattatgagcatgcccaattttaaaaatccgcacgtggcaaaaagttaccacaaaaacggtcgggcatatcctaacccggcttacatttaccgtaacgaggttggtaccggaagtttttttatgaccgcaggcgacctgtaccggtattttgcggcactggtgaacggtcagatcatcccgcttaaggtggttaagcagctttttaaaacttctacccaaagcgtctatgctgggggagtttatcaaaatcggctatattaccgcggacatgggattttacgtggatacgagccatcgattattttcaatcgctcggcgggaacggcggtcgttttgttaggtaaccggcgtggtcgagaaaccacgatgaaattagcaaacagcatttattcgttaattaaccagaccccttatttgggcgggaattcatattaacgagggtagctgcggatacttttacttgggggagaaatgaaaaattatgtacgtaacggcaattgttccggcgcacaacgaagctggaaatattaaacgcgcggtccgagcgctaaaaaaacaggttgataaagtaattgtggtttgtgaccgttgtgatgatgatacataccaacgcgctcaacaggcaggggctcgcgcatttgaaactgtgcacaaaatgaaggacgaaaggcgggggcgctgaaccaagcgctggagaattacgtagattggcagcgaccggaccagtatttgtttatctgtgatgcagataccgtgattacggaagattggattgaacacgctaagcgagtaattgcccagggagattatgatgcggttggctctgtcttttacggaacggctaaccgcaataagctgattgagttttgccaacagttggagtggtatcgctacgccaatcaagttcgccgtagtaagaaagtttttgtcttaaccgggaccgcgtcgttgatccgagcagaaacgctgcaaaaggttcgacaacgaattgggaccttttaccgcgaggattcgattaccgaagattttgctctaacgctagatttaaaagcagcgggggccaaaatgatttcgccattgtcgtgttattgcacgactgagattatgccgacgtggcgcttgctatatttacaacggcgccgctggtatttaggggcgcttcagcaggtgacccgccgacgttgggacaaaatgatgttgccgtatgtttttcaacagttgatgttattaatttcggtgttcgcttttttaggattgattgtgttcaccacgtacctgatgctcgaaaatttaatgatttttagtttgctgtggtttgtaattggcgtgatttttgctaccgagcgggtggtgaccatttgggaccaagatttccaggctaagttttttgcccttatgatgctgccggaactaatgtatagcttgtttttacaactggcttacttaggcgcgttgcttcaattgctccaggggtcaacggggacttggaaccacttaaatactgatcaatcaaaggaggcataaaaatgtataccaacgtacaaaaaaacggaatgttatggattggatttagctggaacggcctgtatcatgggttggccatcgtttcgatattctttgctattttagcggtgggaaccatcctacggagtatgtgggcccggacgcattttgacccaacttgggaatagttaagttttaaaaggagattagtgtgaggaaaagatggctacttggattagtgatcgcaattatttatttttgggaaagcaatcaaaccattgcgtactcatccactgattggggcgaccaatttattactaacgtgagtttgggagatgcgcaacacgacgatcgtactagttttggtttgtacgataagctggttggaaaatgggaatttaaaattcctgccaacgtaccggtcaaggcgcaagaccaactcacttttaaagtcccccgaaatttaagactggttagtaacgcccaattcaacctgaaagaccggcatgggcaagtgattggacgggtagatgcacaacgtgggagcggtaaaatcacggtgcggttagcgcgctacgttacgcaacatgacggtggcatctacggcaactttaaattaggacttttatgggactacgaccgggtcaagcccgcttccaccgtagcagtcagttggccacgtttacgaaccgaaaaatataaaattttaccgcatcagggacctaattcccgagaaacggtgtattcatggggttggtatgatactaaggacccccaattaattcattggcgagtacgccttaattatgcaaagcaaccgctccgacaagtaacgtacacggacttgatcgggataaaccaacagttagtcccggattcgatcagggtcaaaaaggttaaatttgatcggagcggtcgcaagtttaaagttttggcaagtcgctcgccaaaacgaattacccagtatagccaactacggtttgcggtggcgttgggtgacttgaatggtgccaacttgattgattttgaaacacgggcaactaattcaatggcccggtgttttaaacaccaagcgcagttaaccggggttaatctcaacgaaaaaaataccggtaagacgcccgtaaagcaggcttcggggaccggaagtaggctaggagaaatccgtggagtgagtttgcgagatgacgatgctcgtcagccccttccgctgcggttagacacggttttagccggtgatgatcaccaactagtaattaagtttggtttagtgacgttagggttggtagcttgcgtaggctggtttgtctaccgacgtccacgataatagagtagttagcaaaaacccgccaggttggctttaccaacttgacgggtttgctaatctaattaaaagggggaaattctatccggctactttttaggagcagcgggatgtttctttgagatttgggtgaaggcgatcacgcacatcaacgcttgaaaaccaaaggtccaaacgttacgaccgaaaagggcaggaaccgtagatgcggcgaccaccaccatggcccaagcaatgattctggacattttagtttgatgctctggttttatcataatgcaggttcctttcggttaaaaattattttgcgttagcggctttttcagcagcgtaagcagcgttgcgtttcttcatttgttttgcgtaccaccagaagaggaggacgtaagcagcgagtgctaacaacgcgtaaatcatgaaggtgatttcaccagttgaagctttaccaactaagtaagctaagaattgttcgattggtccttccttggttgattcagcaatcttagtaccagcgctcaaacctgctgggaaagcccccacttgtttagcaacgttggtaatgaatggagcacttaaagtaccggcccaaaggaagattggcatttcaatggccccgatgacgatcatccgaataatcttaccgcgggtaaccaccaacagtgcgggagtaactcccatcgcgatgattccaccaagtggaaggatgtggttgccaggcaatactaaggcttcaagcaacatcactggtgctaaaacgttagcagctgcccagatttcagcacgtcctgcgataaatggccaatccaaaccaatgtttaacttccgtccgtgaaggtgcttgttagctaagtcagtaaccccttgggaaagtggttcaacagcagcgatgaaccaagctccaatttgggagaataactgcaagcagaccccgccggtaaaggctaaagtcaaaatttcttttggatcttgccgagcaactaaaccgataaagacccccaggtagcaaccaatggcaaagtggctgccccagaatccaatccgtttgtttaattcagcagagtcaaagtcgtacttatctaaccatggaaaaattttgtcaaaaatcttgtcgaacagcatgattatcgggttcatcatgtagtttaaatgggtagtagtcattgggttatcatctggcgcgtttaataaatcgttaaacgtgggcttcattaagtcggagttgataatctttagaataccgataattaaaatcaaaataattgcaattaataaattggcaccaaagtacattgccatcaatgccgtaaatgaaatgtgccagatgtcaaacacgtcgacgtccaaagtgttggtccatttcaaagccaacataatcaagttcaaaattaccatcaaaagtaagaagaacagggtgtatggcgagccccaggtgatggtagccaatggagcccaaccaacgtcggtaaccgacagattaatccctgtcgacttaacaaaagcggccaaaggagcttggtaagcggtggttaaaatattaataatggcactaatcccggttaaagcaatcgcgagcttaataccgccttccaaggctttggaaaacttaacgcctaatgcccaagccaataaagttaaaacaatcagcatgattggggcagcccccaagtcaatgattggcttgaaaatcaggttggcaaaatgaatgattccattcatataatctcactcctttatttagttgtagttatgatttataaaattgaaaccagattgattaatgaccgcttaaaatgagcagccatggggaacgccgtctaaaacaatgaaggcgcttacttgaatggtattaaataaggggaatccgagccaattggggattcccctttgtttaagcagttaattagccttggattttcttgatttctgcttcgatttggtcgtaaacaggtttagccattgcgggcatccggtaaagaattgccccagcatcgatttcaggaatatcaatgtcaaagccaaggtcaggatggttgattggtaagaaaatttgaacgccttccatcttttcaggagtaacgtctttgatcatttctgcgtcaacagaaacgtcgtaaccacggttcttcatttcttcttcgacagcatccttaatttgatgacttgaattaacaccagcaccacaagcagttaacattttaatcataataaatacctccacataagtaatttaattatttttcatcaaagttagtcgacaagaaatcaaagatctcttccggggaatcacttgcaaacaggtgttgcaggctatcccacggggtgtgagtcaaaaactccatgatttcagcaagcacgttagcttgaccttccgggtcgttattcaaaatcatgaataaaaagcggacggtcatggtttgcgtgggattgatcatgttatgaaactcgacgggatgtgcgagctttacgggaacaatccggcgcttataaacaaagttggcttccgtatgaggaatggcgacgtttggatattgggatcccaccaccgataaatccatgcccgtcggataagcatcttctctgctattcagattgtcgagaaagttatccttaacgtatcccttttcaactaagtcgtcggcgacttccttgaaaacggcctgtctggttgtacctgaactaacatagacaatctttggatcaaatagagattcgattgctgtttcgctcatatacagatcacctctttcaaacattggcaaggtaaagtttatttatgtttgcctttgtttatttttgattacagcttcattctaattaagcgctttcatattgtcaaccagttttttgggttgggtttggattaattaaatcgttgacattcgggaatgcagatattattcttagtttgtaacacaaatgaacaaaaacaaacatttaaaaagtaaaaaggaggggtgcgagtgctaaaaaatgaacgaatgatgaaaattttgaacgcagttaatagtaaaggaacgatcacggttaacgatttggtcgataagctgtcagtttcgtcaatgactattcggcgggacctcgacgaactcgagaagcaggaaaaaattgtgcgagttttcggcggggctcaaagcgttaacttagtgtcgcaaaccgaaccctcatatattcaaaaacgtaaaattcatttagctgaaaaaaatgaaatcgctaaagcagtggcaagtatgattaaacctaacgaaactgtttttcttggtccggggtcgacgaatgaattggtttccaagtatttggaaatcgatgatttacgaatcgtgaccaacagtttgccagtttttcaacgtttttcagatgagcacgactttgacctttgcttagttgggggaacctaccgacgccggagcggtgcgtttgtggggagtttagcggaagaatttttacgcaacattaaaatgcataaggcatttgtgggggttaacggaatctcgaacacaagcgtgatgaatgcagataccgatgaaggcgcgtcgcagcgggttgctttggagcaatcgcagaataagtatatcgtggctgaccaccataagttagatcacgatgatttctataatttctatgatttaagtaacgttaacggtttgattaccgatgcgggcgttaaaccagcaatcttacgacgttaccagcaaattaccgccgtccacgttgctaaaaagattgaataagaaaaggagcagtgaacatgaaagttgtagtaggtgcagataaagcaggttttgacttgaaggaaaaggtaaagacttaccttaaagaacatgattacgaagtggttgacgttagtgaaactccccaagcggacttcgtagactcttccttagccattactgataaggttttgaacgacaaaattgaaaaggctatcatgtttgacgaatacggggttggttcagcaatggctagcaacaaggtcaagggcatggtcacggctaacgtagtcgaagaaaacaccgctcacatgaccgccatgcataacggtgccaaagccattgccatcggtgccggcgtcgttggtgaaaaattggcttacaacattgtgcaatattacctagatactgagtatgccgggggtcgtcatcaaatccgcttagacatgcttaacaaaatgatttaattagggaggaagcatagaatgattatttcaattggaaacgaccatatcgttacagacgtaaaaattcaattatcaaattttttgaaatccttaggtcacgaagtaattgatgaaggaacttacgataccacccggacccattacccaatttacgggaaacgggttgctgaagacgtggcggatggtcgtgcagaccttggcgtggtactttgtggaaccggaatcgggattagtaccgcggccgataagaacgaaggtgtccgggctgcgttagtttctaacctagttgccgcacgttacgctaaggaagaacttaacgctaacgtaattggttttggcggcgcaaccgttggcgaacacctctgcgaagacattattaaggtgttcttggattcagaatacaaggaaaccgaagaaaacaagaagttgatcgacaaaattgatcacattgctacaccaaacccagatcaaaaggataatccacacttctttgacgaagaaaacgaaaagtgggctgaaggattttaccacgattaattaggtcgattatcaatttgtgcaaatttttgttaaaattgtaagcggtacctgaaagggcattcaaaaatatttttttaaacgaaaaggggaagttggacactatgaaaacattgacagaaggaaaactacggggactgaaggctttatcagatgaaaacggcgtaatcagcgctttggcaatcgaccaacgcggttcgttgaaaaagatgattagcgcggcaagcggacacgaagctagccaaaaagaaatcgaagactttaaggtggcgatttcttccgaattgactccatacgcaagcggaattttgcttgacccagaatacggcattcccgcagcacgagttcgcgacgaaaacgctggcctactaacggcttatgaaaagactggttatgacgcaactgaaccaggccgtttcccagacatccttgatcaatggtcagtacgtaaacttaaggaattaggtgcggacgccatcaaattcttgttgtattacgatgttgacgaaggtgaagaaatcaacgaacgcaagcacgctttcattcaacggctcggcgacgaatgcaaggctgaagacattccgttcttcctggaactagtttcgtacgatgctaacaatgatgacgtaaagggtaaggaatacgctaaggtcaaaccgcacaaggttatcgaaatgactaaggaattttctaaacccgaatacggcgtcgacgttttgaaactggaagtaccagttaaccaagcttacgtagaaggttttgcgaaaaatgacgtcgacgtagtttacagcaaggaagaagctgcgaagtactacaaggaacaaagcgacgctaccgacttaccattcatcttcttgagtgctggtgtttctgcagaattattccaagaagaactccaatttgcgcacgatgcgggttcaaaattcaatggggtcctttgtggtcgggcaacttggcgcggtgcaattgaaccatttgctggcgaaagcgaagaagttggtcgcaagtggctgcaaacccaaggtaagaagaatattgaagacttgaacaaggttttggcaaagagtgcgaccccttggtttgaaaaggtacaaaaataatttgaaaaggcccagaagatgacgaactatgaaaaaatgcaaaaggcgaaccctcagttaacgatttatcaggtgggtgacgaacaatttcgggattatggaatcgtatataagcaatttgatttaacggaaattaacgattacatggctagggtggcagttaccgctgcaaaccagtacgtaccgaaaaatcctgcaattgaacaaatgagcgtgatccatgaaatcagcggggatgtttttggcggaatggcactttcagcaggccagtgtgtgggccattgtgatgccttttcagccgttgaatttcaccaaggtagcgaagtgaacatcacctttaccgacgtgattatggtgttaggaaagcgacgagatttacagaattacgaattccacgccgttgacgacgcgcaaattttctacattccgcaagggaccgtctttgaaatgtttagtgacacgttgcattatatccccattgaggttacgccagcaggatttaaagcggtggtggttgtattgaatggtacgaatgaatctctcccaagttcatttaaaactcataaccccatgctagtgaagaaaaataaattccagttggcgcacgcgacgcggactgataaggtcaaagccggaatcttgccgggggttaaggggccattggttcaggttcgcccgattcaagattagaggaggccattaaaatggattgcaatgtcgatgaagaaaaattaactgccgagcaaaaggcagaaattgaacggcaagaagaattgcagcgggcaatgattaaacgccagttagaagaatttccggttaaggatcccttctaaaatcagcgttagttaaagccaaaaacgagattcggaaattccggtctcgtttttttgtgagcgcttccttgaagctgattagacaaaactaaaggacttccgaagaatcccaaaatactctggtacaataaaactatgattatttaaggtgaggaagggtacgcatgaactggagaaaaagtaaaatgggcatttttgccatggttttagtggtgattttggtggggtcgatgatgcgcaccccaattactacgattcccttgattttgggcaatttagcgcaaagtttgcgagtggcccagggaagcttaggaattttaaccactttgccattagtgatgttcatggtgttttcaaattttgcttcacaaattttaaaacggatgggctttaaacggtcactattgctggcgttagccattttagtgcttggatcagcgctacgaatggttgtaacgatgcccacgatgattggcggtacaattttaatcggggtggcaatcgcctacctaaacgtttttatgccgtcgtttgtggcggcctattttccgcaacggattgggttatacaccacgctctacactttttcaatgatgatgggcagtgcaatttttaacttgattaccgcgccaatcgttaaattgtccggatggtggacgatgttattgattttaacggtggtgccattactggccttgctaacgtgggggttgatcgtgccccatttaccagaagagatggacggacgggtgccaacgccgacggacaatcaagccccaactaaaacggtgatttggcaaaataagcgggcgtggtgctttctactggtgttcggttgtcaatcagtaatgatgtacacttttacggcgtggatgccgtcgttaatggcctaccatcacgttggctcgggcatcattggagcaatcatggcgtgcttttcgttgatcggcttaccagtctcggtatttttaccccaaaccttgacccgggtgagtcggcaaactcaggttgggttgattctatccgcagggatcgtgggcctcggggcagccggaatgctcttcgtgcaaaataccgccgctacttggttttggttaattgaagccttgttaattggttattcggtaaacctcttctttgttttcgtgatgaccatgtttgccatgaagacggcttcgccatatcaaacagcgcaactatccggcatgtctcaagctggtggttacctcatcgcggctttaggacccgtactttacgggatggccttttctgctaacccggttggcagtgcacaaaacgtggtttacctcgccatcgttttagttgccacggtagctggcctagcagtagtaaaaatggaccagatttagtaaagttacgtaaaaataatataaccccttgccgtccgcaaacaatgaagttgtggatgggaggggttattttttagtgcgaattacgtatgaatctagcagaacccgagtaattacttgtaaaggcaagcgggagtgcacttcatacgccggaaagtaagtagtttcggacttaaaaccacataaaattaaagaggcgtattttccaatgctactagtactattggtggtgatcaaaagaatgggggcacggttttgtgatatacggcgggcagcttctactagttcgggagtttctccattaagtgaaataataattactaaattgccaggacgaatatcggttgctagggtttgaataatgttgggatcgtcgctaagctgacagtttttctttaataactgaagttttactaaaagttcttcagcaattagttcagaaaagcctcgggcaaaaatgtaaatggtttgggcacgtcgaatttgctgcaccgctttttcaacgtcagcaatcttgatcattttaatggtattggtgacttcgtgttcatttttcatgatggcgctgcgaatatcagaatcggcgcgagcaagattggtgtaggaatcctggttctcttcgactagatggtgtttaaaatcactgtagcctttgaagccccgtttgcgaagggtccgaatgatggttgccgtagaaacgttagcttgttgaccaagcgcaacgatggaaagtgccgggatactttctaggtggtcttggataaattgccacgcgtatttttccgaattacttaatttttgttgtttcaaattagccgcccctaaatgtaaattctttttcaagaataccacagaaaaagatttttttgaaaacatttacaacgcgatggcgcctacaattaaggtagcagaaagaagaggtgcctaaaatgatttacacatgtactttaaatccagcaattgacttatttattgaaactgatgaattaaaaccgagcaaggttaaccgaacgaacagctatgatattctagccaacggaaagggcgtaaatgtttctttcattttaaagatgttgggcattgaaaatcaggcgctaggcattggaggaggttttaccaacgcatttatcgaagaaacgttgcgtgagcggggcattgaaaatcattttgtgcatacggatcaaccaacgcggattaacgtcttcacccgggtgctagcagaaggaaccgagtacaaagaagttaatgcgggaccccaagttacaccaacgcaggtgactgaattcttaggattgattggaaaactgactgcaacagacactttggtcatttcaggaagcttttcccgcggagtggaaccgcaaattttagtaaaaatcgcgcaaaggtcccaaaagcaaggttttaaattggtaatcgatactaattattcggcagttttggaaacgctaccataccaaccggaattgctaaagccaaatgatgaagaactaagtaagtggtttgggttaactaaacggccaaccttaacagatttaattgaatgtggccaacaattagtggcacggggagcccaaaacgtattgctgtcgttaggtagtcaaggcgcgctcttagttaacgcaaccaccgtcctgcttggaaatgctcctaaaggaacggtggtcaatacggcctgttcaggggacaccatgttaggcacctttttagccggaatgaaacaacaaaaaccattagatgaaaatttaaaatatagcatcgcggcaggaagctcaacggcttttcggtcaggattaactgattttacagatgttgacgaattaagtaaacagattacgattaaagtggttaagggaggaatcgagaatggctaaataccaaattattgcggcaactggttgcccaacgggaattgcccatacctacatggcccaggaagctctggagcaagctgccaaaaagcggggcgtttccattaaggtagaaactcacggccaaagcggcaccgataacccatttactgatgaagaaattcaaggcgctgacggcgtgattgttgcagcagataaagacgttcaaattgaacgatttgacggcaaacggttgatcaacgtgtccgttaccaagggaatgaaggaacccgaccaattaatcgacagtattttaaatgacgacgttcccgtttaccacgccagtagcccagctagtgttaagtcccagagcggtgaggctaacgggtccttctggcacaacatttacgttgatttaatgaacggggtttcccacatgttgccgcttgtggtagccggcggggtattgaccgcaatttcctttttctggggaattaactcggctgaccctaagagtgccgagtttaatagctttgcgcagttactgaataccattggtggttttgcaatgaatctgatggttcccgtactgtgtgcttacattgcggaggcaattgggaaacgctccggattggtagttggttttgctacgggaatgattgcctatactaacggaactggatttctcggcggaatcgttggcggttttttagcgggttacacggtagtcttactacaacgcttgtttaaggcattacctaaatcgttggacggtttgaaacaaattttcctttttccagttatcggggtttttatttccggcgcaattatgtggtatatgtcaattccgatgaaagacattaataccgggatgatgagttttttgaagggaatggaaaattcgaatccgttaattttgggattaattatcgggatgatgtgtgcgtttgacatgggcggtcccattaataaagcagcctatttgacgggcacggcactacttgctcaaggaaactacttcttcatggcgggagtatcggcagcctgcattgcaccaccgctggcaaccggttttgccgtattattcaaccgcaatgcctactttgacaatgaacggagcgcgggatacgtaaactttttacttggctccacgcacattacggaaggagcgattccatttgcagcgcggaatccgttggttaacattccaatttttatggtgggttcggcagttgccgcaatcttaacgtatatgacaagaattagtgttccggctccccacggtgggtttatcgtgctgccgttagttaataaaccatttctttgggtggccttcattgtcattggagcgctaatttcaggctttctactttcgttagttgcgggccgaactaagtctacggaaggtgatgcaacgaatccaacaaccgcagaggcaaccacggacgatcaagagctagcgcaaattttaaccgttaagaatgttaaaacggccgttgaagttagctcacgtgacgaactgttaaaatatttagcgaatttagccgtaaaaaatgggtatagtacggatgccaaggcggtttaccagaaatatttagctcgcgaaaaagccggttctactggtatggaacgtggcattgcgatcccccatgcacaagatgccagcatcaaaaattcggcaatgctagtcgttaagctacaaaaaccgattacttggcaaacctttgatcagcagcccgtagatacaataatttcgtttttgattccggagcaggatcaaggcaaccatttgaaatatctctcggcaacttctaaattattgatgcacgaacagtttgttacgcagttaaagcaaactaacgaacctacggcaatttatcagttattcaaccaataatgagcttctttaaaaaaggctggaagaccttcactaacggaatggagattaaattctgctatggttagtaggggtcgccggctttttatttttgagaagaaacctaagcccctaactgctgtttaccaatttttccataacggggatggtgtttaataaattgaacttgtaagcgcttatttttgtgttatcatcaaagtatcaaataaataattaaacgtaaaagggtatataccaatgtataaagaaaaatactttgaagaactaaaaaaagaatttaataacgaagatgagattgtaaccgagatcgtcaacctggaggcgattttaaatttgcccaaagggaccgagtattttatcagtgacattcacggcgaatacgacggactcaaccacattttaaagactggagcggggatcattagtgaaaaaatcaacctccgttttcctgaaatggcggcggctgataaaaaggaattaaactttgtggtggcctaccctaaattcatgattgaaaaagtgcaacagggtaaaagtgccgacgagttaattcagtggtataccaccattattccacggatgattgaggtcacccaatattgcgctagcaaatattcacgttcaaaggtccggaagacgttgcccaagaagtacgcctacattatcgaagagctattgtacgtagaaggtagcccgaaaaacaagcaaaagtactacgcccagattattaataaggtcattgaattgaatcgggcgcaagattttgttcaaagtttggctgctacgattcaaaagctggtgatcgatcacattcacattgtgggcgacgtttttgaccggggccaaaagtctaaccaggttttggaactgttggaaaacgcccactccctggattttcagtgggggaatcacgacgtcctctggctgggcggttacgccggttcgcaggcctgcatcgcaacccttttccggattgcgactcggtacggctacatttttgatttggaacgggaatacggaatcaatttacgggcgttgtttacctttgccgaccaacattacgaagccgatccgtttttctatccgaaagctggggaatttaaccagcaaaacgcggaattgttgtctaaagtccaccaggccctaactattatccaattcaagctagaaggccaaattatcgcccggcaacccgactttgaaatggaaaaccgcctgtttttgcaacaagcggtcaccggcgcagttgaaattggcggtcggacctatcctttaagccacgggtgttttcaaacggtggatccgcaacacccctacgaactgaccgcggaagagcaggaagttatccaaagtttagggtattcgtttcggcatgccccgcaaattaaggcccacatggactttattttgcgaaaggggagcatgtacctaatttacaataataacttgttgtatcacggttgcattccgttaaccgaggacggcgactttgacgagtttgaataccggggccaccggtatgccggtcgaaaattacttgatttctttgaacagcgcatccgggccgccaccagcaaaactgactttaccgaaaccgatgatactgacttaatgtggtactgctggatcggtaaaaaatcaccgcttttcgggcggacggccatgaccacgtttgaacgctactttattgacgacaaaaagacccaccgcgaaggcgataatccgtacttcatgcttcgcgaccggctttccacggcgcactatattctagataaattcgggttggacgagcgctccagttacattattaacggacacactccggtaaaggtgggcaacggcgagtcgccaatcaagggcggtggtcaaattttagtaattgacggcggcttatcgaaggcctatcagaaggcgactggaattgccggttatacgctgatcaacaattcatacgggttccaaatcgttacccatacgccgtttttgggagtggccgagttgtataattcgacgactggctcagcaaccttgaaacgggtgatcgaccgggaccttccccggcgcaacattgccgatacgactatcggaatggaacttaagcgccaaattgacgatttgaaatttctcttgcaaaacgacgacaactagtcgttatactttttggaacgtaaaattcgccaagtaatcaaggcgagcaccaaactgacgataatcatcattaaaaagccgaatttagtgtgttcaccaggcagcccgccggtgttcattccccatagtccggcaattaacgaggggaccgaaatgaccagggcggcggaatctaaatacttcatcaagtggttcaaatgattactcataatgtcggtaaataaaccgctgatcgcttcaattaagtcacgataaatggcaattaacttcgtgatttggcgttcagcggtttttatgttgtaaatcattgcttcgtccgccaaattatcggtaaattccgctaacttaaaaagccgttctaacgcttgatgttgggtatcaagggtgtgctctaagatgacggcctcttttttgatatttttgatttcgatgagatattcatttttggtggtttccgtagactgtgcttcaatttcttcgagctgctctttaatatgcgcgagttttacgcgatagttggagtaaatttttaagaggaagcaggcaatcaggccttcgttggaattaaacagggtggtttcgtaaagctgttgaatttcagtggcgctcgccgattcttcgtggaccaaaaaggttagttgttccggctctgaaacgatgattaaagggtctaacaatacctgggagtcaaggatgttatcggtaggcgcgaggttacagaccgcgatcaaataggcaatttcgtcttcaccatgcttgaaacgcatggttcggggaaagacctcgggagtttgcaggcctgccgtaatggttgccggccattgatgtttttggattaaattgttgagagaatcaacactggtgaaagtttcaattttgagctggacgtggtgattaggcatgccgaaactcctttctcgctaaacgtttacataacgtgagcctttttctttttaaaaatattctattatattaaaatgctaattacaaaagaaaggagttgtatgcacatgaatcaaccagatttaaaggatccccgtacgctgtaccacacggataaatttccggcgcaacaacaggacaccccagcgatccaagggaagatgacccccgtacccgactgtggtgaaactagttacgtaggtcacgacttgctgttaaaccgaaaggtgcttgtaaccgggggtgattccggaattggtcgcgcggtggccatcgcatttgcccgggaaggcgccgacgtagccatccaatttttaccaggtgaagaagccgatgcgcaagaagtggaacactacatcgcttccgcagggcgtcaagcgctcttactcccggctgatttacgcgattcaaatgctcccgaagaaattatccaacgggtggtcgatgaatttggtgcactcgacacgttaattttaaacgcgtcccaacaaattgcgcacgaaaaaatcgacgacctgccgatccaacaaattaaggatagttttgacgtgaacgtggttgccatgttagccatggtgaaggcagccaaaccgcaccttccagctggcggcgcgatcgttaccaccacctcgattcaagcgtttaacccaagcacccaattgttagattacgccgcaactaaagcagcaatcgcgaacatgacgattaacttggggcaacaactgattgaacaaggggtgcgggttaacggcgtggctccaggaccaatttggactccaattcaattggatcatggtcaaccagaatcctcgatccctgaatttgggcaagattcaccgatgggccgggctggacaaccagctgaattagccccagcatacgtcttcctagcgtccaacttagctagttacgtaacttcccaaatctacggcgtaactggtggcgaaccaatcaacctttaaggaggaatggcggtgccttggacaaaaaaagattatcccagctccatgaaaaatctcaaggaacgggtgcgtaacaaagcaattgaaattgcaaatgctttgttacaagaaggttatgatgaagaccgggcaatcccgattgccatcagccaagcggaaaaatgggaccaggaccaccctgaagattaggtggtcactaaaaattgtaaaaagcgagtgcgacaaaagtcgggtagcttgtgagtattaatccaaaaggggctgtgacaaagggctctaaccaaaaaaaacggttcatgaagtgaaacttcttcatgaaccgtttttattttggttttttgacttcaacagagccaaaacgtgtaccaaaagtcaatttttggttaatgctcgcaaactacccgacttttgtcccactcttgtttttgattaagcggaataaactagttttttcagctgcttttaattttcatagactagctagtcagcttttgtttccactgcgtgtttttgatattaactttgggtggaaccattgtcagattcgctgtccgtgtagttgtaataagcagggttagtgtaactatttgatgaataattaccatcatatgcgggagtgtaagtcccatcagtataactactatcatagctagaactttcttcttccgctgaagatgcggcagctgcgctttcttcggctgccttggaactggactctgccgcggccttagaactagcttccgccgccttggaagctgatttagaagcttctttagaagcagattcttcggctgctttgcgtgcggcttcttcttcagcttctttttgggctgcgatggctgcttctcgtgccgctttttcggccgctttattttccttattgacgattgaacgcaaactaattaacttagtttgttcgtcgacggtccgttgagactgctgattcttccgcatgtccttaattaacccatcaatagtggaaacgctaattttttggttttgttggtgagctttaataatggtgttgtagcggcgactaagtttatccgccgtttggacaatttggcgtactttttgtagacgctgttgatactttttatcgaaagcttgcggaacgctgtttgccgacaaagtctgcatttggtggttgacttttttagtagtcaccttcaagtcgacccggttttgccggttgaacaaatgttggtaatcctgccgaacttggtaagcgttggcagcttggttttgggccttttgtaacgtttgtttcttcggccggtcttttaactgagcgacgtcatgcttaagcgtagtaatttgttgcttggtgacgttcttttttagatccgaatgttgggaatcgacgtacaagcggtcgatccgggtctgtagccggtcaactttgctagcgtagagcgttttgctgattccccatccgccgccaaaaagcacggcgcacactaaaataatgctaccaattaaaattgaccaacgccgcatcactaaacgccgatgccgtcgtttagcggaccgccgcccccgatacaggtcgtcttcgacaaattcgttttggtacggatcgcgcggattgatccagtgcttaaatttctttatccatctatttagtgtttcgttcataaaaactaatcccccaaggtgtcagccaacacgtttaaatttagttaaattaaagtacgaattataactaattttattatactttgttttaagaaattagggcaaaaaacattacattaactctaaattattgctcatttttttgagtttatgtgtggcttcttccatggacatgagcgattcgtcgaaaaatgactcgctaagcgtgacaaataaacgcgcggacaatccaataaaggtttcgtctaggggcttagctggtaaagcaggtttttgaaggtaatggtccatgcgcgcgaaaacttcttttcgcggtttgataactgccatcccaaacgtttctgaaaggcctttcattattaggtaagttaattcggccatttgctgggccatcagtaacttcttccgaatgtacgtttctttaaacggcacctggagttggagacacttgccgttacaatcaaaattcaagaacgaagagtgcggatggtgctggtccgtataaaaatcactgaggtggtgggcaaagatccaatttgcgggccgccgggtagttccgtttagcggtactacccgttgggtacctaaaaccaccgggcgggcttgtttaatacctaaataatcggttaccacgcgtaaaaagatgtcgcaacagggctggtcgcgtaaaaagttacggataagttttcgagttgattgattagtaatatggggaggtcgttcggtgtcaataatcaaggtagaaccggggcagcgccaatggctaatatcttgcaaataaagggtggtatcactaaaaattcgtgcatctttgatgaatggtaaattaatatcccgattctgatccgaaaaaacttgacttgagctgagctgctgaaattcatcatagtagttcagtttgacttccatattaaaataatctcctccgaaatgattactaatcaatatttttttgcatttgaatattatcaaagcgctatcacgctaacaagtatttaaggcaaaataagcccattttgcccattaaccggtaacttagcagacacattcgtttttaaatgaaatgtggtttcatatttttgaataaatttgcaaattttattgaaatggcatttcaaaagcggtacaattaagcaactcaaatgaaagcgaatacatggaggtgcagaataatgttagatttaagtcggttaacgacggaaacccgtaatccgcagacgatgcggttggatgaattatcaacggcagaagtcctcgaaattatgaaccacgaggaccaaaccgtggcgcaaagcgtacaaaaagcgctcccgcagattactcaagcggtggaccaaattgtcaaaaactttaagcaaggcggacggcttttttatatgggcgcaggaaccagcggtcggttaggcgtgttggatgctgccgaatgcgtgcccacgtttggcactgatccggaaatggttcaaggactaattgctggagacgaaaaggcgatgaccgtggcggtagaaggtgcggaagattccttgactttaggaccggcagatttaaaaaaacgacacttaacggataaagacacggtagtgggaatcgccgctagcggtcggacaccgtacgtaattggcggattagactacgcgcgagaaatgcacgctgccacgattagtttggcctgcaacgcggatgcagaaattagtcaacatgccgaaattgcgattgaagtaccggtgggtcccgaagtcttgaccggttccacccggttaaaatcggggaccgcgcagaaattagtgttaaacatgctttcaacggtttcgatgatcggaattggaaaagtttataagaatttgatggtcgacgttaaaccaactaacgctaaattggtggaacgttctaaacgcattattatgcaagccaccgatgcagattacgagaccgcagccacagtgtttgaaaaggcccaccaaaacgttaaggttgccatcgtgatgattttgacgggggttgacgaatcggaagctcaaaagcggcttcaagaagcccacggttttgttagaaagacgattgattaggaggaaaaagtaatgacggatgcaaaagtaaaacaaatcgcgcaggcaatttacgctaatgtgggtggtcccggcaacgtagccaaactgatccattgtatgacgcgggtgcgcatgaccattaaggatcctagcttggttaacatggccgggttaaaacaaattgacggtgtgatgggagtcgtggacgacgacactttacaagtgattgtgggtccgggcacggttaataaagttgccgaagaaatggtccgcgaagttggagtaaaactgggcgatccttttcctgaaacggtgatggatacaagtaagatgaccgacaaggagattgtggaagccaaggctgctcaagtgaaggcagcccaaaaggctaagcaaaagcaaactcccgtaaaacgagttttgaaatcgatttcgaacatcttcattccgttgattccggcctttgtcggggctggtttaattggggggattgccgcggtgctctccaacttgctcgtggctggggatatcagtaagagttggacggatttaattttagtactgaacatcattaaaaacggggtgtttgcctacctttccgtttacgttggtattaatagtgcgaccgagttcggcgcgacccctggtttagggggtgtaatcggggcggtaaccctgttaaacgggatgactcccgaagctccgctacacaacatttttaacgggcaacccatgagtgccggccaaggtggaatcattggggtgatttttgccgtttgggtactatccttagtcgaaaagcaacttcatcgctgggtaccagattcaattgatattattgtgaccccaacgattacgttattagttattggaatatttaccattttcctagtgatgccagttgccggcgtaatttcaagttccctagttggtgcaattaactggattctaaacattggcggcgcgttttctggatttgcgttgggagccttattcctcccaatggtaatgtttggtttgcaccaaattctaaccccgatccatattgaaatgattaacaaaacgggggcgactccgttattgccaattcttgccatggcgggtgctggacaagtcggcgcagcctttgccctctgggttaaatgccggcggaaccgccaattgactaacttaattaaaggagctctgccagttggaattctgggaattggcgaacccttaatttacggggtaacgttgccactaggacgaccgttcatcaccgcatgtatcggtggtgggatcggtggtgccgtagttggcggcctcggtcacgtgggcgcaattgcaatcggcccttccggagtggctttaattccgttaatcactaacggccacatttacgcctacgtcctcggactcttagctggatatgccggcggattcgtggcaacctacttctttggaatccctaaagacgccctcgttggcgatgctgaagttaacgctgaagttcaaaatgaagttcaaaacgacatgccaagcagcgcgacagctatgcgtagcggttcggcgaccgtgacaactcccgttagcggtaaaatagtcgagcttgatcaagttcctgatccaatgatggcccaagaagtgatgggaaaatcggtagcggtgatgcctgacgaaactgatccccaaatttacgctccggtagatggaaaagttactatggttgctgacactaagcacgcggttggtttccgagatgagattggtgaagaagtcctcgtccacatcggagtggataccgtgaagttaaatggcaaaggctttgaaattaacgttcaagctggtgaccaagtgcaccaaggtgacgtaattggtaaagtcgattggtccgtaattcgggaagcacaacttgcaccagtgaccttgacaatcatcaccaattcgggtgattatcaagttgataaaaaaattggacaaaccgatgtccaagctacgtcaattttaatggagaatcaacgctagccacttattcattacgccagcgtgaggaggggtgacgatgaaaagtgttgtatttaccttgaaaaatcagttgggtgattttaccaaaaaggaaaagcaggttgcccgctttatcattaagtatccgcaagcggtaattgattccaatgccaaacaggttgctgatcaagtgggaacgagcgctgcaacggtaattcgcttagccaaacgggtttgtaaaaacgggttacccgagctgaaagaacgcctgaaaaacgaaacgatggttaacgacaagttctttgaagaaatcgatccggcagatacgctcgaagtgatgaaacaaaagatggaataccggattaaccacaccatcgagcaaaccaatcgaacggttaagggcggtgcggtccggaatgcagccaaactggtggatcaagccgacgtggtttacacttttgggatgggtgcgtcccatttagtagcggatgatttgcaacagaagttcgtgcggctggggaaaccagtcgcccaaacccaagacgtacacctgttggcagcggggatgtccaaaggccgtggggtggtcgtgctgatctctaactcgggagaaactaaagagacgttacaattactaagtgcagcccgggcgttagatttgcccgtagtggcgattacccgggtattgagcagtcccctggcccgacaaagcacggtggtccttgcccatagtgatagcggggaaggtaaccaactgcgaagcgcggcgacgacctcgctaatggcccaactgtacgtggttgatctactctactactcctttttaaaattacattttgaagataacgtagatcagttgacgaagtctcgcaggattattaaaagcaatttctaaacgaaccaaacacgattcttggtggcaaaaggctactgggaaccgtgtttttatttagagtggtaaaattgaagcgaagaatttggacgatcttaattgctataagggggttaaacaatgcaagccatggatttagactggtgttttcggctcgtagtggcggcaatttgtggtggttttattggctacgaacggtcggcccggctgaaaaatgctggaattcggacgcacattatcgtagctttaggagctgccttagccatgttaatctctaaatatggtttctacgatttgttacaacatcctggaattgggttagacccttcccggattgcggcgcaaatcattagtgggattagttttatcggtgccggaaccatcctagtgcggggcgccggtgttaacggcctaactaccgccgccggggtgtgggccactgccgcggtcgggatggcaattggctcgggattgtacttcatcggaatcgcggccgcccttctgattgtggcctcgcagtccttgttccgggacaatttagttttaaagtatttattacggcacaaacattttcactgccagattctattgaaaaacgacactacgactttatcgacgattcacgcaatttttcatgacgtggggttcacccggaatacattttccatcagcaacgtaaccaccgagcggattacggtggaattggaagggattttaaccgacaagcaggatattgactcagttttaatgaaaattgcgaagaatccggcggtcgtggaagttcagcgggaagattaaacgaaggatttgtatgagtttgctggctggtcaaggccgtaaagattagtagtttaagcactacccgaaggatggaaaaaatataaaatcatttgggtgtgctgactttattagcatcaaaagtgcttcttgaggatttttaagttctgaagaagcacttttttagttggtaaaacttgcaagttcaagaattggtatatacatcttaaaggttataaaaattgtgtggagataaggttgttagcgcaaactatttttaattaaaaaaaggcaatttaacgattgtctttggttagataaaggttatactttatttgtaaacgtttacacttattgaagttagatgggatttatctgatgaggagatggatgtaatggcagcgaatattttaatgacgcgagttgataatcgtttggtacatggacaagtcggggtgacctggaccagggcggtaaaggccaacttaatcgtggtggctaatgacgacgcggccaatgacgaactgcaacaaaagttgatggccaccaccgcggattcttccggggcggacattcgattctttacgattgaaaagacgattaacgtgatcaacaaggctgcggaccggcaacacatttttttggtggtaaaaacacctggtgacttacttaaattagtggaaggcggcgtgccggttaataaagttaacgtgggcaacatgcatttcgcgcaaggtaaacgggaaatcaccaaaaaggtttacgttgacgatcaagacgttcacgacctcctcgcagtagctaatcggggaattgaaatttttattcaagactatcctggtgaaaaacaatatccgattaccgaacaattattgaaataacatccagttagtgtaaaggaagtgattttagcccccaattttatgacaatgtcgctaaacgtgctcagtaacttgagtattcgggcttagccaattagttttaaacatacctgacgattcagctactgcgcgctgcttatcaagagaggtgaaaataaatgtcggttactctcacacaaggtattttaattgcgatttgggcaatgatttccggccttgatgcttggctgcaagctttcttcattttccggcccatcattgtctgcacgattactggtttgattttaggggatttacaattgggggtcattgccggcgggctgactgaattagcctttgctggactaaccccggcgggaggaactcaaccgcctaacacagttttatgcgggatcatgaccgtagtaattgcggccacgaataatactaaccctaccaccgcgattggcttatcgttgccatttgcgatgctcatgcagtatattttactgttcttctactcatcattttccctattcatgtctaaatttgaccaatacgcagcggaaggaaatgcccgtgatttcaaacggcttaattttattccgctaacgattgtcatcgtttcgtttggcgtggtagctttcctcagtgcctacgctgcgcaaactccaatgcacgctttagtaaattcgatgccgcattggttgacccacggctttgaattggctggtgggatcttacctgcggttggttttgcaatgctgcttaaggtaatgctgaaacctaaatacatgccgtacttagtcttgggattcgtaatggccagcatgattccattttcaaacgtattgccggtagcattggtcgggggcgtttttgccgcgattgaatacttccggacccgggaaaatatggaattaaaggcccaaattaaggacctttctgcacgttcgcaaggaggtggcatggacgatggtatctaagaataaaaaatccattttcagcaatcatgaaatttcaatgctcggtattcgttctaacctagtacaggcttcgttttcttacgaacggatgcattcgccaggatggacgtgggcacagctgccctattgggagaaaatttatcgtgacgatcccgaggggttaaagcgggtaatgaccgacaacatggaatttattaacagctcgccaccgctataccccattctcatggggctactgttaaccatggaagaagagcacgttgattcgaccaccattaagggattgaagaacgcgttgttcgggccgatggctggaatcggggatgcaattttctggttcaccattatgccgattgtgggcggaattaacgcctcaattgctaaaaacggaaacgtctttggtcccatcctcttcttcgtggtttacctcttcctcttctggtcccgggcgcccctggctcatcttggatacaacctgggaaccaaggctattgacgtaatccaagaaaattcgacggtcatttcgcacgttgcttctattctgggattgaccgtaattggttccctaattgcgtcgtacgtaaagatgcagttgaccattaaaattggggccgggaacaccgttattgacctgcaaaagcaacttttagacaagatttttcctaacattttgccatttgctttcgtattcttactgttttggctgttgcggaagaacattagcccgatttggttgattgtggtgacctttgctttgtcaattgttatggcggcaattggctggatgtgattagtgaataaaacggagataattgatgaacgagattaaagtaattgtgagtggccacggcggatttgcgtctggaattcaagcggccctaagtttactgattaaggtgccggaaaattggcaatttattgatttcacgaccgggatgagcgaccaagaattacatcaagaattcgtccaagccttaggtgttgcaccttttgaggaaaccgtgttttttactgatttagctggcggaacgccgtacaacgtcgcggctactttggcagcagacgcggcgcaactgcaagtggttgcgggatgtaatttggcttcgttgatggaaaccatgttccaaacgtttgggaacgcgcatcagttggctaacgccctaattagcaccagtcacgcaagtatcaaaaggtttgatccaaatgctccggttagccgaaatgcggactcggatgatgggatttagcggggagaactcggaagctcgatggagcgacatttttgaaatgggttggtttaaaatgctctgtgtaccaacgcttaaaaacgagaacgtgatgattgaaaaagtattaaattggagaggttgttaaatatggataccattggaatagcggtgatcgtaatcacgatgatcgctggaggtatggcaattaaaatctatcaagagcgacgatacttttacctaagcacctttttttataaagaatcgcaaaatagcaatgtgttgtttttagggaaaagcgggcgatatattttaaaccggactaaggttagcgaggctaaccaacaaccagctaaatttattattgatgaaggaacgttcacggtcactgtcgaccaactgcttttgcaaagtcatgatgggctagtgatcacttatgacaatgtgcgtaacctagtgatgaacaagaacccgcacgtgcaccggcagagtccagcggtgtcagatttaaaaaccatcgagatgaaaaatcatcgattaattgttgcccaacaaccgttaaaaagactgggcgaccaccgcgctaaaagcgtggtttcagtgcgaaagatgctgggacaggcggaggtcggttagaaaccacgtcggaatatttctggggtgattttcgcaggttctgtgagttttattatattggctaggaagaattgggctttagtttagcgtctgccttggggtgggcgcttttttgtgggggagaatttgcaaattttagatgttaagcccacctgtttaaaagaaaatgtataatacaattagtaaaaattaattgcaggtgtaaaaatggctaacgtaaatgatccagttgtagaaaaaatttcatttaataaaaacgggttacgattgttagatgaaagaaatgaacagcttttattagactacccaactgtttacattatttatgcagaaaacaaagatagttatagcgtttatgttggagagacgaataatattaagcagcgaacaagagaacattttcaagagatgcgctatgctaaaagatccaaaatgtttgtggttggacatgaacatttcaataaatcattaacaatggatatagaaaacaagttaatgctctacatgactggtagtaaagccgttaaaaatttatccaacaagcgggctaacccgcagtataaatattttcctgtagaagagatgaacgctattttttcaaaaatatggcgtcagttacatagagaaaacaatcaattatttccggttgagaaggtaattgaagaaaatgcgctatttaaagcttccccttttcacaagttgacagaagagcaaatgaatgctgaaatcactattctggatcatataaagcaagcgcttaacgaagaaaaagagaatcagttaattctagtggaagggtcagcaggttcagggaaaacagtgttactaagttcattattttatttgcttagtggacaagatgaagaatttaaagggaaaagtgcctacatgttagtgaatcatgatcagcaagtgaaggtctataacaatatcgctaaaaaactaggtatccaaaagaagtttgatgaaaaagtaatgaagcctacaaagtttatcaataattttacagacaaggcggatattgctttaattgacgaagctcatcttttgtggacgcaaggaaagcagtcttatcaagggaaaaaccagcttaacgatattatggatcgtgctaaaattactatagcagttttagatccacatcaaatgcttagaactcaacaatatattgaagggcaaacgttaaaaaaattagagaaccgggctaagaagaatggccatttaattaaattaagtaatcaattgagaatgaacgcagcaaaagatactgtgaaatggattaaaatgttagtctatggaaatagaataactaatttaccaaaggatgataaagattacgaactgaaaatctttaagagcccaagtgaaatgtataaggcaatcaaagaaaaaaatcgagaccaaagtaaggggctttcccgaatgttggctacgtttgactgggaatttaaagaaaaacgggacaaaaaccacgatttatatcaagtaacggtagaagattttagcttgccgtggaatctacaaaccaaaagcaaagataagaatttatcctgggctgaacgaccagaaacaattaatgaagtagggtctacctacacaatccaagggttcgacttgaattacagtggtgtaattattggtccgtcagtcaaatatcgtgatggtaaaatcgtttacgatcctagtgctagtgcgaataaaaatgcggtatcaaatcgcacgttaagtgatggaagcaaagtgaaggtatataatcagctattacctaacgagctaaatgtgttgttaactaggggagttaacgggctttatatttatgccgttgatgatgaattaagaaaagcattgctagcagctcaaaatcaggaaatacaaaattaatgtaaaacatttcaaatttataggttgataaattactaattaataagaggttgaattctaatttgaatttcaacctcttattttgtcggattttaattttttaaaaaagattcacgataaaccattgcaatcggggcaatgattttttggtcaacattaccgaattagaaaatcgaaagaattactggtaaaagaacccaatttaagcgttgaacaaattggacataatgtgggttaataccaatagttattttattagtacttttaaatcacgcgagaaacttactcctggaaagtttagggagataattttgcaataaatagccaaataaaagctctggtcataccttaatcgctaattgactctccttaacaatcttggtatattcattttaggctaaagaaaacgctttcttaaaaggagaatcacaatgaaaaaagcacggtggaagttgttactcgcgggactagcattattaggtggaattagtttaggacaaaatattatttcagctaacaccactattcgggtaggaacgtataatttaagggcgcctaagaaaaatgacactaataaacaaaaagatttgttggaaaatgatcaagtagaaattgttggaactcaagagatcaattataaaaatcatcgtttttcaggcaaaagcaaatataatacgttaactaacttcaaggatgattactttaagaacattttttacagcaacgcaattgattttgcgggaggtgggtatggaattgcaacggtatccactttgccactgcaagattctaaaactttaaagctatacagtagtgaggctggaaaacatctcaaaaaactaaaaaaggcctatcgtgaatataatccagataaaaaatcaacggtgaaaaatttgaataagttaactgccaaatatggtaaaaaattagttgagccccgggtctatcagcgctcggttgttgaaaaagatggcaagaaaattgcgttttataacactcacttaagctacgagtcgacgaagattcggcaaaagcagtttaaagcgttggcaaaggcgatgaggaaggataacactccttataaggttttggtgggagattttaatgctgatcaaaatactacggaatggaaagctttcaagaagaatttcaacattaccaacggaaaagatggaatctggcgggatacctttattggagaagatccaaccatgaacgttaattcaattgataatatcattacaagtaaaaatatcagtatttctaatatccatactattaaatcgacagcgtcagatcacgttccgttggttgcagatttgacgcttaaataaaaaagttaaaaattcttattagcattcgcccgatgttagtaaggattttttgaaatttggcctttaaagaataaccgcttactacggtatagaaagagtagcttccctaggtgggcctattaaaagctggattacggataaaagcgctcaatagaatgctgtccgttaatggctttgataggctcacttttaagtagaatacaggaaaagatgctggtttgcgtatataaaaataggcgataaagtaattgcattttaaggcggcatgtatatactgaagatatacaagacaaaggggctgaatacattggcaaatgacagcgtaaaaattagaaaatctggcaactccagtattttaaccgttccaaaatcaattaccccaatggcaacgtcatatcgtgtttatcaaggacgagacgggatgattgtgtacgttcctgaaaaagataacccatttaaaaatgcagattttattgctgagcatgaaaatagcattcaaaaagaagcaggtggggggcagctttttaacaatgaactcgcagaacaatgagtacattcctgacaagcaagatttaattgaaattgattttgatccggcagtgggaaagaaaattaagaaacgtcgtccagcgctagtaattagtaatcggggatatagtcaagttacgggcttagtggtaattgcccccattactcacgctaataataatcggctaaaagattttttcgtaccagtggtgagtgcgaaagttagcgggtacgtgaatccgttacaattttttacgtacgattttagaaaacggcatgcacgtaagcttgatttgcttccgacgcccgcctttgtcgaagttcggcaatgcattttaaacatcatggattagttaattgtggtaaacaggttgttatttaaaaaatagcaatctgtttttttactgccagaaaagtgactctttttaagaaaatgtccgtcgctaaatttaacagtaaaccatgaccgattgaaaaataaaatataactatttcttgacaacctgctttattcgatatatcctaatcacatacttacaaaaagtaagtgaaattaaagcttactgaacgggggattcaacatggcaaaaatgaaggcgggccaagcgttggctcaagtattaaaaagttgggacgttgatcacatttacgggattacggccgattccattaataatacggtggacggactttaccaggaacgggatggcttgaaatacattcaagttcgtcacgaagaggttggttctttagcagcaacggcggatgcaaaattaactggtaaaatcggggttagttttgggtcagctggtccgggtgctacgcacatgtttaatgggctatatgatgcaaaaatggatcacgctccggtgttggcactaatcgggcaatctagtacggaagtgatgaacactaacttcttccaagaaatgaaccaagatccaatgtttgtggacgtggcggttttccataagcaagtggttagcgccgcgcaaatcccatacgtggtcgacgaagcgattcgggcggcctacgcacaaaagggaccggctgtagtaattattccggataatttatcaggacaagaaatcgactacacgccaattaagacaccgaagatttaccaacaaccggttcattcggcaattgatgattcagcgattaacgacaccattgcagcgttgaaggcggctaagtatccggtgctttggattggacgtggtgttgctggagcacgccaacaagttattcaattctctgaagactttcagacaccggtggttacggctgttccgggaacgggaattatgccgtcagaccatcctagttttatgggctctatgggccgcttgggaactaagccagcctttgaggttgctcaaaaagcagacttaatcttgtttgtgggaaccaacttcccatttgcccgcttctggccggacaacgttaaggttatccaggttaataacaatccggaagatttgggtaagcaacgcgatgcggacatggcgattttggctgacgctaaggaatttttggatgcggtattggcgcaaaacgtcaagcttccagcaagtaaatggctccaagccgcacaaaaggataaggcaaactgggacgcatggcttgaaaagttatccaaggatgaccaccaaggattgcgtgctgaaagcgtaatggcagtgatcaaggataacgctgcagataacacagtcttcgggctcgacgttggtaataatacggaatgggcaattcgccaaattccgttgaaccatgaccagaaatttacgttgtccggttggtttgccacaatgggttacggtttgccagctggaatggctgctaagttaagttaccctgatcgtccggtggtcaccatttctggtgacggtggctttgcaatggtaatgcaagacctgcttacggaagtcaaatacgaaatgccaattgttaacgtagttttggaaaacaagtcctttggttttatccaacacgaaaagttagttgcaaaccaagcaccgtacgggattgatttgcaaggcgcaaactgggctggggtagccgaaaatatgggcgcaattggtttgacggctacggatttgccttcgttagcgcaagcctttgataaaattgacgaacttcaaaaggcaggaaatacgaagccgattgttttagatgctaaaattgtaaataacgaccccgtagacacctcgttcatgccgttggatccccaaatcttcgatgaagcaaccatcaaagctttccgggaacaatacgaattgacggatggtcaaccagcactcagtgaaattttgaatgaacttggggaataattgtagtaaaaaaaccgtttggccattttgatcagacggtatttttatgcataaaagttattgattattattaaatataagcattagacatcactgaagggcgggaatattataaggtcatcaaatgaaaagaagggatctttaatggaaaaaattttgatcttaggtgcatacggcaaaaccgctcaaattgtaactgaacgtcttttggcagaaaccagtttaaaactgaaactctttttaagaaacgctaaccgacttgctgacttggaggataatccacgaatcgaattgatagaaggagatgctacagatgttcttcagcttgaagcagcgatgcaagatgttgaaatcgtatattctaacgttggcggagttgtcttagcgcaaacaacccaagcaatttttactgcgatggaaacaacaggggttaaacgactaattttctatagtgcattaggcgcccgtcatgaggttaagggaaaatttggggaatggaacgaaaaagcaatttccagttatttacctggcttccgtaaatcagcagcgttaattgacaaacatcaaggtattgatactaccgaactccgtcccgcttggttgactgatcaagacgaagtaaactatgaaattactaaaaaagatgaaaattttaaggggacggaagtttcacgtaaaagtgtggcagacgtggtggtcaagattattaaggacccaacacgttacgcgcatgaaagtattggaataaataaacctgatacagcgggtgatcgtccggcttggatgtaagattagctgaaaaaaactaggaaaaacgatatttcgtttttcctagcttttttaataagcaatttctaaagaattttagttaagggtacttttagcgttctcgagcgtaaattccttaacttggtcatcttggtgaacgtaaacctttggcaaagcagctaaagctgatacgtcgagggtgattttaccggctgccacggttactttgatctcacccaaaactttaccgagatgatccaccacgcgttgcgtatgggttccttcagtcatttgatagagatgcaattcaggagcttttgcataatcgtagtccgcatgttcagcgtcggggttcattagcaaaatactattttgtcgagccaacagcggtaaattaagatagtcatacttttcagtaatccattcaccgttctttgcaacgtcgtaaacctggttagttaggatgtttgtccacttgccaccgggaatgtagtacttaacggttccctgatcgttaaagattggggcaactaagaggtcggcgcccagcatgtactgcgtgtctagatgataggtgttttgatcttcaccaaattctaggaacattggccgcattaacggaaccccagtttcgtgagtacgaacggcttcgtcgtagaggtacggcatcaaggcgagtttgttctttacgaatttacgggtgacgtcaacggcttcttcatcgtagttccatggcactcgatattcaatattgccatggtaacgactatgcgaagataacaagccaaattgggtccaacgtttgtagatatcagcagaggcgttgtcttcaaacccaccgatgtcatgactccagaaaccaaagccagaaagaaggaaggagagcccgccgcgtaatgaatcggccattgaaacgtagcgggataagttgtccccgccccagtgaacagggaacttctgggatcctacggtagctgaacgagcaaatacagcagcttggccctcgcccttcttttctaacaagacgtcaaacacggccttgttgtaaaggtaagtatagtaattatgcatccgtttaggatctgaaccatcgtagtaaacggcgtcttcgactgggattcgttcaccgaagtcggtcttaaaggcgtccacgcccatatccattaattcacgtaggtaatctttataccatttggtagcttcaggattagtaaagtctacgactccttggccagcttgccagaggtcccattgccaaacgttaccatcgctatgtttaatgaagtagcccttttctttaccaaccttaaagagccgggacttttgactgatatacggatttaaccaaacgcagacttttagacctttatcatgaatccgtgaaattaagccttcagggtctggaaaagcgtccttatcccattcgaaactggtccattcaaagcccttcatccagaaacagtcaaaatgaaaaacgtctaatggaatgttacgttccttcattccgtcgataaacttcataacggttttttcgctgtaatcggtggtaaaggaggttgatagccaaagtccaaacgaccatgccggtggcaaagccggttttccggttaacgaggtgtagttagataagatttcttttggtgtcgggccataaatcacgtagtactcaagtgattcgccttcaatactaaattgaacgcgcgatgtattttcagaagccacttcaaacgaaaccgtttcgggctggttaacgaaaacaccatagcccttattagtgatatagaaggggatgtttttataagcttgttcacttccagtaccgccatccttttggacaatatcgacgacttggccgtttttaacgaaggaagtaaatcgttcaccaagtccgtagactaattcgtcaattccgatagaaagttgttcgcgcatatagtgagtttgatcgtcagttttagtaatttcaccttctgcgttcggttccgatttagtgattacttggccatttgcttcgaaattgatttcaaaatcgctgccatcaatggggaagtttgctgataaatctccagattggatgcgcaacgtattgtcatcagtggtggttgctagctttacatgctggtcatttaaatcaaagcttggatccttaggtaattggtcaaaatgggtcaacttgatgccaattacgttctttagaggggaagtgaccgaaacggtggtcattccaatattaagagtgtccccacgttcgttaatttttttgtacggggcgtaaatttggacgttatcatcattgattttataatcgtaaacttgtttggggttgttaaccgcgaaaccttccttagttaaccaataaccgtttgtaaatttcatgagttggattaacttcctttctaattaaaagcataacagtgactggagtaaataaataaaactaacaaactcttttcgaattgaattgtaagcgaatacaaacggagtgtcaaggatcaaaaaaattattgaaaacgctttacaaaaaatacccggcatgtataatgaggttcgtaaacaaaactaactaacttttttcgcgaaccaaaattttaaaagaaaagggtgtttaatttatggaagtaccacatcgacatacacatagcttagtatcttggaaggaacggattagctacgcagtaagtgattttgcgtgtaatttatcgtttcagatgatcggaacctacttaatgtttttctatacggacgtttttggcattaccgcagcggccgttggaactttattcttagttgcgcggatcgttgacgcgattgacggaccaatatgggggttattgattgaccatactcacacacggtggggcaagagtcgaccgttcttcttatggttctcaatcccatttgcaattttctgtgtgctttgttttaccaccccaaatttaagtatgggtggtaaaattgtatgggcttacatcacttatattggggttgatattttatattcggcagtcaacatcccaatcacctcaattttacctaacctcacggatgatacggacgagcgggttaccctaagtacgattcgccaattcttcgggactgccggcgcaaccatcgttacggtagctgcgttgccaatggttaacttctttggtggaggcaaccaacaaaagggattctttattagtgttttgattttagctattatttcggcagcactattgttggtaacttttgcgaacacgcgggaacgcattcagaccaagaattcaagaaaggcaattccaatcaaacaatctttgaaagcgcttaaaaataattggccttgggcaatcgtaattttcattaactttgtttactggttaggtatgcagaccaagagtcaagtaaccgtgtacttcttcaaatacaatatgcataacgcgggattagcctccctagtattaggaattcaagtagttgcgttagtggctgtaatcctcacgcctgcttgcgctagaaaaattggtaagcgtaacacgatgttgttaggaatgcttttggcaattgtgggtcaattagttttgagtattggtgctagtcaactaagtgtttcgattatcattattgcaacggtaattggctacttaggaactgggtttgtttctggcttaattgcggtaatgttggcggattctgttgactacggcgaatggaaaaacggcgtgcgggctgaaggaatcgttacctcgttttctagtttttcagctaagttaggaatgggtattggtggtgccgtaaccggtctgattttaagtgcaggcggctacgttgctaacacagctcaaaccgcaacggctcttcgcgcgattgaacaaaattacatttgggtaccaattattggttttggtttatccgcaattgctttattattctataaagtagacggtgttgaagataagatgcaagcggacttatcggcaaaacacgcaaaagaaaataaaaacgctgattaagtaggctaattcagcgtagtttaagggagcaagaaagaatggtaattcataaagagacgatgcgaaccgctaacgagcgttcagtactacaacgaatttttacggaaagtccgatttcgaaaagtcaaatcgcacgagacgtgaagttaaataaggtgaccgtttcccaaattgttaaccgcttcattgagagcggattggtagtggaagcaggcgcaggagatagtacgcaacaaggtgggcggaagcctaacttactgcaaatcaacgcccggtacggttacgtggtttgcattgacctcggatatcatgaattatcagcgctggcaatgaccattagtggccaaaagttagaaattcggcgcataaactttactgataacgatatttccagtgcaatcagcaaaattaaaggactgattgcggaattaaagaccgaatacggagaaaagaatttaggaatattaatttcagtacatggaattgtttatcaaaatcaagtgatttactcgccattttggaacatgcatgatgtcgatattgccgctgtattaaccgaatcgctaggaattacggttttgttggaaaatgaagctaacctcacggcaatttttgaaagagattttagttcagaagggattcgaaatgcggtaagcatcagtatgcataaggggattggtgctggaatcatcatggacggtgaattgtatcgcggacgtaaaggtgaagcgggcgaaattggacaaaccatcgcgtttgaaaccaaagataaatcgttagcggaaagccaaaaaattgaagacgttgcctctcaagaagccgttttagaccaaatcaaacaggctaaaaatttagactacatcaatttaccgttgattcgccaaatgtatgatgaccacgatccggagactttagaaattttacaaaggttcgaaaataacattatcaagttaattaataacgtgattgtgtcctttgatccagacgtattgtttattaatgcgtatatttttaaagaatttcccgaactattagaacggattcgaacaaagtttgccaaaatttccgttcgggataccccgattgtattgagtaaaaatgtggaaactgccagcctttacgggggttgtgcacaaatgattcaagaaattttaggattttcgaagttgaaattagattttaaatcaaaggagtaacaataatgagtgaatattgggattttaaaaaagttggttacgtcggtaacaaaactttaacgtcgggtgatggatttcatttttataacccagaagaagtgattttaggcaaaaaaatgaaggactggctccgcttttccgttgcctactggcacacttttgatcaacgactagtggatccgtttggggacgggaccgcaattcgtccgtacgataagtacactgatccaatggataacgcgatggctaaggtggaagcatcgtttgaattttacgataaattaggcgtggactacttctgtttccacgatcgggacctcgccccagaaggtgatacattacgggaaactaaccggaacctagacaagattgttgacaaaatcgtggaataccaaaaaacaactggtaagaaagtgctttggaacacggcgaacatgttcaccaacccccgtttcgttgccggagcagctacaacgccgttcgctgatatttacgcttactgtgcagctcaaattaagcatagtttagaaattggtaaacgagttggtgcagaaaattatgttttctggggtggtcgtgaaggatacgaatcactttggaatactaacatgttgaaggaacaagaacacgcagcgcaattcttccacatggcaaaggattacgcgaataagattggttttgacgcccaattcttgcttgaacctaagccaaaggaaccatcaacccaccaatatgattttgatgcagcaactacaattgcgttcatgaagacttatggtctagacaaagatttcaaattgaatttggaaggtaaccacgctaacttggccggacacacttaccaacacgaaatccgggttgcccgagaagctggaatgctgggttcacttgatgctaaccaaggggacaagttgattggctgggacattgatgaatacccatctgcactatcagaaaccattgcagcgatgtttgaagttgttgaaaatggctccattggtccaaggggtggtttgaactttgatgccaaaccacggcggcagtcatttgctgctaaagacttattaacgggccacatggtcgggatggatagctttgcggctggtttacgagtagcagctaagatgaaggaagatggcgtaatcgaaaacattttgaatgagcgctatggttcgtttaatagtggcatcggcaagcaaatcgacgacggtaaggcgaccatcgaagaaatggaagattacgtcattgataaaccccaaaaggatttattggccgcgacgcattcaggtcacttagaacaaattaaggatacgatcaatcattatatgattgaagtactggcgaagtaaataaggtacggagaaacccgaataaacagcgaggattaactggttcacgtaattaatcgtggtttatgcgattagttatgtaatttggttaaccgcagaagctgaaggttcggagcacattgcagttatgcagcaggtgacgctgcaatcatgcgatgcgcgtgtgttgaaagcattgaatgttgggggactaagaaaaaagatttttcttggtcctcttttaatataataggtgggtgaaggaaatggcatatgtattaggaattgatttaggaaccagcgcggtaaaggtaacggccgtaaaccgtgctgggcagattgtagcgcaaagtagtcaagaatacgcaattagcaatccgcaagcggggtatagtgaacaaaacccggaagattgggtacagaaaactacgctagcaattcaaaatttggcagcggtggaacatttagatttgtctaaagttgaaggaatcagttattcggggcaaatgcacggattggtactgatggacaaaaactaccgggtgttacgaccagcaattttatggaacgacacccgaaccactgcccaatgcgaagaaattacggataaattaaggggagattttttaaaaatcacccgcaaccgtccgttagaaggctttaccttgcctaaaattttatgggtaaaggaaaatgaaccagaaatttttgcgcaaactgaagtcttcttactgcccaaagattacgtacggttccgcatgaccggcaaaatcgggatggaatattccgatgctgccgggacggtgtggctagacgaaattcataaaacttggagcaaggaaattgcggataaattggcgttaccgttggaaatctgttcaccattattagaatccactgccgtcgtgggaaatataaccgtagcttacagtgcaatttccggtttgcctgttgaaactaaggtgattgctggcgcagcggacaatgcggctggtgcaattggtgcggggattattagtgaagataaaattttatccagtattggtacctcaggcgtagttttggcttacgaaaaagatcgtaaaacggattacgccggacgattgcatttctttaatcacgcaattccggacagttattattccatgggagtgacgttagcggcgggttacagcttaagttggtttaagcaaacttttgcaggtcagcaaaagtttaccgacctagtggaagatgctaaaaaatcgccgatcggtgctaaggggctgctatttaccccctacattgtgggagagcggacaccgtatgcagacgctcagattcggggaagttttattggcatggatagtcgccagcaacttcacgactttactcgagcggtaattgaaggaattaccttctcttttcgtgacttgttgtcgatttaccggtctgaaggcaagcattttgtaactgcggtagctacgggtggtggcgccaagagtgcgctatggatgcaaattcaggcggacgtttttaatatgaacgtagttagtcttgaaaacgaacagggtcccgggctaggtgcagcaatgcttgcggctgttggagttggttggtttaaagatttggcagaatgttcggaaacgtttgtgaagtatggaaaagtttaccgtcctaaagctaataacgttgcgaaatacgaccgaatctaccgaatttaccaacaagcatactcagcaacccgaccgatgaccggtgatttattaaaaattgataattaggctactatttgacaaagactcagaaattttctgggtctttttttgatgatgatggatatatagggagggattatggtggttaagttcgtattctagcgaaaaaaacattaaatttgtcgtgtgataaacatttttttgccaaaacctgccatttgacattttatttatcggtacttcgtaggaaaatttaaggcgtcaaataaagttttagtaatggtaggttaagttaaggagttttgtatgaaaaagatatggatagattgcgatcctggtcatgacgatgcactagccattttagttgcgttagctaatccagagcaattgcaagtgttaggtgtatctacgattggtggaaatagcccgttggaaaacgttactaacaacgcgaagaacttattgaatttactaggggcgcaggttcctttaattaaaggtcaggcgggcccgctagttaaagaactgcaaagtgctccggaagctcacggggaaaccggcatggcggggctagaatttcctgacaatgattatccgattttagaagtgaacttactgcagtatatgtttgaaaccatcatggctaatccagaaaaggtcgatatcgttgcaattgggccgttaacgaatattgcattgcttttaaaggcttatccagaagttaagacaagaattaaccaaatttgtttgatgggcgggggaattgatcacggaaattatagtccggcagcggaatttaatttttacgtggatcccgaagcggcgcaaatcgtacttaacgcgggcgtaaaagtggtgatggcgggcctggacgttactgagaaatcatacgtaacccgggaagaaattgatactctgcaaaccaagggccccatttcccgtaaaatttatcaattgttagacttctataatgtttcggggcggcaatttggcttcaaagatagtccgttacatgatttgtgcacggtggtttacctattagatcccactactttcacgggtgaaattcaatcggtatcggttgctactgaagaaggcgttgcccgcggaatgagcattgccgacactagaaaacagcctgaatggcggaaccgaatcttggtactgaagaattctaatcgggaaaaatacgttaaatatttgatggatggcctagaatatttcgatcatcacgtaggctaagaaagcgaggactttttgatggaaaagcgggtaaaacttagagaccagttattgaaaatagttttgggaattgcacttttaattggaatttatttctcctttcaacaaacctttccgccaatattaaataattcgggacgggcagttcaagaattatatatttgggtttccattatttcgatgttcgcgggctttgtgaatatttatatgaccactaaacgggacgtgaaatttatctaccctgatttggtaaatttaattacgacaatcattgcgttatttttggcacagacctattcaatgctcccgatgagtttttgggggattattgttgcatttatccagtattttgactggaaaaaccaccatactgatgacggacaaacccagcttaaaagaattgataaacaagcaattatgattcttattttgggcatagtaattgcgtttgtaattattggtttcttgattttgattggtcacgagggacaagggttattgagtggggcgtttaccaccgggaccggtttgattgcgagctttttacttgctaaacgttattttatggctgaatacctcttcttcttactcaacgtgctaatgcttacaacctatttaatttcgggtcaatttacgctaatgattattccaatggtttactttgcaaataacattattttccttgtgttcaaccgggtcagcgattacgaataaattggattaaaagatggtatgatctgtttaacggtgtagtagttggactagccgaaatatacggtgtggttggggatcttaatgacaaacatgaaactaacgcaattatggcaacattaccagagcgataacttatttaattacgcaagcgtgcgtccttttttagaagaatatggagaagtggttcaattttcaaagggacggcagttaattgaacagggaggttacccagaatttgtgtattttatcgtgaagggattggttgtgggtaaaaaaatctaccgagacggtaatgaatttacatattttttggcagacaataaggcgggcaacatcggattgttagaggtgttagcacatcaagttcactatgccgcagcggtagaatgcttaacggacgttactttggttaaagtgccggcgccgttgatttatcaaaaaataatggaagatccggtgttgttacgagaatgcgtagctttgttagctaatgatttatacgaagtttctaataaagaaggtcggttctatcgattacgagggattgatcgggcgcgaatttattttgtggaatattacgaaaataatcgatcggacgaagatcgggtagcggtcgataaaaagcaacgggaattttcagcagaacttggaattagcatccgcacggttgatcgagtaattaaagaactaactaaaactaaggagatccagtatgttaaccggaaagtgatgattaccgcgtctaattaccagcggatgatggctaatttgacgaataagggcgttagttgaactattaaaaattaaaaaacggaggctgggaaaaagtaaaaaaatgcttttcaaggatgaaaaggttgttttggtgttttgacttcaagagagccaaaacgtgtgccaaaagacagtttgttccgcgtaaccaaaaattgaccattatgccaaattcaggcataatggtcaattttcagttaatgctcacaaattgcccgacttttgtcccactctctattttttattattcaaaatgataagttaaattttcattgcgaaattcgccaggggtgatccccataaattgtttaaacgtgtgcacaaagtgactttgactagaataatgcaataggccactgatttcttttaatgaaagttcggtaaatagcaataaatgcttggattcctgaattttcttgtggttaatgtacacgtgaatcggctggccaacttcttttttaaactgggtagagattgaagttttatgccggttagtgaaatcagccaaatcagcgagggtaatccgatcgtaaatatgctcaccgatataatttagtattttttgcactaattggtttttggttgcgtattggtaggaatggatcatgtccataaatttgtaggaggcttcctggacggaaaccaaacattccgcgtaagtataaatgctttgcaaacgttgcaatagggcgtcagaaaggctgaacgcttgctcggctgggacgccgtcttcgatgctgacccgggttaagatcgtgattaatcccgcatatttatatttcaaaccctccaagtcactgtccgatagtttgactttgtaggtatccgccatctttttgaacaaccactttatcttatccggctcgtttcgccgaattgcttcaatgtaacgccgttcaaattcgtaggagtcaagggtgtttttctgatcgcggcgactcgaaagattttgggctaagtgataattggtggatttatagactcgatcataataccagtgctgcttttggttttggcccaaagttccacggatgattgcaaaaattaagttagtaaattgctcaaacccttcccgagaagatttactgtaatggattccagcaaaataagtatgtccctgaaaatggattgaatctgatccagcttctaaagcaccacacggcccaatcattacggttccagtcccgtattcgggaagttcaaaagcaaaattactataaaagaaagcgcccttcttaaaataacgaatctcgttagggtgggtttcttctaggacttgttctttaaagttccgcgaactccagttagttttgggaatcacgatttcgtattgatcattaactaggaataaaggaattaaatactccttgtataactgatctaaaacatattttaaagttgcgttatccatgatcatcccgtcctttggcttagctattaactttatcctagctggttgtagggggaaaagcaattagaaagggatttttgaaaagtgggacatgtttcataaaatgacacgcgttacaagtcgtgaatgcgagttgcaagaccgttgaaaacgctttaataaacaaaagccgcccactatgatgtaaatgtaaacaagctaagttacatgaaaggaagttttggaaatggcaaaacgcgactatatcgatacaaatacttacacccaggaagaaattaggttcatgattcacctcggtctgaaattaaaggaagccatcaaaaacggatattacccgccattgttgaaaaacaagacgttaggaatgatttttgagcaaagttctactagaaccaggacgtctgcggaagctgcaatgacggaattaggcggacatgcgcaatatttagcacctgggcaaattcaacttggtggacatgaaaccattgaagatacatctcaagtacttggtcgaattttggatattattggcgctcgggttgatcggcacaagacggttgcggaagttggtaaatacgccaaagttccggtggttaattttatgagtgattataaccaccctactcaagaattgggagacattattaccatgcaagagcaccttccagaaggcaaacaattgagtgattgcaagattgtgtttgtgggagatgccacacaagtctgcgtgtccacaatgtttatggcaactaagatggggatggactttgtacaatacggaccaaaggggttccaaatgaaagacgacgtggttaaagtgggcaaacaaaacgccaaaaaatatggcgggagtgtcacaattactgaaaatgctgacgaagctttacaagatgcagattttgtttgcacggacgtttggtacggtttgtatgatgatgaaatgccaaaggaagaacgaatgaaaattttctaccctaagtatcaggtgaacgccgaattgatggcaaaggcaagcagtcacgttaaatttatgcattgtctaccagctactcgaggggaagaagtaactgatgaagttttggattccgattattcgattgtttgggatgaagcggaaaatcggaaaacggcgatgcgagcgatttttgtttatttactgaatcccaccttagaatatgcttcgccggcagtggcagcgcattatgatgctgaattagaattaatgctacggaatgctcctgaaagacggcaaggctaaccccgttttaagcgcatggtgcgtgatagattggagattatattatggaaacgggaaaaaagaaattcaaactatttgatgcagtattgatgtcggtagtggtaattttggtagttgaatcagctgctccggctgctgcaattggcacttcacaattcttttggtggatttttctcttagggttatttttcttgccttacggtttaatttcctccgaattaggaacgacttatacgggagacggcggtttatacgactgggtgaaacaagccttcggttctcgatggggtggccggctagcgtggctatattggattaactatccgatttggatggcgagcttggcagtgcttttcacccaggtggcggaaaccatttttaacttaaaactaggaacgtggcttgcggttggtattcaattaattttcgtgtggttcgtggtaatcgttggtaaccaaccggcctccgaaagtaaatggattatgaatttagcagcattcgcgaaaatttttaccatcctttcgttaacgggattaggaatttacgtagcggtaactaggggagtggcaaatagttttgcgccgcgggaatttttaccccaaatgaacattaacagtctaagtaatttatcgattattatttttaatttcctaggttttgaagtggttgctaccatggcggatgatatggacaatccgcgcaagcaaatcccacaagcaattatttatgggggagtcttaattgcagttttctacttgatgtcggcctttggcatgagtgcagcaattcctaccaacgagttgtcagcatcgagcgggctactagacagttttatcctcttgattggtaaaatgaactggtttgtcgttgttattggagttttattcttgtacattttagtttctgaaatggtatcttgggcactaggagttaattacgtggcggattacgcagcgaaagatcatgttttaccaaacgtatttgggattgaaaataagcagcacatgccggttggaacagggtatttaaacggtgtggtagctaccatcttaatcgtggttgcccccctgattcctaatcaagacattttttgggcatttttctctttaaacgtaattgcccttctgctttcgtatacaatgatgtttccagcctttttaaagctccgcaaaattgatcctcaacgagaccgcccgtttaaggttcccggtgggaaggggttactgtggtgcatgacgtggattcccgagtttttacttttactgacggtaatctttactgcagtacccttgaatactactgctgcagaattatctgccaaggtgccaattttaattggggttattgttaccctagtagttggtgaattagttgttagaattgctgaacgtcgagaagttaaccaacgtttaaaaataaaggagacgcaaaaatgaagaccttagatagtacccctaaaaaagatggatttagaatgccaggagaatttgaagagcatgcgggtgcctacatgttatggccccaacgccccgataattggcgaaacggcggtaagcccgcccaaaaaacttttgcgcaggtagccgaggcaatcgccgaatttgaaccagtgacggtgggcgtgaatgacgatcaatacgaaaacgcccggaatatgttacctgaccaggtgaaagtaatcgaaatttccaacaacgattcttggattcgagactgtggcgcgaccttcgtgaaaaatgatcacggagaattacgcgctgtagattggacgtttaatgcctggggaggtttggtagacggactttatttcccatgggataaggacgatcgtgttgctcagaaaatggcagaattggaacaaacagatcggtaccggctggatgattttgtgttagaaggtggatcaatccatgtggatggacaaggtactttaattactacggaagaatgcctattatcggaaggacgcaatccgcaactctctaaggctcaaatcgaagaagtgcttaaagaacaccttaacttggaaaaaatcatctggttgaagaagggaatctaccaagacgaaacaaacggacacgtggataacattgctaattttgttaaacctggggtagtcgcccttgcttggacggatgatcaaaatgatccccaatacgagatttctaaagaaaacttggcgattttggaaaatgcaacggatgcccaaggtcgcaaacttaaggtggttaagttaagagttcctaaaccagtactgatcactaaagcagaaagtgaaggggtggacgcggttgatggcacgctaccaagaacggaaggcgagcgtctagcagctagttatatcaactactacactgcaaatggcgggattattttcccactatttaacgaccctatggataaggaagctcaaaaagtgttgagcgaattatatcctgatcgcaaagtggtaggtgttcccgcacgagaaattttacttggtggaggaaatatccactgtattactcagcaggttcctcaacgctaagatgaggaaaataattgaggtgggaagaaaagcataatcctacctcaatttttattttcaaatatggaaaactaattgaatgaaattagcgtgtgctccatgttttgagagtaaaattaattattcgtaattcagcaatttttcgaataaagaaggagaattacgaaaaaaagtcagaagggattaattggcaatgaagttaacaacaattccccaacaggatggtttttggatgccagccgaattcgaatccaagggacaaagtttaatgatgtggccgcaacgccccgataattggcgtaacggtggtaaaccagcacaaaaatcttttgtacagttagcaacattaataacaaagtatcagccagtaacggtgtttgtaaacgaaaatcaatataaaaatgcgcgagcgatgttacccacccagattcgggttttagaaatgagcaataatgacgtttttattaaagatacgggaccgattgaattggttaatgctgatggagtggtgcgttgtatggactttgggtttaatgcctggggcggattgctcgatggtctttattttccttgggataaggaccaggaggtaaccggaaagttagctgacttatttggctgggaccgttaccagtcggactttattttagaaggatgttcggtagtggccgatggggaaggtaccttgattactactgaagaagtggtactttcggaagggcgcaacaagggaattactaaggctcaagccgaagaggttttccaaaactatttgggtgcccaaaaggtaatttggcttccggaaggatttttcttagatgaagctgggggtgacgtggataacatggttaattttattcgaccaggcgaaattgttttgtcgtggaccgataatccgggcgatccgcagcaccggattagtcagcgtgcttacgacattttaagtcagacaacagatgcccgtggacgaaatttaataattcataaaatggatttgccacagcgtccggtaaaattgacggcactggaagcagaaggggttgatccaattaacggaatgttaccccgcacggaagggcaacggttaaccgctacttatgttaattatattacgcttgaccaggcgattatttttccggaatttaacgatcctaacgatcaaaaagcccgccaagagttagctaattattatcccgaccgggaaataattggttttcccgctaccgaaatattaacgggtgggggcggattacatacagtcgtgcttaacatgccgggacattaatggagggtggcttatgaatttttttgacattgtagagtcacatctcagtacgttaaccaaaaatgaacaagcactatttgactacgtagtttccaacatggataaaattaaaaaccaaagtattcgcgaagttgctagtgaaacttacgtatcaacggcaacgttcctacgtttcgtcaagaaaattgggtttgtggggtttagcgaattcaccacggtaattaaatataccgtccttaacgaaaaaaacgagcaagaaaaagagatgccgttcgaagttagccaggttgattatcgagaagaatacctaaaaaatattactgaatcagtccgggtgatcccacctaagaaattacacgagattactaaacaactggctaatcatcccaccatttacctgtttgctaaaggaattagtaagtatgcggcagattacgtatattacgtttatacgatggcggggtttacggtgaagtatccccgggatcgcgattttcggcgaatggcgattaaacaagttaaatcggatgatttagttttcatgcttacgtataatggccgtaatcgcgagtttttagaaatgattaaacagttaaaaggagcggcgcaaacaccttttttaatttcaatcactgagccggataacaacacgatccagaatttgagcgatattaatttatatatttttgctgacgtaatcgaagttaatgacgttgaaatcagttcacgagtttctacaattgcgttgatggaattgattttgtaccaatatattgaagattatggcggtcaagattttaactttatgaaaaaataaatagtggaattggaattcgttggagagaattctaattccactatttttgttatccctggcagacaatattaaggatggcaagcagccatcgtatttcaaagaaatttaatggtcaatttactacaaattcatccagcaagtgctatgcttaacgtaacaagaaggttcattgaaaggagctcattcaaatggatattcaaaataatttgattacgttggcagatggcaatcagatgccacaagaaggctttggattatataaagttcgtggacaagcagcggttgacacggcggtgaaagcagcctacgaaaatggctaccggttgtttgatacggcacaactctacgaaaatgaacaagaagtgggaaatgcgtttaaaaagtttgcgattcctcgggaagatattttcgtgactaccaaagtgacggaggcacggcaaggctatgatgaagcgattgcctcggtaaaagaatccctgcagaagttgcaaatggactacgtcgacctgttattgatccattggccagttcgtcaacacttttttgaaacgtggcgcgcgtttgaggatctgaagaaggcgggattgaccaagtcaatcggggtcagcaactaccaaactattcatttggaatatttggcaactaaggcgcacgaaatgccggtagttgatcaggtggaaatgcatcccttcttaacccttaaaccagtgattgaatttaataagcgacacgacatcgttacccaggcgtggagcccattaggacgcggaacggtgcttgaccaaaaagtgcttaaggagattgcggataagtaccaaaaatcgcctgcccaagtggttttacggtggcacttgcaaaacggggtggcgttcatcccgaagtcggtgcatgaagaacgaattgctcaaaatgccgacatctatgactttgaactgtcggatgaagaaatgaagcaagtcgacaagctaaataagttcgcaagaacgggccgcgaaccagaattgacgtatgaatatgggcggatgtattaaaaagagcgtggaagccaccgggtaattttcgaggattaactggattttaggtttaatcgcggtttgagtgattagacttaaaatttggttaaccggaaaaaattggtggctggaacgcgtttcggcaaagcaacagggggcgcaagtccaagtcattaaaaaatatggggactaatcgaattttgtcgattggtccccatatttttttgctagctataaaaatctagggttaccaaccccaccttgcgcacttttctcccctgggatacactatccgtaaattgataacgttttcatagtagttaggagaggtttttatggtgaaggatcaagtagcagcaatgctgcaatcggtaacggaaagagaagattggcaagaacacggcgccactgcggaggactttagccaacggttgggagtgcggcggaacacaattagtgcgtacttaaatgatctttataaagagaaggttgcaatcaaacttaattcacgtccggttaaattttgggatagggcgactttagagcaacgatacggcatcgttttagaaaatacagagtttgaaagtcaagcggcgttggaaaacattgtatctcagcctaaacggacggcctttgacgaagtaattggtggacacggttcgctatacaccccaattgaaaggctgaaagcggccgctggctacccaggcaccggattacccgtgttaattaccgggcctacgggagcaggaaaaacttatttagcgcaagtttattaccaatattgcgtggataagggttatttagcaccagaatcccgctttgtacacctaaattgcgcggaatatgctgacaatccggaacttttagcaagtaatttatttggttataaaaagggggcctttacgggcgcgaaccaagatagtacgggactatttgatgaagcagatggcggaatgttatttcttgatgaaattcaccggcttgatgctaagggacaggaaaaattgtttaattacttggacaacgggataatcacgccgttgggtgcaactaaagaggggcatcatgtacaagttcggctagtttttgcgactaccgaagatattcaaagccatttcttagacacctttattcgccgaatccccattcaaattgaaatcccagaactaaacgaccgaccacgtcaggagcgcgaaaacttggttaagttattttacctccgccaatcccagaaaattcaacgcaaagtgttagtaaatacctcggtgctgaatattttaagttccagcagttaccttggtaacgtaggtcaattaaagaacaccatcttaatttcggtggccaatagtttacaacgggcggcgcaaagttcgaatattgaaatcttattagcagacgttcccaaaacggtaattgaccataatattcaagacgcgagtttgctatcgtttagcgaccagttcatcagcgtgctgccaaccatgaaaattgatgatttaatctccgaatcccaggcgtataccgatgaaattaaacgggttatgttaaaaattattcagcaattccaacaaacggccaaacggaacgccttcattgacaatgccatcgacgaaattaaccaactgtgtgactacttaatttttaagaaggatacggaaaaaagcgacatgtcggtgggctttttgaaaaagatgtttgccgatcgaattgctaacgtcgaaaacaatagtgacacccagtttatgggcaacgtcgcgttagttttagcgtactacttttacaaccgtaaccgtgctaactggcatttggtacaacgcgacgaacagtgcattcagcaaattaacgccacttttcatggcgaggatgcggaaatcgatcaaattgttgtggatctgcgtttaattaccgcaaagaccatgaacttgcatcttgacgacgtggatgagctatttatccatctgtacctacggagcgtgaagaaggaaaccaatagccaaaacattcgttgtattatcctctctcacggttattcgaccgccagcagtattgccagcgtgatcaataatttatttaacgaacacgtaatggacgcgattgatatgccgttggatattgacgtggcggagattggcgaaaaggtcagcagttacgtgaaaaatcgccaaattaaccggggactaattttaatggttgatatgggctccttggagggcattcaaaagttcattagcagtgagattgattttccgattgccattgttaacaatgtctcaactcagtcagcgttgctagtggccgatgatattcggcatcataaagatattgagcaaatcatgcgaaacgttcggcaggcgatggtgcctaaaacgcaaattatctatccaaaagaaattaagcgcaatctaatcgtaacctgctgctttaccgggattgggacggctaatagtgtcaaaaaactgttgttagatagcatgccggcagaagtggactgtcaaattcaggcctacgaggttgaccggttaaaggctgaagaacaaatcgccatttttaataagttgtacaacgtggtggcggtagtggggacgattgacccggggcttccgacggccccatacatttccttggaaagcattatttccggaagcgagatggagaagttggataaggctttgcaagtatgcatgactacggagcagctccaacagtttaaagaacaactgattcacagtttttcattagagcgggtaattaattccattaccattctggatgcgcatttggtgatggataatattgaccgcgccattaataaatttaaccagttaagcgggcaccagttaggcaacatcacaaaaatgtcgttatacgtgcatgtgagctgcctaattgagcgattaatccgaaacgaaccgattaccagctatgatttagaacagctttccgacactgaagaccaacggctttttaaatggataaaagagtcttttagtgtgattgaaaaaatttatagtgtcgaaatcccagcctccgaatacggctatattttcgacattatccaagcagatgcctaaaaatcagtgacttgactgaataaaggaagggcgtgccagaagttggcacgccttttgcttttataagggtgtaaggaaatggtaggtgataaggtttgaaaattatattagcaagtcatggcgccctcgcaaaagggatgaaagatacgttagatatgattgtgggaaatcaggtaagtattcaggcatattctgcttatgatgaggaaaatgtcgattttgcttcggatattagccaacagatcacgcgagaagtaaatgagcaattcattatcgtgactgatgtgatgggcggttcggttaataatgcaatgactgaattagtgctacgttataaaaatgtttttttgataacggggatgaatttgcctctagtactatcattagcaacctattcaggagacatagatttgaaggcgcttgatgaactagttcaagaaggaaagcgaggattgattaacgtaaataaaatggttgaatctgcaaaggaggaataaaaatgattaaagtaatcagaattgatcatcgtttattacatggacaggtgatttttgcttggaccaagtcgcagggaattgaacgaattgtggtaattgataacgttgcggctggtgatgatttcaagaaaatgtcattgaaattatccaagccagcagacattaaattgagtgtgtttagtgttgatcaagctaaggaacgaatcgccaaaataaataatttgaagagtaataccatgattatttttggagatgttttgcaagctggacagattgtcccacttttggaaggggttaaagaaattaactatggaggtgttaaaaaccggccagacacgaagcgattcagtaatgcagtttttctaacggaagaagaagttaagtgtagtcaggaattaaagaatctaggttttgatttgtatatgcaacaagtaccaacctctaagagagaaagtttaaatgaactaatttaggaggttagatatatgcttttaaatgccattttacttggaatcattgccgtatttgggacaatggattccagaatgctggggcggactaactttgagcaaccactagtaatggcggccctagtaggagttgctttgggcgatttaacaaaggggttaattgttggggcatctctagaattaatattcatggggatagtaaatattggggcggcagctccgccggatctagttttgggctcggtaatggcaactgcttttgcaatcttatcggatacaaatgctcaaactgctttaactattgcccttccggttgcaatcctaggacaaatggtgggaattcttttacgaatgtttatgtctacttttgttcataaagcggaaagcgacatagaaaaaggcgagtttgccaaagctagaaggtttcacattctatggggccccattttatattcattgatgtatttcgtacccgtatttgttgccatttattttggagctgatgtagttaaggaaattgttcaatcgattcctgcttggcttactaatggattgaatttagcaagtaagatcttgcctgcgtatgggtttgcactactaatgcaaacgatgctgtcgaaaaagacagttgcatacttgttattaggattttttatcaccgcttacgcaggcttgtcagttaccggtgtagcaatctttgcggctttacttgtaattattttaaacgaaatattgcctaaaaatagcgtcgatcagggactaactagtgatgaagacgatgatttagaggagctttaggaggtgagatgatggctgaaaatacacaaatagattcaaaaaagttaagaaaaaagtattggtccttcttctggcgttcttatgcaatccaagcctcttggaactatgaaggacaaatgaatttgggctttctgtacggaatcgcaccgactattgatagtttatatagctctaaaaatgaagaagacttgcaacgtaagaaagaggcttacaagcggcacttagctttttacaattgcactcctcaaactagtgcatttgttctagggctggcttcttcgatggaagaagagtatgctcgtgaacccacttcgttcaacccggattcgatcaacgcggttaaagcatcgttgatgggaccactatctggagttggtgattcatttttccaaggaactattaaagttttagcgtttggtttaggagttaactttgctagacaaggcagtatcctgggaccaattttagcaatcttaatttcatttgttccggcagcgttagttacatactacggtggaaagttaggctacacagctggaaatagctttttgaagaaacttactagtcaagggattatggaccgagcaatgtatttggtaacaatcgttggactaatggtaatcggatcaatgattgcaagtatgattggaattaccacgccaattcacatgggtaagacgtttaatctccaaaagacgttggacaccatcttccctcagatgattccgttattggttactttctttatgtattggttgttgcataaaaaagttaaaacgggatggatccttacaatttgtattttaagtggtttattattcagcgttttagggattttagcttaaacatagtaatcagttaataaaatattttaattatattaggaggaatttttattatgaacatgtcacctaaatcaattattgcggatatcaagaagaaaaatagcaaaattaaccgagtgatctttaccggctgtggggcgtcgatggcggacctatatccaggatactactttatttcgcacgaaagtaagcgcttcttatcggcttttatgcaagcaaatgaattcaattatgacactccacaggatgttggtgaaaacacaattgtcattacagcctcacttggaggaactactccagaatcgattgaagctaccaaacatgcccgtgaattaggtgctcacgttattacactatcgcacatgccaaattcaccaatcattaatgcagctgaatatggtttagtacatggttttgaagaagactacgcacataagacagaaaaaatgaccttagcacttaagttagcaatagaaattgtaaatcagtttgaaggttatgaattttatgaagacgcacaaaaagcatttgatggattattcgatttaattaaccaagaagctgcgatggtcgatccagctgcagaagaatttgctacacgctataaagatgagaagaatatctacgtgattggtagtggtgcaagtgcggatgtagcctactctactgcttcattcttatttatggaaatgcaatggattagtgctccaaccattcattcaggcgaacttttccacggcccatttgaaatggctttgaaagacacaccatacttactatttatgaatgacggtaagacgcgccacctagacgcacgggcaatggcattcctacaacgctttgacactaaattaacaattattgacgctaaagaccatggactagcatcaattgcttctaagaatgtaattgattactttaatccaatgttacttacaggagttatgcgggtttacgcagaaaaaattgcggctgcacggcaacatccgctaactaaacggcgctacatgtggaaattagaaaactactaaaaattttaaaagtgggactgcgtttgctggcggtccccttttttaagaggtgattgcgtgaaaaaagcttttatttttgatatggatggcgttttaattaggtctgaagaattttattttgaaaggcgaatgcgtttctttaaagaaaataatttgaccccgggttcttcagatatagatgattatattggagtgtcaaatgaaaaggtttgggaaaatttagtaccagaaccaagtgagcgcgaacaaattagaagaaagtatcagccctttttggaaaagaataaaattaattatcaagaatacttggacaaacaagtccccaaagctcttgcaacgttgcaaaaacaagggaaaatgctggcattagcatcagctggagaagaaaaggaaataaatcggatgctacgtgaatgtgatttggcgcaatattttaacgtagtgattagtggtgaaaaggtaaagaaaaataaaccagcaccagacgtctatctagaaacaatcaaagccttgcatatttctaaagatgattgtgtggtggtagaagatagtcctacaggaattttagcagctaagcgagcaggattggaagtgtgggcggtcccagcgccagtagatcaaaagttggctgacgtggttttagaagattttgggagtattattgaaaaataaaattggcatcgataattggataaaaagttttcaataaattaaaatttgattttacttctccatttttccagtataatagaacggtccaagcaatcaaaagagaagtaggagaaaatgatgacatacccacaattagatttagcaaacgtaaagggaactaagataacgattcaaactaaccatggtgacattaaggtgcagctttttgacgaattggtgcccaagacggtcaaaaatttcgttgaattggctaagcaaggttactatgacggagtgatttttcaccgcgtgattccggatttcatgattcaaggtggcgacccgactggtactggaatgggtggcgaaagcatttatggtaaaacctttgaagatgagttttccaaccagctttacaatttaaatggcgcgctatcgatggctaacgcgggtcctaacacgaacggcagccaatttttcatcgttactaataccaacgtgcctaagaaaatgatccggcaactaaaggcggctggatttccagaggaaattgtagaagcttaccgaaagggtggtacaccatggttggatggccatcatacggtatttggtcaggtgatcgaaggaatggacgtggccgaagcaattagtaaagtggaccgtaattacgaagaccgtcctacagaagatgtcgtgatggaaaaagtattggtggaagaataagcgctcaaataattttttgaacagttttaaggatttaacgaaaatggaaagttgaatgcgactttcgcaattggagtggaagtttagttaataaggcatccggtttctgtaaccaagtgaaattcgggagcctagagcatccaaactttccaataaatcctcaatttgtatctaagtaaaaattcgttgttaataatcgcaggccgattattgatgacgaatttttttgtggttggcgtatttaaataagagccgtataaaaaaattttgtgggataaaccttaatctataaagcaaaatgccccgttttcactaaggtaaaacgttttaacttaacatattttcaataattaagtttacaaatgataaaaatggcgctattatgtaagcgttaacaaaagcaaataataaggagattttattatgaatttagcaaaatacattgatcacacaattttggcaccagaagccacccaatcacaggtagatcaaatcattaaggaagctaaggaatacgatttcgcttccgtagtagttaatccatactgggtttcgtacgtggcaaataagttgaagggtaccgacgtcaacacggttaccgtaattggttttcctcttggagcaaataccacggcaaccaaggtgtttgaagcaaaggatgcgttgcaaaatggcgctacggaattagacatggtaattaatatcggtgaacttaaagctggccatgacgacgcggttctcaatgatattaaagccgtagtcgaagctgggcatgctgaaaaccggcacgttaaggtcattattgaaaccgctttattaactgacgaagaaaaggttcgggcttgtgaactttccgaaaaagcgggggccgatttcgtaaaaacttcgacaggtttttcaacggctggtgcgaaggtcgcggacgtgaaattaatgaagcaaacggttggcgaccggttaggcgttaaggcatccggcggaattcacactaaggcagaagccgaagccatgatcgaagctggggcaactcgtttaggagcaagttccggcgtcaagattatgaatagctaaaaataaagtgggacagtttagttttaggaggggtttaaatgaagttcaaacgagtttttacaattgtcacggattcggtcggcatcggtgaagctagtgatgccactgattttgacgatgttggcgcagatactttaggacatatcggtgaattttggaagggcaacttccaagttcctaatttacaaaaattagggttaagcaatattcggcctgatcacccaattgaaggagttccggtggcggaccatccgcaagggttcttcggtaaaatgcacgaagtctccgtcggaaaagatagtatggacggccattgggaaatgatgggggtgccggttaaagaacctctaggctttttccctaacggctttccgcaggaattaattgataaaatcgctaagtttagcggtcgctcggtaattgtaaacaaaccgtactcggggaccgaagttattcatgactacggagaagaacagctgaagacgggagcgctaatcgtttatacctctggtgattcagttttacaaattgcggctaatactgcggtaattccgctagaagagttgtacaaaatttgtgaatacgcgcgctcaattaccattgataaaccttaccggattggccgcatcattgcccgcccgtacgttggaacgaataaggacaatttcaaacgaacttcggatcgccacgattatactttagcgccaactagtgaaacggacatggatcggctcaaagcggccggattctccgttttagcggttggtaaaattaacgatattttctcgggccaagggattacggatgggtttcacacggaaagtaaccacgacggaatggtgcggacgattgaaaacgcccaaaaggactttaccggatttagttttactaacctagttgattttgatgccatgtatggtcatcggcggaatcctgaaggctacggaaaggccttgatggaatttgaccaacaactgggtgaactattgccactcctaaaggatgacgacctgctggttattacggcggatcacggaaatgatcccggatttaagggaacggaccacacccgggaatacgtcccactattggtctatactcctagcgttgccgaaggtaaatcactgggggtgcgggatacttacgctgatttaggggcaaccattttggacaactttaacgttgctggtaacgaagttggaactagtttcttaagcgaattgcaataaggaggaaataccatgagtacacacattgcggcacaaaaaggcgaaattgcggacaccgttttactaccaggggacccacttcgggcaaaatatattgccgaaactttcttagagaatgcggaatgttataataccattcgaaacgcttttggatataccggtacgtataaaggtaaacgggtatccgttcaagcaactggcatgggcattccatcaatctccatttatacaaatgaattaattaacgaatacggggttaaaaccttgattcgtgtgggaacctgtggtggaatgagccctgatattcacgtccgggacgtcctcattgcccaaggagcaagtacggattcttccattattagaaatacgtttggtcgggatatttattacgctccgttagcagactttgcaatggttgaaaaggcgcatcaagttgcgcaagctaaccaaattccagtgcaagtaggcaacgttttgtctgaagaccgtttttacaacgacgaaattgatcgtcaaaaactggttcaatacggcgtcaagggtgcagaaatggaagcagccgcgttgtacttattagcagcgaagtatggcgtacgcgcgcttgcagtattgaccatcagtaaccatatcatcactggcgaagaaactaccgcggaagaacgggaaaaatcgtttgatgacatgatcaaagttgcgttagaaacggcaattagctaaggagcggaatttaatgtatttaatcgttaacattattggattagtggttttcctgagtttaggagtacttttttcaaaaaaccggcagcaaatcaagtggaaatcggtcggtatcatggtggtatttaacctcgttttagcgtggtttttaaccagtttcccgattggccgcagcattgttgcgggagcttcggcaggatttaaccaattagtccaagttgcttatcaagggatcgcctttgcgcttgccgattgggtggacgtgaagtcaatgaacttcgtgaccagttcgttattaccgattttgatgatcatcccgctgttcgatattttaacgtacgtgggaattttaccgtggatcattaagtggattggtcgcggattgtctaaattaaccggacagccgaaattcgagtcgttctttgcggtggagatgatgtttctgggaaatacggaggcactcgcggtttcctccctgcaactccaacaaatgaaggcggaacgcaacctaaccttggcaatgatgtcaatgagttgcgtaacggcttcgattatcggtgcctatacgagtttaatgcccggacagttcatcctcacggcgattccgattaacgtaattaacgcaattatcatcacgaacatgttgaatccggtcacggtaacgcctgaagaggatacgattgccacaatggcgggttccggaagttcagcaagcgcacaagacgcggactcgggttcggaaacgctggccgaagcgacggtagctgaagatgaagtgccaacgcgggaaccatttttctcgtttctgggtgattcaatcttaaacgcgggtaaactggtgttaatcatcaccgccaacgtaatcgcgttcgttgccttagcagcgttagtggataaactactaggaatcattaatccttggcttaccctagagcacattttgggaatcgtgatgttcccgtttgcgtggttaaccgggctaaacgtccacgatgccttcgaatttgcgcaatacatgggaactaagttagttaccaacgagtttgtcgtaatgggcaaggtgacgggcacgattaaccaatttgcgccccattataaagcagtgttaacggtatttttgacctcgtttgctaatttttcaaccgtggggatgattatcggatgtttcaaaggcttagttaaccggcagaaaaacgacgtggttgctaaaaacgtgggttacctgctcctatcgggaattttggtatccttagtttcggcagcaacggtcggactctttgtctggtaaaaaaatattgttggtaaaggaaaatcaaattttgatgggaataagtaaaacaagattaaaaaccgaaattttagcaggaattactagtttttttgcaatctcctacatcatcattgttaatccaatgattttaagcgatgcgggaattccagctggacttagtgtatttgccaccgttttttcttcggcaattggctgtttaattatggcgttgtgggcgaaagcaccggtaattcttactccggggatgggagtaaatgcatttttcacctacacggtggtagttggaatgcatctatcctggcaacaagccgtcgccatttcgatttttagtagtttgatttacatggtaattgcgtttaccagagcgagtgagttcctggctaacgcgattcccgccgtgctgaaaaaagggattacggtaggaattgggttgtttttggtgaccttagggttggaaaaggcggaattgatccaatctggcggaaaacgagcactattggcagccggttctttaagcaatccggcgacgttattagcgctgttcggtctcttactctctctaatcctctttttgcgccgggttcccggtggctttgtaattgggattatcgtaactagtctagtgggcgtccttttccacatcggtggtacgcaggcaacttccattagtttaagtcaactgccgaaatattcagaaatcctttttaagggcgatttcagccaaatgttttccatcaaatttttactggccgtattttcgatgacgatgatcttagtctttgaatcgatggggattctggaaggaattttacaggacccatcgcaatttcggaaggcatttcaagcgagctcggtgacgacctttatttcaggtttcttgggcacgagtccaacggttgcggctgccgaaagtgcttcgggaattgaaagtggcggacggacagggatcgtatcccttgtttcgggaattttattcttgctttcgctgttctttattccgttgttaagctacgtgccccaagcagcaatcgcgccagtaatcatcattacgggagcggtaatgatggaacagttggccaccattaactttgcggattttaccgattggttcccggcgttcttaattattgtgctgatccccttgactggctcaatttcgacagggttagcgttcggctttgtggcctacccaattttgaaattagcgatgggtaagcagagtgaagttcacccgattatgtacgtgttgggattgttattcttagcccaactaggttttaactcaattttggtttaggagaaggttgccatgagcaggatgactgataaaacaaaaattaaaaaaagcttggaagttgcccggatgcattacgaagccgggatgggccaagtagaaatcgccaaacagctgggactttcccggccgacagtttcccgactgcttcagtttgctcaagacaacggcattgtgcagattaaaattgtcgatcccttttccagtacccaagagttagaaaaaatgttgtgcgaaaagtatcagctaaacgaggctcacgtggtatacgctgaatatgaaaattatcaaaacgtgacccaacagctcggaatgtatacggctaagtacttagccaaagtggttaaggatggcgacttaatcggggttagttggggaaagactttaaacgaagtggcgaaggcactgacgcctcagcccgtcgaaggcgttcaagtggtggagctgaagggtagcgttacctattcacctacgccagtttttgacgaggaagtcttgatgaaatttggcaatgcttttcacaccaccccacacgaatttcctttaccagtcgtttttgaaaatcaaaccacccatgacgtggtgatgcaggaccgctacatcaagcgattaattaatttaggtaaagaggcaaatatcgcaatttttactgctgggaccatccgggacgatgcgttgctatttcaaacgggctattttgaccaaggcgacatcgcgcgtatccaaaaaacggcggtaggcgacatctgctcccggttttatgaccaggatggtcaaatcgcggttcctgaagtgaataatcgcaccgttggaattgacctagccgaattgcgtaacaaagaacacgcggtgctagtggccggtggaaaatggaagtatgaagcaatcaagggcgcgctagctggacaatacgcgaactgtttaattaccgacgtagcaaccgcccaacgattgattgacgaataattaatttaaaggagggcttgtgatgagaatggttgacgtgatcgaccacaagcgaaatggaagcgctttaactaaagaggaaatcagtgctttcgtggaaggttatacaaatggagaaattccagactaccaagcaagtgcactattgatggccatttactttaacggaatgactgacgaagaacaggctaatttaaccatgcaaatgttgaattcgggtgaccagttggacctctccgacattccgggaattaaggtggataagcattccaccggtggcgtgggagataaaactagcatcccattagctccgatggttgccgcgttaggaattccggtaccgatgatttcaggtcgcggacttggccacactggtggaactttagataaattggaagcgattccaggttttgaggtggaacgctcggaagcagagtttaaaaaacaggttcgtgacattaaagtcgccatcgttggtgcaaccggcaacgttgctccagcagataaaaaaatttatgcgttgcgcgacgttaccgacacggtcgactcaatcccgctaattgccggctcgattatgagtaagaagatcgcttcggggacggatgccttagttttagacgtaaaaactgggactggcgccttcatgaaggaagaggcggacgccgtcaaactagcgaatgccttagtgaaaattggtaagagtgttggcatgaactgcatggcgctaatttcagatatgaatcaaccccttggtaacatggtgggcaatgccctagaaattcaagagtcgattgcaatccttaaaggtgaaggccccgaagacatcaggaaattagtaatgacgttaggtagtcaaatggtagtacttgccaaaaaggcggccacgttggcagaagcccgggctaagcttgaagaagttgttgcaaacgggagcgctttagaagtgttccggcagatgatcattgcccaaggaggcgatccgcgggttatcgaagatccgacgttaatgccccaggcaaaataccattttgaacttcccgcgccccaagcaggttacgtaacgaaaatgacggctgatgaaattgggattgcggccatgttacttggtggtggtcgtcaggccaaaactgacgtgattgattacgcggtgggaattgaattacacaaaaaagttggcgacgccgttgcggaaggtgaaagtttgttgaccattcatagcaatacggaggacgtagccaacattaaggagctactatataacaacattgaaatcggcacggatgctcaaccgattcaattagtgcataaaattattaagtagttgtgtttgaatttatttaataacaaatagctaacaaaaagagagtggaacaaaagtagggtagtttgcgagcattaactgaaaattgaccattatgcctgaattggtgatggtcaattttaggctacgcggaacgaactgactttgcgctattgaagccaaaacaccaaaacaactttttaaggaacttttcatcctggaaaagtactttttccatcctctttttacacacaaaaccgtaattaactagcttgaaaagcaggttaattacggttttttaattaaattttatatgaaggttaatcgggattcttagcgtctacttcaccagcttgaaccggatcttcctttttaagggtgaaggtagcaaacagggtgatggcaaaaacgaacaatcccatgattaggtaggtgtgttggtagccaatcacgtcgtacatttttcccgcaaccgaagagaaaatgaagacggaaacttgtttggcaaagttagaagcaagcgcgtaaacggttgcataaaggcgaatgtcaaacgctccagcaatatacttcatgattgaagttagtaacaatggcatttccaaaccggctaataagcggaatccgaccagccagatccagtttggcgcaagtgcagaacctaaaatccgaagggcagtaataaacccgtaaataattaagccgttccgagaaccaatcttattaatgatccaaggcatcgggaacatcagacaaaattcaatcgcaatttgagctgaagtcatgtagctataaactaaagttccttgagcagcggtatggaagaacattttgaagaagatgatgaattgttgatcaaaaacgtcataaagtgctgaagcacccatgtaaaaaattgcgaggatccataagtttttcaatttaaagaccgacataacggtttttaaattcaatgagttggaagtgtcgccagcagcttgggcattttcaagatcgattttatcactgaagagtagcaatccggttaggataattgcggctaccgtacaagcccaaaagatggagtttggagaccagagaaagatgggaccggcaattagtgaagcagcaactcccgcaacggagcctccaacgcgggagtgggcgtattcaaagccgtttgccaaacttgcccgttgaacgtactgttcgattacggaaaccccgccattgagtacgaagctgagaaaagtcccggttacaaaagctacgaggaaggcgttaatgtgtaaaatcggcatgaaaacccactggaaataagggccgataaaaatagcgacgatcgagatggttaaaattaaggtctttttaaataatagcttatccgaaactaccccgaaaatcggttggaaaattaacgaaattccagccatcatggagaaaacggctcctgattcggtaccgtttaaatgagcgacttgttccatccagagggtgagatatccgttaatgattgcccagatgaagaagtaactaaaatgcgtgaggggaaacccccagaaatgtttagattgtggtttagtattgttcatgttgtacacccctattcatagttataaggtacgggtttgccaaaatcagggcgaccgtccgccgtccagccaaatggttgaaccatggtgtgacgattgggatcataaagcggatcgcccttgatgtcggtatagttacgacaatggtaaactaataaatcagttttaccgtcttcggccacggtgaaggaattgtgtcccggaccgtattgttgaatggccaaattgctttggaaaactggagtaggcgacttagcccaattacgggcgtctaataaatcggcgtcttcgtcgatagttagcattcccatggcataattttcgtcagtagcacttgccgagtaggttaagaagtacttaccgttacggtgcaagatcgcgggaccttcgttaacccagaaaattttagtttcccaatcgtattcaggcttggttaacattactggttcacccttaagggtccacggattttccatttcagcgatgtaaatgttggaatttcctttgatggccggatccttctgcgcccaaacgtagtaaagacggtcgtgcgccttaaaaacggtggcgtcgagggcgaaggtatctagcggcgtttttacctgaccgcgttcaacccaatcactttcgccgcgcatggggttaggattatcgcattctaagcaatacatccggtgttgaaacatgccgttgtggtcgaattctttagtgtgggcagcagcaaagtaaatgaaccattttccatcgatgtaatgtaattcgggagcccatatgagctggctcattggaccgctaccatcgggatgtttacgccaaatcgtacggggagccgcatgggctagtccattcaaggtttttgcgcgccgaatttcaatcagattataggctggaaccgaagcagtaaagtagtaataaccatcggtgtgcttataaatatagggatccgcccgttgtacaatgagcggattaacgtaatcagttgcggatatcatagtgagatactccttttatgaaaatgaattgtaaaaaaatggtgtggaaactttcgaaaggttcgtgaagcatttattacacgagcaatatatgaccgcttgaaagcgttgtcaaccctttttgttaatctttgaaaggaatctgcaaaaaaatctctttgcgttaactttattattaaattaagcgcttgtaaccggttttttattggcatataattaattgaaaaggaaatgtaaacggtttgataatggaggacatatgcaattagatatctcggatgcatcgttaaaagtttatgaagcactggcaagttcggtacgacttcaaattattcgtttgctgtcggatcaaccgatgagtgttcaagaattagccgaagcgttaaatttgagtagcccaatcgtcactaagcacttgaataaactggcggaagcagaaattattcatagtaaacggcaggggcaccaaaaggtttcttccttacgagtggatacaattgatattaagtttccgcggcaaatttatccgacgtttagcgtccacaaaactggaattccgattgggcactacactgaatttagtgtaaaaccatcctgcgggttagcgggtccagacgggtacatcggcaacgtcgataaccctaagtactttatgctgcccgagcggatgaacgccgggatgatttggtttaacgacggttacgtggaatatcagactcccaactttatcaatattgatgaacacttggaaatgcttgatttatctatggaactgggatcggaatttccgttttccaacaatacttggccatcagatatcaccttttccattaatggcaaggaaattggaacgtggcgttcaccaggcgacttttctgatgttcgtgggaagtacactccggactgggttccggataacgttaaccaatatggaattctaaagacgttgcgaattaccgaccacggcacttatttagatgggcaaccgttcacggaagtctgcttagcggatttgcccgttaataaagacgtttggacgattcgttttgaaattaagcccgatgccaagaagtcaggaggctgtactatttttggggaaggctttggtaattacgaccaaaatatcgagttatccgctttttatagctaaaaaagaccgccagccctcggggttagcgatcttttttaatttaggaggtttaatttttcaagaatgcgcgtaaatccgccatttgactttcgattactgccgttccttgatggtatagatccatgagcttattgttgtcccgttctacgcgggaaacggtgaccggttgttggggccgaattacaaaggcttttccttcccgttctaaatgttcaatttcctcaaggctttcgttgtaacgccgcggacggctttcaaaagcagaaacaaattgaggaaagtcccgatacttcatccgcactagccggttcattgcgcggctattctcggcttttcggtaggtgatgtcgcgcgttaaaacgatgactagtttctcgtagcccagttcttgagcacgtttgaaaggaattgaatccgcaattccaccatctaggtatggttggtgattaacaacccggatgctggatagcagcggcatgctagcggaagctttgatggcttcttcctggccttcagtatcggtttttcggaaaacgtcagccttcccagtcaataggttagttgcggtaatttcaaaaatttgctggctatctttgtaagccatgtaatcaaacggactgtaagcataacattctggagaaaataggaagtccaggttgaaaataccaccattacggactaaattattgaaaccaatgtaacgtttgtcatgtaagaaatgtaaattaacgtctttagagcgtcccttttgcttggaaatataattcattgcacacatcgtgccggctgaaacgccgtgaatatactcgaattccatctcttgatcaatgaaataatctaataccgcactggtgaaaaatgaccgcagtgcgccgccttctaaaattaaagctgctttttccaatggaatcccttcttcctgtagaatctacagacgctattttagcgcttttagtgggtcactggcaaacgagttttgggaaggtaagtgatttttaacggaagtttttaaaagacgactttcttaaggaaaaatagtaagatggtggataatcaaggtaaataaaatacgtggcaaagcagggagtgaatttgatgataagaattataattatcgctttgataatctacgggattattcaaattccctttattattaaagcgtattggggcaggcgtaaataccagcaaaaaattaaagacggtgaacgacagaaccaaaaaataatggaagaacaaaagaaacgggatcatcgttaacgtaaaagaagtggaattaatattactataggtatgtatgagtaatcggtagcgcgattaacgcaccaaatagggaccggagaaatttttctccagtccctatttttggttgagcggaaaaaactgacttttggcacacgttttggctctattgaagtcaaaacaccaaaacaacttttgaggaccttttcatccttgaaaagtatttttctagttttttccagcttcatttttctaagcgagtttagcggattagcaactaactaatttttgaaaaatgaggggattcttcgattagtttagtagttgctttagagctaaccgctaactctaacaccttggttgctagccatttcgtggtacttcaggtacacatcggcatacggatgctcgcaaccttcgtgccatggttttacgtgaccgcagaagtgaattagcttgggatcctcacgggtttccgcgtagggctccagcaactcggtccgcggtgggaaaatggtttccattatgatgttagattgggcattccattgcggatgcaagtggagccagtcatcataaaggttggcgtttaaagcgtcttggtcgtggaaacgcaacttttccggattttggttaatgtaatccaaaactttttgggttgtcgaccgcgcccgccaacgcacaaggtcaatcaacatcattcccgagttaaagtacttttcgttttctttagtgattcccatcttttctaaccggtcgtggaatccagcatcctctacggcagcaattacgttgccttctaggttagtttgccataattcatgcaagcttgtgttagcgataatgtcgcagtccagataaattgcccggttgatggatggcaacagtgccggagctaagatgcggtagtaagccgttttaacaatccggtcactttctactgcgttagctaacaattcttcgttaacttccacaattttaatcgtggcgttgtcatagcgggcaatgatgctgcctaataacatcatatcgcgatccgtgagatgatcaggtaacaagaagaaattgtattggtgatccggatcattttccaaaattgaaacgtaagaagtggcgagcgcttgagtaaaggccgagttggctgccgagataacgttaatcactccgcggtgcatttctaactcgccaagttcttcatgatattcatctaaatatggatgaacggtgaggttcttccaaggcttctcatgagtagtgaaatggacaatgctaggttccttaatggcttcgtcgattagttcagcatacccctggttaattggccggtgttttctgaaaataatcgagttttgtaaattccactttggatgaagaaattgtacttcaccagctaacacggcgttaagcgcatcctggtcgtggaaaataattcggtcggcatggtttctgatgaatgccaaggttttttccgtaattcgatgagcgttccactgggctacgtcaattaccataatgccagaattaaagtagaggttacttgcggcaactacgggatcgacgcctaaacggtgcaacgcgaatgcttgtcctgtatcaattaccgcgcctactgtgttttggtttaaattgctttcggcaagttcagttaggtcttttcgaattaaaacgtcgacgtctaagtaaattagtcggtcaatctgccgcgaagctaaaagcttaggggcgatgattcgaaaatatgcagttttattgatgtgttggtttgttgggcaaaaatcgaaacgttcgtcgtcgagatttaaatactcaatcgtatgaaagttatgcatcaatttgtctagcagtgcccgggtttggtcaccaaggttgttggttaaaacgatgaagtgggcccgggttgctgaatttaaagtttctaaagcagttttaatggtaatgcatagctggtcagcgtaattgcgatccgctgccaataagatattaatttttttcaaattcatccaccccttttttgatttgtgtgcccattatataaatttattcgaaattaagtaaagtaatatgcaatagtcttgataaggaaatcaaaatatttgcaaacgtaatttcccgtatgtataattcagggcaagtaacgagattgttagttgtttgaatgataggaggtcacgcaaatgagtgtaatagtgccgattgaaagaattaggttgggaaacagtgaagtggaaactcccggtttgacattgaaggtcaccaacgtgttacggggagaaaacgccgtgcttggcttcttagatggcggggatgatctgattatttccgtattaaaggcgcaaaatggtaaagctaacattggcgaccaatggattaagtttgaaatccgcgatctaggaaaccaagttgaagtgcggtgtgacgaaacgattaaaattacagatattttcgcgctactgcaaaacatgtctcgtagttacgtttaaacgtgttaattattgatagaaaatctttaaaaagtgtataacgttaaactaatcgtttcattaaaaataaaaagactgaaaatgtttccagtcttttcaataatggatatttattcgttacgatagaacgaataaaaaatgagaccagccgcttatgggcttggtctcaaatttttgtgtttttaagttaaaatttattctgcttcggcaattttttgcataatgaaatgtgctgatttgcgtaacttataaagttcttcgtcagttaattgcaattgaagctgttcaacaatcccgtcacgaccaattacggctgggtaagataagtaggtaccatattcttcccggaagttagaaactggtaaaacttctcgcgcgtcgtttagcactacgttagctaagcgaacggccgcggcagccactccatagttggtgtagtgtttacccttcattacgtcaccagcgccaatccgagcttcttcattgatttcgtgtaagtctaagccccgatcattagcaatctctttgatgggccgatcgagaacgcgaaccgttgaccatgcggtgaattgagagttgccgtgttcaccaaggttatatccggatacggagcgagggtcgatgttgagtcccttagcaaccgcgcgttgcatccgagccgaatctaatagagtaccggtgccaatcacgtgttcctttggcagtccggtaacttcttgatagaacgaagtgattacgtctaccggattagtaatggcaataataatcccgtcaaaaccgctttccttaattttttcagcaacttcccgcacttgtttgcgattatgtggtaattccgcaaaacgatcaacgttagggttgtcactgagtgaaatttttccgagtgctgaaatgataatatccgcatctttaagagcggcgtaatcgttaacaacaatattggtatggtaagtcaggttagccatggcatcttcaaaatctaaagcgtctgcaccaactttggcttcattttggtcaatcaatactaaatcatctgtataaccgttagtaattatttgttgggcaacggcttggccaacgtgccccattccgataattccaatttttcttgtcactgctaccacctccactgtcattttaagctacgatgttaaaaaaagctaccagccgggtttggtgaattggtatcgttttcaaaaaagggatcgaattaactcaaaattacgtgatcaccatctttaggagatgttttttaataaaagggcataatgtgaataaattccaaattttttcacattttatagttaattgatacgcagatggtaaagtacatgttagaatgaccagtagaaagccgtttcaatactgaatagatgagattataatcattttctggtgtgattggtttttaatgaatagtttaagaaaactaatgtggtttgatttcattttaaataggttccaaaatatggtttaaagcgtcattagttagtgggtgaaacagcactccacatttccttttaaaagtaatataaagtagctgtttttcagataataagatgataagattatgaatgttataaattgtacatactgagcatttgattcgagaggtgaaaaaatgaaagttgtaattgcagcggatgctttcaaagattgcttaagtagcgaggaagttaacgaagcagttcgcgaaagtatctttaaaatcgatccagaagttgaagtagtaactgctggaatttccgatggtgcattagacggtttagatgttttaaaacggtggggacgagaaatcgaggaaatcccttttaaaactaccgatttaatgggtcgaccagtagacgcaccatatttaactactaactataaaaaagctccgttagccattattgcaaccgctagcacggctggaaaacaccggattttgccatcaccaggatcattcatccgagcaaccagtttcgggttaggaactcaaatccgggatgcgttagggcgcggtgcaaaacgaatcctcattcttaccggagaaacgggagttagtgatggaggattaggtttacttcaagctttgggcgttaacttttatgatgaagagggacatttaattgggcgcgacaagaacttattagcaaccaattttaaagaagtacgcaatttagaaagcgtagtccaacaatttaatcacgttgaaattatgattgccactaatactgaccggccttatgcaggctatcgcggcgcacagcggacctggggaatggataagggcggtaccaaaaagcaaatcgaagtttttgataagcgaatggacggctttttcatgacggttattaaggaactaaacttggatttgcgagacgttgctggtttaggtgtagatggtggaatcgggggagcgttggcagttctaggcggacaaatcgttccaaccggtgacataatggctaacttagtcggtttaccacaaaagttagaagatgcggacttgtttattaccgggaccgggaaaatttcccaccatccgcaaactccgcacgtaattaatcaagtactagatttagcgacgaagatgtccgtgccagccgtagccatctgtggacaagtagacaattcaatgcgccattatccgaacgaaaaggtagcagttttctctattcaaagaaggccaagctcgttaaggcgttcgatggaaacgcggtacgctatcgtaaatattaagattgtcactcgtaatataattcgattgatgaacatggcccgcgctgaaaaataatttttgaaaatgacacaatccaagctggaaattgttgaaaaacaggctggcttatttaaggataaaatgtaagcgattccggtaacgtggaaggcaaaatggtttacttttagtaagtgaggcagtatactgtttgcacaattatttttagtaagggagtgctcatttggcaaaaaagtctaaaattgcaaaggaaaagaaaatagaagaaacggtaatgcgctatgccgcattgcgcgaaaagttgaaggcacaaaaggattaccaagggcttagtaagttgccgcggaatgcttcaccaactagaattcaccgacgcgacgcgctagatggtcgaccgcatgcttacatgcgcaaatttcagctgtctcggttgaactttagaagattggcgcacgaaggtcaaattccaggagttaaaaaggcttcttggtagggatgagagctgaaaagttccataaattagcgaagacaattaggtctgcgctttttttgtaccttttttagaaaaataaatagtagaagactgagcattaaatttacaaagaaatacgactttttatttgaaaatcccctgaaaataaagtggtaagatggtatatgtacataattatattagagaaagaagtttttttagtgaagttaaggaccttgctttatgtcgtcatttctacttttttgtttagttcaatggagattgcgctgaaggttgctggagggacgtttaacccgattcagttgaattttatccgcttcttattcgggggattgctattattacccttcacaatgaaaacgttgaaaaaacagagacgtcgattgaaaggacgggacattgcggcattttcaatgactggattttcatgcgtgttagtcagcatgacgttgtatcaactggctattcaattatcactgcccgccacaattgcaattttactaagtgctaaccctgcatttgggatgttgattggcctagttttactgaaggaaaagatgtcgcggaccaatacactggccgtaattctaacgctagcgggattgttggtaattattaatccgtttaacttgaccaatcctttaggaattacgttaggtttgctaagttccatcacttttgcaatttatgggattttaacccgacttagctcgaataagctgggatttggcggaatgaccatgacgtgtttttcgtttattgctggagcaatcgagttagcgatttttatggcaattacccatattccggtagtcagcagggcttttagtgggctagaaggatttagcgatattccgttcttccaagggattaccctttcaaatattctgttattagcatacataagtttcttggttacgggggtcggttttgggttgtacttcgtagtaatgggtgaagctggagtaccgattgcttcgttgattttctttattaaaccggcgctagcaccaattttgtcgttgttgattttaggggatccgatccacttgaataccattgtgggaattataattatcctgattggatcagtagttacgctagtaggcgaaaagattgcgatgaggatgagcaaataatagaaagcggaagccaccgggtaatttttgaggattaacaaggtttcgaaattaatcgcggtttaacgattgatttcgaaatcaggttaaccggaagaaattggtggctggagcttattttgactcagtagccaaggtaacatgaggactaacagaattacggggctgatcgcggtttttgcgattggccccgtaatttagttagccggaagggttggggagacaaagcattgtttccccaacccgttaacgaatttataagaaactttataggtcgttcacactttaatttagcgtatgtactataatacatagataagtaatcgcgattaaaggaaggaaaagcgtaatatcaatgatcttttttattaatgcacaaatgccggagcagaaatcagggattgaacatgcggagttaaaacgactggagctttttaacaagatgaaggtagattgtcggctgattttgcgggattggagcgcggacacccaccgccttacgcaggccgctgggattgacgaccagcaattgatcaacatgtttgactactaccagcaagctttacaagtgcaacgtcacatagttcaccccactgatttagattttggggtcgcggacgttgaactccaatatgaaccggaaaatcagcggtatttagcggtaacgcctgctcaggaactggtcgctcggattaatgtggcgggcgacgaggagcgggtagtctctaccgaactttttgacggctttggtaatctttatcgagtggacaactacgattaccgaggctttgtctccctttcgcaatggtacactcccgataatcagattgaaaatgaagaatggaaaactccggaaggtaaaacagttatcgaagcttttaccaagcagaaccgggctggtgaacttaaaccttcaggatggaaattaacggaccgtcacggaaaagtttatcaattcgacacgattgagacctttacgaagcattttctagatgagttgaatgacgacttctggtcgaccaagcaacctaatatttttgtattggatcgtaatcatttagctgactgggcctttttaaacatggaaaaaccagcttatcgagtgattcatttgcacaactcgcacgctagtgatgcacaagcgcccatggattctacgttgaaccagcattatgaatttgcgttgcggtcgatggatcgctacgacgcttttatcagtgcaacccaaaagcaaactgcagacgttcaagagcgttttcacccccatacccggttatttaccatcccggtaggcattgtgcccgagcagttacgacaagccccccaagttccagttgctaagcggcagtttggaaaaatggtggcttttgctcggattgcgtgggagaagcaccttgatgacctagtgcgggcgattgccatcgtccaccagacgattccggaggtgacgctcgatctttatggttatgcggaccctgcgaataattacgaagctaaacggaaagtggaagaggttattcaggaaaaccatttagaaaaggtggttagttttaaggggtataccaccgcggttgatgaagttgaaaatcaggcgatgatgtttggattgacttcgcggatggagggcttcaacttagccgtaatggaaggaattgcgcacggattaatttcctttacttacgatgttaattacgggcccaatgagattgtggaaaatgacgtgaatggtagcgtggtaccttacggtgattataaagcgatggcgcaagcaatcattaaggttttacaagatcagcaattagcgcagcgttactccaccggagcatacacttcggccgaacgttattcggaaaaacaagtttggcaagcttggcaggcgctactagatgacgcacaagcaagctggccagcaaagcttcgggcaatgccagaatttcgggaggatgttgaataatgaagtattttgttagccgaggaatttacacctttaattcgggaactgagcatgctcaagcccaacggacccgcctttttaaccaacaaaatgatcccgcacggtacgtaacgatggattataaccgcttttggttgcgggatgcccagcgcgttggattggccgatgatcaagtattaaacatgtacgattattttcaaggaactacgcaaacgccaaccgtgacggtaccggtacgggaatttaagcagttgccgtttgatgaataccaactagttgatcatggccccgattattatacggtcgatcacgcgggccgacagcttgcacggatcaatattttaccagggacggtcggcttgatgggggacgtggaatattacgaccgctttgataacctagtttcccgggataattacgattggcgcggtttcaaatcgtcagttgattacttccaccccgatggcagcttaggagtgcgccgctttttgaatttagcaggagaagtagttttagaaaatgtttatatgaacgttgcggatcaattacagcccaccatgtggaaactgattggttatcacgggcaggattaccggtttgactcgcaagaggacttgtttttattcttcttaaacgaaattgctgaacaagacgacaaagcggtcatggttgccgaccaccgcgacgtggatttgatggttatgcaagttgaaaaggcccaatcccgatggttagcctttcatggagcgcacgcggaccatcacggcaatgtttatgcagcctatacacccgcatttcaagcagaaccgggagaaattgatggaatcatcgtgcctactgttcaacagcagacggcgattcaaggacaatttcccgagacaccagtttacgtggcggctgatacggtagttgatgctaagactttgtctaataccgtttctaaaaagaagcgtactcccgacctcgttattttcagcggacgtttagaaagtgatcggcgccccgacgaagcgttggcagcctttttgcggttgtttgatcagcttcccgacgcgacgttagaataccggggctacacaaatgatcatcaactattaggtcgtttgaaacagatggcccaacacatgggaattgccgagcacgttatttttggcgattacttgccggatacatcaatggacaatttctataatcaggcacaggtactcattaatacggcttacgacgaagctggcgggattagcgtcattgaagccatggcgcatggggttccggtggttgcttactataccgactacggcattgaaaatttagtggaaaataatgtcaacgggtttgtcgtcacaaatggtgatcaggcgcagatggcccgacgagtaaaacaaattctacaggacccagatttgtggcaaaaattaagccggggagctcaacaaacggcccaggcttatcaagcaagaacggtttatcaacagtggaaaaatattctaggatgagtaaataaaaacagcgcgggacagcaattgaataattgatgaacatcaactaaaaatgaccattatgcctgaatttggcgtaatggtcattttgggattaagcggaacaaactgatttttgaggttgttgaaggcaacgcaccaaaaatttttagttttactcagctgctatttggtttaaatgaaaaaattatttaataacgcggaagcgttcgtcatctggcataaattccttatcgccagctggttgttcaattgaaccgaatggcatttgtgcctttaaagtccagttagctggaatatcgaatttttctgcgatgaatttgtcagcaattgggttgtagtgttgaagagaagcgccaatgccttcgttagctaatgcagtccaaacgtccacgttagcaattcccattccgtgttcaccaaacatgtcaaatgcatctttgtatagtgggaaattcttcttcaagtcagcgatgacgtcttcatcggtgtagaagaggacggttccgagtccagccttaaatgcgccttcgacctttgccttggtagctttaaaggcttcttcgttaggaacttcgccgtgtaaaatatctaaaattccatcccaaagttcatcgtgagccttaccgtaaaggataaccgcacggattgattggctattaaatgcgcttggtgattggcgaattgcttcttcgatgatttcggtaatttcgtcttcgctaagctttacgtttttacctagtgcgtagattgaacgacgtttttttaagttttctaaaaatgaatttgacatattgaacatcccttctgtaactataattgtctggcttacttttagtaagtatattgagtatataaaaaagttgaggggattgcaagttttttagaaaataaattgaccgattgccaatcaattgtaataatatggttaataaacgatgtggcggaggatggaagatgaagaaaattatcacggtgatggcagctttaacgatggcagtcaccttgggagcttgcagtaagaaagcggcgtcgagcgggacggtttcctcagaaaaaacgacccagtcgccaaccaagctgcaagtggttactaagaaaaagaagactaataatttgggaaacgttttgatcacgatcaagactaactcaaaatctaaagttaagataaccaacactaaaactaagaaggtagcaaatttaacggcggatgcggatggaaagttaatctttaacgcacatttaggcgaacacactaaggaagccgaatttatgattaccgctacggctaaacatcatcaagctagtggaacgcaaaagtttaaagtatataacgattcggctgcttaccacgagtgggaacaaaatcaaagtagcgcggcggaatcctcttcttctgctgaagaatcttcatcggtggacgaacaatcttcgtctgcagatgacagcagtgcagaagtagatattacggctggcgatgatgtatccagcgcggctagttccagcgattcgaatactggaacgaatactacgggaaccgcgggcggtggttacgtggctccaagctatagtgcgccaagttacagctatccaacctaccaaggcggaggcaaccattatcattcaagcaccagcggcgggagtgctagttcagcgccaagttctaacgatacggtaagcgatcaagctgacgaatcggacacggatgccgcggcaaataacgcgggtactgataaagttgaagcaactacggaagaagtaacggaaagtgcggattaagttggaaaacgttgtaagtcgagtagtttatatagattaatgtgaatcagtaatggaatttttgacgttattgaaattgataaagcaaaacgtttctctaggattttagaattctggagaaacgttttttattaccatctttttagtttgtaaattacataaaatcttaattaagcaaaattaggcaagtaattaattagcaagaagattttgctcgctgtggatgctgttatattttttaccccattcttccatagccgaaataattggagttaaggtttttccatactcagtcaaccgatattccgttttcacgggaaccactggataaattttctttgaaatgattccatcttgctctaattcctgtaattgaagtgctaacattcttcgtgaacagccgttcatccacttttggaactggctaaaacgacagacttcttctttcataaggtgaaagataatgacgctcttccactttccggagatgatttgcaaggtgctttctacaggacagccttcattgcaatcataaatatggcgtttcatgtacattacctccgaaaatataaattgattattttaattgtaacaccgcaattcctttgtgttcatggttacatttttgtaacgtagtaaattaaaattcacttcttatactagcgagttaattgaattaagataatttttgtaggaggtaaaagaattgaaaatgatgaaagcaatcggttttgatgaacatttaccaattgacgatggaaacagtttgtttgagtttaatacatcattacctaagttagcgccacatgacttgttagtaaaggttaacgcaatttccgtaaatcctgtggacattggggtgcgaaaggctggccggggtaagcttaccaaacctaaaattattggttgggatgctgttgggacggtagtcgacgttggctataaggttggattatttaaaaagggagacagagtatattatgcgggatcgtttaaacgaccgggaagtgatgctgagtatcaagcagtagatgagcgaattgttggcaatgcgcctgataaattaagcgatgccgaagccgctgcaatgccgctaacttcgctgaccgcttacgaagcattgtttgaacaaatgaagctagcgataagtaatgttggtgaatcccggtccgcacagaaaacaattttaattataaatggtgcgggcggggtaggttccattgccatccaattagctaaattggctggtttacaagtgattacaactgcttcacgaccagaatcggagaaatgggttaaaaattatggagcagatattgtcgttaatcatcgaaaagatttggtaagtcaaattagaaaaatcggtgttcaatacgtagattatattctagagcttaacgatattgacggccattgggatgaaatgtgtgaattaataaagcctgctgggaggattgtttccgttaccgaaaataagcgaccaattaatttaaggaaacttatgaaaaagaggggacacttttcgtgggaatggatgtattcgaaatcttattaccaaaccgatgatatgaaatcgcaacacgatattctaaatcggattgcggaacttttagatgaacgaaaaataaaatcaacgctaaatcatacgttaaaaccaattaatgcagaaaatctaaggaaagctcatcaaattgtcgaaggcggccatacaactggaaaagtcgtgattacgggcggattaataggttaaaagacagttttattgcgttttgaggaaaacaggacgatgaattaagtagccggctaaaaactataaatacaaatgaaaatagagatcagaaatcgtgtagataattctggtctctatttcatcaatattacttttattttctacatttaccggcttaacttagtcctcaaacggtgctaagtgatttaccggaccatatttgtggcctacagcaatggaattgctaattgcggcggtaacgaagcgtttgccgattcgaatagcagtggcaatgtcagtacccttagcaatttcagcagtgatgcaagctgaaagtacgtcacccgtaccgttaacccggtccgtttcgacgtatggggcgctcatccagaagctttcaccattttctagaagaacgaaatcgcgtacttcgctttgagcacctggtttatgagaacccttaaggaccacgtttttagcgcccatttcctgcaacatctttgcagcgcgttccatgtcatcgtcattttgaatgtcaatgccggttaacttgattgcctcataaaaattaggggtaatcacggtagctaacggaatcaacttcgccttcaaagtttcaaacgcgtcttcctccaatagtaaggcaccgtgtttggtaatgatgaccggatccaaaaccaaaggaccaaagtcgaatttttgataatttttgacaacggtttcaatcattggtgcatcagctaacatcccggttttgctagcccggattttgaaatcgtcggctagggattgaaattcttggtcaacgaaatcagtaggaagcggatgactagcttgaataccgtaagagttcccggcaacgcaagcggtcatcacgcacattccgtggacatcgcgacgttggaaggtgtttaaatcagcctccattcctgcgctaccatcggaatcagaaccggcgattgttaaagcttgtggaaattcatttgacattaaactcactccttattctttactggtttaaggataacatatttaaaaattggtagatcagtaagttggagaaagaaaaagggagtttcccctcagtccagtgttgagcgggaaaactcctcaaaaaaatttaaaaaagttatcgacgagacgccgcttgtaaattagtggcggcattttggaaaataatttgttgaatccgattaactgaaagttgaactaccgaattttcattgtgaacttgttggtggattagaccggtaaattggttccaatgcttaattaattctggaattgacgggtagttagcttctcgaaataccgcgaataaaacgtcaacgattcgattagcgtcttcttcggtaatgctaggagacagctgtttgaagaagggggattgatcaaaacctgctggggccgcgattcccacggcgcttgcaaaactccccgtccggtccgcggtccatgaagtaaggtcatgctgccaaatccccgcgtttaaactattaacggttcgctggggaaagggatgtatccccactaaggaaaataccgaaagcggcgccatcaattctaaaacaggtacgtcaaaatggtatttgcctacgggtaagcccggacttccaaacagtaaaacctgttggatgcgttgagttgccgaggttgtcagatgatcacaagctaaggcggcaattgcagcgccgcgagaaaagcccacgcaaatgatttggcgatcgtcagcttgtaaactgcgttgtaaatatgcttgggcagcgttttgcaaagcctcggggttcgttagcgcaaagtgcaggtcctttcgccaactaagcagcgttccgttaggtccccgaaaggcgaccacttttagtgttttggtgattcctaaagtgattgctaaaaaatgctcgttatccggactgagttcttctaaagtaaccttctggtaacgattgctatgggcaatctgttctaatagttgccgatcggccggaagggttaaataatccttggcctggatctgggcgagaagcgtagcacaaaaatccggcagtaacgccggcaacgctaattcactagtggccatggttaatggcaattcaaccaaccggctaaataaggctaggtctagttctagcggatcgtggattggtcgctggtactcgcttagaaaattggttaatttagtcatttaaatttgccccgatctctttatctatatgaaaaagggtagcacgcgactagtttttcagtcaaacggtgctttcacgtcaattagctatctatgatatactgaaagcgaatacaacattggtttagaccagtgtgaataaggaggaaaaataatgggtagactaggtatttcgatttatcccgaccgaatggggattgaggaaaccaaagaatacattaaattggcaagtaaatatggttttcaacggatcttcacgtcgttcttgcaaattaagggggatcaagatcaggtggtggcccgtttcaaagacttaattgaatacggaaagtcgttaggaatggacaccatggtggacatgaacccgaagttgtttaaacagttgggcgtgtcgtatgataaccttaaatttttccacgacattggcgcgtgggcagtacggttagacgaaggtttcacggggatggaagaagcgcggatgacgcataatccatacggattgaaggtcgaggtcaacatgagtcgcggtacccattatattgaccaaattatggattatgctcccgatcggcaaaatctaatcgggtcgcataacttttatccgcagcgctacaccggattaggtttggactactttaagcaaacttcccaacaataccggcggcataatattaatacggcggcctttgtgaacgcgccgtctggttcagtggggccttggccgttacaagagggaatggtctcgttagaaatgcatcgcggccaatcattgtttactcaaatcatgcatttgaaaatgttgggcttaattgacgatattctaatttcaaatgctggtgtgagcgaggcggatcttaaagaagcggccgcagccttcaacgcttcgcaaccaaccgtgcgggtgattgcggatgccggcttgaccgatactgaacggaaaattattttcgatagccaacacacgtaccggggggatcattccgattacgtactgcggagcaccatgacacgggtttggtataaggatgaagatgttccggcgcgccatacggtcccaattcataagggcgacgtgttagtaatgaataacgaatacgcacaatataaggcggaaacccaaattgcgttgcaagatttagaaaacaacggccgagtgaacgtggtgggccacgtggcaccaactgatatgatgctgttggaaacgttgcagccgtggagtgattttaggatgatagagggctctggaacccgggcagctcttgaggattaacgaaaaataggcctagtcgcggtttaagcgactaggcctatttttggttaaccggagagagttgggttccagagcccgtttcgaccaggcaacagaaaatgcgaacatgctttttaatccggcacgaaaagttaagttaatgccctgtactacttctaaaatggtcattcaagcaaaaaagtgggtttcctaccgtagttaactaattttgacaaattatttgactcaaaagggttactaaaaaaacaaattacatatttgtgcatattggttttaatttgtaggtacaaatgttaatatgaacttgtgaaagcgatttcaacgctttggccggtattacaagggtatatcacttattttgcacgtttgattattgggatgccggcaaatttatttataaggaggttgttgtaatgggtgacaacaataaaaccaatggatttgctgaaaagctaatgcctttggcaagtaaagtagcatcttctcgtcacttggtagcattgcgggatggatttgccttagttatgccactgatcattattggttcagtgtttatgattattagtcaatttccaattccagcttatttaaacatgatgacgagtttgtttggtgccggttggcaagatacggtcggctgggctaccaacgcaacgtttagtattatcgggatggtagcggtaatcgggatttcgtttgaattagcgaagtcttacgatggaatcgacgccatttcggcaagtatggtttccttagcggcatttatgttaacgattccattaaatgtcgataaagcgggagcggtttgggttccgttaactcaattaggttcgatgggcttgtttgaagctttgctgattggcctattcgtaaccgacgccttcgtttggatgattcataaggattggcaatttaagatgccagacacagttccacctgctgttggtcacgccttttcatcattgattcctggatttgtaattattttaggaatgtggttattacggcttttggttagctttaccgattttaagacgattccaaacgtaatcacggtaatcgtttcgcaaccattgaacgcagttggcggatcaatcttcggaatgttagttgctgaattcttcgttgtcttcctatggctattcggtattcatggttctaacgtagttggtgggatcatggcgccggtttggttaggtaagatggcagaaaacgctgacgctgcgaaggcacacaaggcgttaccaaacatcgttacccaacaattcgtggataacttcattcactttggtggtgctggtgaaaccttagcattggcctttatgctaatgttcttggcgaagtcagaaaacttccgggccattggtaaattaactgcgattcctggtttatttaacattaatgaaccgatcatcttcggggttccaatggtattgaacccggtaatggcaattccgttcgttatcgttccattaatttcggtagtaaccacttactacgcaatgaagtttgggttggttgctaagccacttgggattgcggttccatggaccactccgccactaatttctggttacttggcaactggtaagatttcgggtgcggtaattcaattagttaacctagcaattggtggactagtttactacccattcttcaagattgctgaccgtcaagctcttcaacaagaagaagcaaagcgcgcagaaatgaacgcttagaaaataaaaatgtggctaaacgagtaaagtttagtcgcatttttttgataaaaaacggcaattgtcaaaggttggttaaacaacgttattacgaataaccaaccaactaactaatgtaatgagagtgctggttagtgcgcaaattagaagccgcctgcatgaaattatgtaatggtttatgatggtgaagaaggcgataaagcgcctcacttagggatgggagattgattttaatgagtaaacataagcaaaaattgacttctgagcaacgaacgcaacgcgcccaaaatgctcagaaagtgattgccaacgcgcgtaagccccggctaatgattaaagacttgcccggatggatgcaaaatgcagcgttaaaccggtttaactggttgcgctggttgccctttgttccgttactgattgtgctcctcacggcaccgatgctacaaaacgaagttccggctacgttaaaggctgatggtgggatgattaataaaaatgcgttatttttggtgccgtttgcttgcctactgggcgcatacggctgctggattgcgattaaatcccggcgacgtgctgatcacgtagatggagacgtaaaccggtttgcattgatggaaatggaaaccatcatcggggatctgttggtaatactgatttgtaccgtcatctccatttggcaagtctttgtggcctttcactagaacactataaaatgtatataacactgaaggttcgcaccctataccgaaaagtgttaatacttgctgattttttgtaagcggttaaaatcgatagtggaggttgataaaaatgacaaaaaaagtattagttttaggagcacacgggcaaattgctcaattagcagaaaaggaatttatggaagaaaccgacgatgagctgaagcttttcttacggaatgctaagcgactcactccatctaaccctgaccgggaaacggtaattgacggggatgcggctaacgttgaccaattaaaagatgctatgcaaggagttgatgcggtttacgctaaccttgcaggcaataacatcgccgatcaagccaaggcggtcgttgaagcaatggacgcgaccggtgttaagcgcctcgtttggatttctacgctaggaatttatgacgaagtaccgggcaagtttggggaatggaataactccacgctaggtagctacctcactcgttatcggtcagcagcggacattatcgaagctagtgacctagattatacggtggttcggccagcatggttaactaaccacgatgaaattgaatacgaatttactcaaaagggcgaagacttcaagggaacggaagtttcacggaagagtatcgcacacgtagtagttgatttaattcaaaacaatacggaaattaagcattccatcggggtcaataaacctaataccgatggagacaaaccaagctggtattagtatcttaggtttataagtcaagtgcacaaaacttggtagactatggattcgatacgtaaagaatatgttgcaacaattatgatgtcgtttttagattaagtagcataaactaaatttgaacatacttgggtgcgcaaaattgccaaattaaagagcttttcaggaattagaattttcttgagaagctcttttttgcttaactttttaattagtctagattagtccaacgtgtcgcgcaccttatttatttgtttcaaaactttagtggcagtttcaatttctttttctgaaaaattttttacggcttggtttaactgtttattcagctctacatgaaattgttggtgcgctttttcagcctgttttcctaaggcggtaagtcttagataagtatctttttggttgttctccttatgatatttttcaacaaaagagtttttaactagtcgattaacaagcttagaaaccgcgccttgagtcatatttacgtgaggcagtaaatcgctgattttgggattggtgtctgcaatcagagcaataacatctaactcagtaatagaaagtttttgaaatacgtttgaaagattagggttgcgcaacatttttttgattgtagttttgttggagtgttctctatatttttttaattcggcaaatagttcgttgttcatttatattcctcggcatgtacatttaaattttgttcttatggtgttattatacaatatattcctaggaatatattttaacaagaaaagagctagagaatatgaaaaaagttgcgattgtttttgaccacccttacggtatggaagctggatacaacgagccgcataaaagatccttcacatcagcattgttggtcgctttactcaaagcgatggaagacgacggaacagaagtggatttgatcgatttgcataaggataattttaatcctgtgatgagcaagcaagacttaataaattggcggactaaatcttttgttgatccacaaagtcaggattattttgaacgcctacaaatggctgatgaaatcattatgctatttccaatatgatgggaagttatgcctgcaatgacaaagggctttttagacaaagttttagcaaagggacaaattaagcaagcgggggcaactagaagattatttgcatcaagtactaaggtgcgggttttaaccgtttcgggcgctcccacatggatatatagaattgtgtttggaaacccagtaatcagaatgctaaaaagaggtgtgtttaagaaggctggtattaaggattttaaatggcataattttaatgcggaagatacatcacctagaggtagggtgaaaatgctaaaatctgtaaaaaaatatatttagttttaaaacgtgggatgatttgattaatgattagccgttgtaatttttgtaaaagatattaaccggtaagtttcgcggaattcttgcctcggatgaacgttattctgtataattcatactataagttacgacaagttttgatgaaaaatataaaggtggtattagcccatgaatattgattggaaagcagaagttgagcaacgtaaagatcaaatgttagaacgtctaatggaattgttgaaaattgacagttcccgtgatgtagaacatgccgaaaaggatgcgccacttggtccgggacctaaggcagcccttttgaagatgttagaattcgccgaagcagacggatttacaaccaaaaacgttgaaaatgtggcaggccacgtcgaatatggcgacggcaaagaaattttaggtattttaggacaccttgacgaagttcccgctggtgaaggttgggataccgacccatttgcgccagtggtcaaagatggccggatttatgctcggggagttagcgatgataagggtcccgttttggctgcttacctagggttacaaatcattaaggaccttaagttgccagtttctaagaaggtgcgtttgattttaggaactgacgaagagtctgactggtacggaatggaccgctatttggcaactgaacaaacacccgacttcggtttttcgccagatgctgaatttccaattattaacggggaaaagggaattgcttctttcgaagttggagtgcccgcacaatcagcaactggggattttgaattacaatctttcaagggcggaatcaaggacaacatgattcctcgcgaagctaaggcagttgtcttagcaaaagcagacgttgacgaagctgcttggcaagctgaataccaagactacctaagtgaaaacggccttaccggggcaatgaatgttgccggacaacaaatcacctttgacttagtaggtaagtccgcacatgccttggaacccaaggcaggcttgaacgcggccactttcttagccgacttcttgaaccgtaaagtggctaacgattaccttaaattaattgcagaaaaaatgcacctagattcacggggacaccaattgaagattaataccgtggaccctcaaatgggcgatttaacggtttcgccagacttgtttgactaccaagcaggacaagctggtacggtaattatcaatattcgttacccacaatccatctctacggatgaaatcattaagaacgcgacggcagcgttggctgatttcgaggctaaagttgctttgcatggtcacgcacaagaaccacattacgttcctgctgacgatccgttggtaaagactttgcttcaaatttacacggaacacaccggagaagcaggacaagaaatggtgatcggcgggggaacctacggtcggattttagagcgcggggttgcctttggagcgcagttccctggccgggaaaacgttatgcaccaagctaacgaatacatggcaattgaagacattgtcaacgcagctgcaatctacgctcacgcaatttatgaattagctaaataaggttgacactagtttgaattatccgtaaaattaacagcgatattgaagcaatgaagtagcctagtagcgggatgggttcagcaattagaaatctggtgggagctgcaaaccagactgacccattcggtgaattacactatggagctttctgcttaaaagaacggatcatctcgttatcgatgttgagcggagtgtaataactcaattcaaggtggtaacgcggaatttttcgtccctgatcagttgattgggggcgttttttattccattgatgattaataacagaatggagggtactaactgatgaacattattgacgaattagattggcggggcgcaatcaaccagcaaaccgacgaagaaggtcttaagaaattaaccgaagaaaaatcaatcggtttatatgcgggaattgacccaactggggacagtatgcacattgggcacttgatcccgttcatggttttgaaacgattccaacaagccggacacaaaccggtaatcttaatcggtggcggaacgggttcaattggggatccgtcaggtaagaaatccgaacgggttctccaatccatggaacaagttcaccacaatgaagaagccttgaagaaacaattggttaaattctttgggacggataatttccggattgtgaacaattacgactggctttcaaaaatgtccttgctagatttcttgcgcgactacggaaaattattcaacgttaatacaatgttagctaaggatatcgtagctagtcgtctagaagtcggaatttcctttaccgaattcacgtaccaaattttgcaatcggtcgatttcttgcatttatacaagcacgaagacgtgcaattgcaaattggtggtggtgaccaatggggaaacatcacagctggtaccgatttaatccaccggatggaaggccaggacgccaaggtttatggtttgacaattccgctattgctaaaggcggacggaacgaaatttggtaaatcagaaggcggcaacgtttggcttgatcctgaaaagacaaccccttacgaattctaccaattctggttaaaccaagacgaccgtgacgtggttaagttcttgaagtactttactttccttagccatgaagaaattgaacggttagcagaaacggttaaaacagctcctgaaaaacgcgaagcacaacggcgtttggcagaagaagttacggaattcgtccacggcaaggctgcggtagaggaagcacaacatatttcggcagccctcttctctggggatgtgaaggacctcacggcaagcgaaatcgaacaaggtttcaagaacatgccaagtgtggaagtcgaaaacaagaaggaaaacattgttttgtggttggtcgacaccacgaaaattgaaccatctcggcgtcaagcccgggaagacattaagaacggtgccatccggattaatggagaaaagattacggatgtggacgctgaaattgatccagctagtcattttgatggcaaattcgtgatcgttcggcgcggtaagaagaagtatttcttagcacgggtaaaataattaacgataaaaagggttcgcaacaaaccaagttaggttgttgcgaacctttttttgttaagtatgacattacttgtgaacgtctttgattttaaaggccaagaagagggcgcagatttctaatagtagaaaacaactaaaaacgcccaagaaattgtcggtacctaaaatgacggtggcaattaccacggccgttgaacccaggacctggcgaacggtggcaatgatggacgaaccgtgcggtattaaatggtcaggcaatgaattggcgccgagcgtggtggcaggcatcattacaaaggcgtttccggcctccactaccatcgtagccagaatggcaattgccagactttctaaaaagacgttgaggatcattaacgaccagcccacgatgaagatggcgattccgatgatcataacgggtttaaaaccgatccggtcagctaatttaccactttgccggttgagccaggataaaaaggccgcggcgggaactagtgcgagccccgaccaaaacggcgaaaggtgtaaaacttgttggagataaagtggcatgacgatggtgacggtaatcaacgacatgtacgcaagcgccgttagtaaaaccccaaggtcaaaatttttaatgcgcataatttctaggtgaagcagcgggttagttaagtggaactgacgaataacgaaccaggctaacattcctaacgagactactaaaatgatggcgagtgaaaggttccaaccctggtggttgatctcattgataaaatatagcaagccgataattcctaaagaaagcagcaccgaaacaaaatctaactcggaatggctttgctgtacgggactaacgatggttttgaacgctagcagagtgactaggattaatagacagttaaagaagatgaagattgactgccaattaaagatttgtagaattactccggaaagaatcggtcccactgcaagggccgaacccataactaggccaacggttcccatggtggctccccgttgttcttcgggagtgatctgcaaaattaccgactggtatgtgggaaatagtaccccaacggagaaaccttccattaaccgcccgaccatcatcattgcgaaatttggcgcaaaaataatgatgaaggttccgataatgaaaattagcaataagctaatgtacattcgtttgaaattaaggttatttagcatccacggcgaaaggggcatcactaccgacatgattaacataaagccggtggtgagccaggcgaccgtgctagccggtaggttaaagtaacgcatgaaggtgggataagcggttgacagggatgattgacttatcgacatggtaaacgtaccaagcagtagcgtggcgacgaaccaacggtaagcttttttagataatggagtcataaaataagtcgcttcctttgcttttgtttataacagttctaaagtacaacacgaatgacggactgtaaaggtggattatcaacggttaaggaagcatattcgggggttggtgcagctttatccaactttttgcacaaaaattaaaataaatgtcacaaaagtgttgacgggtgccgggcatcaacatccgataaccaagattcacgtgatagcgaatcccgttcggcatcacaatcagataaggacgatagcgaatcgaagtcgacatctgacaaacaagaaagcgaatcccgttcagcatcgacatccgataaccaagattcacgtgatagcgaatcccgttcgatttcacaatcggataaggacgacagcgaatcgaagtcaacatctgacaagcacgaaagtgaatcgatttcggcatctgaatctgacaaccaaaattcacgcgatagtgaatcccgttcgatttcacaatcggataaggacgatagcgaatcgaagtcgacatctgataagcatgatagtgaatcaatctcggcatccgataaggaagacagcgaatcccgttcgacatccgacaagcaggatagtgaatcccgttcggcatcaacgtcagataatcaagattcccgtgatagtgaaagccgttcggcatcacaatctgataaagaagaaagtgaatcccgctcagtttcgacatccgataaccaagattctcgcgacagcgaatcccgttcgatttcacaatcggataaggacgacagcgaatcgaagtccacgtctgataagcatgaaagtgaatcaatctcggcatctgaatcggataaccaaaactcccgggatagcgaatcccgctcaatctcgcaatcggataaggaagatagcgaaagccgttcaacctccgataagcaagacagcgaatcgatttcggcatccgataaacaagatagtgaatcgcgttcgacatcggataagaacgatagtgactcccgttccgcttccacgtctgacaaccaggactcacgtgatagtgtaagccgttcgatttcacaatcggataaggaagacagcgaaagccgttcaacctccgataaacaagatagtgaatcaatttcagcatccgacaagcaagacagtgaatctcgttcggcatcggataaacaagatagtgaatcgcgttcaacatcggataagaacgaaagtgattctcgctcagtttcaacgtctgataatcaagactcgcgtgacagtgaatctcgttcaatctcgcaatcggataaggaagacagcgaaagccgttcaacctccgacaagcaggatagcgaatccatttcagcttccgaatctgacaaccaaaactcacgcgacagcgaatctcgttcgatttcacaatcggataaagatgacagtcgttcggtttctgaatccgacaaggaagatagtgaatctcgttcagactcagaaaaacatgaaagtgaatcaatttcggcatctgaatctgacaaccaaaactcacgggatagtgaatctcgttcaatctcacaatctgataaggatgacagtgattcccgttctgcatcaacgtcagataaccaagattctcgtgatagcgaatctcgttcgatttcacaatcggacaagaatgatagtcgttcggtttccgaatcagataaagaagatagtgaatctcgttcagactcagataagcatgaaagtgaatcaatttcagcatctgaatctgacaaccaaaattcacgggacagcgaatctcgttcgatttcacaatctgataaggaagacagcgaaagccgttcagactcagataagcacgaaagtgaatcaatttcggcatctgaatctgacaaccaaaactcccgtgatagcgaatctcgttcaatctcgcaatccgataaggacgacagtgattctcgttcggcatcaacgtcagataaccaagattctcgtgatagcgaatcccgctcgatttcacaatctgataaggaagacagcgaatctcgttcaacatctgataagcaagatagtcgttcagtttctgaatccgacaaggaagatagcgaatcgcgttccgcatctgataagttagatagtgaatcccgctcggcatcggataagatcgacagtgactcgcgttcagcttcaatatctgacaaccaaaactcccgtgatagcgaatctcgttcgatctcgcaatctgataaagaagacagcgaaagccgctcagactcggataagcacgaaagtgaatcgatctcggcttcaacatccgataaccaaaactcccgggatagtgaatctcgttcgatttcacaatcggataaggaagatagcgaatcccgttccgcatccgataagcaagatagtgaatcacgctcaacatcggacaagaacgacagtgactcgcgttcggcttcaacatctgacaaccaagattcccgtgatagcgaatcccgttcgatttcacaatcggataaggaagatagcgaatctcgttcaacatccgataagcaagatagtcgttcagtttcagaatctgataaggaagacagcgaatcccgctcaacctccgataagcacgaaagtgaatcaatttcggcttcgatttctgacaaccagaactctcgggacagtgaatctcgttcgatttcacaatcggataaggaagatagtgaatcgcgttcgacatccgataagcaggatagtgattctcgttccgcatcaacatcagataaccaagattcccgggatagtgactctcgttcaatttcacaatcggataaagaagatagcgattcacgttcgacttcaatttccgataaacaagatagtgaatcccgctcggcatctgataaggatgatagtgaatcgcgttccgcttcggataaacaagatagtgaatcgcgttcggcatcggataagaacgatagcgaatcccgctcagcatcggacaagcatgatagcgattctagctccgactcgaacaacggcggttcgaataacggatcagactccgactcgaacaacggtggttcgaataacggatcaaactccgactcgaacaacggcggttcagacaacggctcaggctccgactcgaacaacggtggctcgaataacggatctgattccgactcgaacaacggcggttcgaataacggatcagactccgactcgaacaacggtggctcgaataacggatccgattccgactcgaacaacggtggctcgaataacggatcagactccgactcgaacaacggtggttcagataatggctcaggctctgactcgaacaacggtggttcggacaacggctcaggctctgactcgaacaacgatggctccaacaacggttctggttctgactccgataacggcggctcgaacaatggctcaggttctgattcgaacaacggcggttccaacaatggggctggcgacaactcgaataacggttctggaaataatcacggaactgaccaaggcaatggttcgaatggctcaggtgatggaacctggaatggcggtgatggcaacggcactaatggcggcaatggcaataccggcaacggcggagctggcctagtagatactggatatcaaccaggcaacggccaaggtgacggtagtgtcgaccttgcccaagataatggtggcaacggcgcaaatagttctaatggtggaacaaatagcgcagaacgcttaccacaaactggtgaggaagataacgctagtgctcgtgcagctggtacagttggattagttggtggattacttggactcttcggtcttggtaagaagcgtaaacgtcacgatgaagaataatcgtcgactttaaagctagaaactaagttaagaaaagctctttaatcaacgattaagagacatcctaagatttaaaaaatacctgtagttagtggtaggtgatacctatcgctagcggcaggtattttttgtggtcaaaaaacgagccctataaataggaagaaaagtgtttggaaatgcaatacaaaaaacgtcgatcggcctacgttaggctaatcgacgctttttaaatattattctattttaaatacaattggtaggcaaagcgtttattatcaacttcgttttcgtcaatgaagtcaataatcccacgatactcaaatccattgttggtaataactttttgcatccccttgttaagcgggtgggtatcgacgcgaacttcgtcgtaaccaagtaaagaactaatggtgaagagaccttgcatcatcttctcagatagacgttgaccgcggaacttcgatgaaatcgcaatccggtgaattgacatgtatttgtcatcagggttgccccgccaactaccttcctggatatcgtcgtagttaacatcgttatctggccacaatgcggccgtaccagcaatctgtccatcgaccattaatacataactaatttgttgctcaatatctttctcaatgtcttggttagtagggtagccagcttgccactggttgatcccctgttccttcaaataagccttagcttcattaataattgttaaaatggctggcaaatcagccttagttgctctacgcaaataagatgttgtcataatttccgtctccattttctttttctgaaaaaataattctaacctaattttgcagagatgtcaccctaaaatttttggtgaaagcgaattcatttgagatatttcctatttgggaaaattcaaggctaatattaacccattaaatatgctaatatatgtagatagtaaagaatttaggggtggtagcatgaaaaaagttcggaactggagattaaccctcggttggcaaatcctcattggtctaatcttgggagtcgttttaggcgctagtttttaccataatcaagttgctatcacggtcatgcaaaatctaggaaccatgttcatccacatgattcaaatgattgttttaccgatcgtggtatcttgtctgaccgtcggaatcgccggaatgggtgacgttagtgaacttggccgcgtcgggttgaagactttgatatacttcgaagttttgaccacgattgcgttaattgtcggaatgatttttgctaacgtttttcatccgggaacgtacatcgacattcacagcctgcaaagtacggatatcagttcttacgtggagacggccaaagcagccaaatccaacagcggaatttgggccacgttgatgaacattatcccgacgaatattttttcatcgctggctgaaggaaacatgatgccggtcatcttcttctccgtgctctttggtttgggactaacggccattggcaagcagggacagattttgattgacgcacttaccgccgtgcaagaggttatgtttaaagttaccaactggatcatgcacttttcaccaattggggtctgcgcgttgattggcgtgacgattgcccaaatgggaattgatgctcttaaaccgttgggactattcgttttaattacttatgtggcaatgattttctttgtgcttgtggtactcggcttagttgcgaagttccacaacatcaacttctttgaactcctgaaagttattaaaaacgagttgattttggcgttttcgacggctagttcggaagcagccttaccaaaaatgattgataaaatgcaaaaatacggggtgagccaaggaatcgtttcttttgtaatccccacagggtacacatttaacctcgacggctcggcaatttaccaggcggtcggcgcgctgtttttagcacaggcgtacggagttcatttgacgctcggtcaccagattacgttgttggtagtcttgatgattacttcgaagggaatggccggggtacccggggcgtccttcgtagtgcttctagcaaccgtagcaacgattggcgtaccgatgagcgggttgaccttcatcgctggtgtggaccgaatcatcgatatgggccggacggcagtaaacgtagtaggaaattcattggcagccatcataatgggcaagtccgaaggtgaattcgacgaagaaaaacaccgggagtatgtgggaaatctgtagagagcggaagcccctgggtagcttttgaggattaacggaaatagggaactaatcgcgatttaggcgattggttccctattttggttaaccggagaaagctaggggctggagctcatttcggctacgcagcataaccaataggaaagcccctttagtttgctttcaatgattaaaaacggaagtatacttccattttttacaaaattaccactaaatggaaatatatttccattttgaatctaacgactagaacaaaaaaggttgaggaatttttcctcaaccttttttatttaccctaattcaaccgtgaagttcagcaggcgactaacgtagttcgggtggtgattaagttgttgaatcgtgcgctgaagggtttctaaattatcagtaataatcccgttaacgcccatgaaggtcagtttggccatgacgtcgcggtcgttaaccgtccaagcgtaaactttgcgaccggtaagctgggcggtaattaagaaggagttattcaaggtagaatgctccatcgtataaaaatcggctttagattggggcacgccgataaagttaaatggcaggatgtagccaacttggagcttagggttcaaggtttttaacttttcgacggcatcgtaatctaggctgtggacctcgtcgtggttggccacgaggcgtttaccgtagcgcttattaaaggtggtaatggaattggaagaatcccgtttcgtagtcttaagttccaccagtaagcgctggtgcaaacgttcggcggttgctaagtagtcgtcaaagctggcaaccttcgcagaagtcccgttttcccgagcagttaagcgggtgatttgccgaagcgtcaagtcatgcggccgtttattgacaccggtcaattgttttaagttctcgtcgtgcattaccacaaactggtggtccttagtttcatgtaggtccatttcaatgaaatcgggatgcaaccggctggtgttaatcagcgctggaatggtgttttgcaccccgtttttcgcgttaactccgcggtgagaaatggttaacggcgtggaagtaaaaaagccgttcaggtaaagggcgttaaagccgaggattcccaagaataaaacccccgccaaggccttaaaccaccaatgcttgcctgattgataactaagccgttggagctgattactgagctgccggctactagtaacgaagctagcttggtttttgagttgatcagccatgatcatcaatgaaccagttcctaaggcgatgctcattaacaggagtaccagctcaattaagagcagattaatggaagctgcccaatagtcccaggaagccggaagatgatggtcagccaaagcctgaagcgctaaaataagcgcctgtcccaaaattgacagaccgacgttgaccacgattaacaatcccagttgcttaacaatggttttgaagttcaatttggttaaccgccagcttttctggacggcttggtgtcccgtgctgcgtcccaagataatcagcggaagggccaagaagaaccgaattcctaagtaaaaggtaactaagtaaagcaaaatcagcactaaaagcaggggccgattttcgtatagaaaatagttaataatgaagtcgggcacccgcaccttgttcaataacggagtcgagatgcccagccccccaaacggcaggataattaaacagtagattaataagtaaccgaccgcacggccaaaagtgtgccgcacccgttggaaagaaagagtgattagcgaatttaaggctaattttttaccttggttaatctgcataatgcctagaaataagaaggtcacctgccagtaaatggcgacgatcacggcgagaatcaggagtaggcaaccgatgtccaaaaacggatggttggtgaccacctcaacgaaattggtgttggaaaggtagcgcacccccgccaaacgcaacatgatgctgccaatcaaggtgaaaagcgggatgatgcccgcgtaaatcaccacgatactggtaatgaataggctgagatagctaagtaaatgtttaaaaataaaacgatacgttttggtgatgctcgccataaagggcctcctagataactgttcttcttgttattctagcagagaaagtgcggtatttaaaacgccaggagggtagcgaacgacgaaaagggggcggtttacgtggttgactgccttttattaattacgacctcggcgaagccacggtcttttacctattaaattttttaggtgttttaagtttacctttacggaagaacgaaaatacgagactgaaaaggtccttaaaaagttgttttgacttcaatagcgccgaaacgggtaccaaaagtcagtttgttccgcttaaccaaaaaattggccattatgcttaattttgcataatggccaattttcagttaatgtaatgctcgcaaactacccgactttcgtcccactcgcgtatcgaatggtttgaattttatagttcttgcgtagtaaatgctttctttgctgcatcatattggtgaagataacggtgtgcaccaaactcctcgaagaaggcgtttggctcttccggattagggtagaagaaagtttcctcatcgcccttaacgactttgattcccactcgcggggtgtcgaccgtagttaaacgagtggtcggtgaggataggtaggtggcgatgtattttttaataatcgtgaggtccatattcgcaactccttaatttaaagtacgtcacgcgtctgtggcgtatccagaatgtaattgttaattaccttggaagaaattgccggcgtctttgccaaaatcgattgcgcgacaattgattgggacagttgttcttgataaaaatcatttggcacaaactgactaatacttaaaacaatgaaggtaatcagataactgattacgaatccagcgacggcgcctgccaagccgttgacttgatgaatgacgggcaaccaggtgatcatttgtgaaaaccggacgattaagcgaatcacaatccagcccacaagcatcaagaagatgaaggaaacggcgttcatcgtggttaaattagtcaacgggtcgtggctcccgttcccaaaagtacgggagagaaattcggcaaagggggcggtgaagtttttggctgccgcaaacacaattaaataacccactagataaatgatttcggcaactagtccgcgccggtagccggaaaaaaaggccgaaatcaagattaagattaaaattaacgatagtagcattaaaagctccttgttgaattagttggttaactaaccataattgaggtcagttaggtactattattagattccctaacgtcattactcgttagtgagtgttcaatattgacgaggaaaactgggtgttcagaagatgagacaccttatataaataaccactatagaggaaaaaacattgctattcaagttcaattaactcggttgaagttcaatttaagttaaaaatgaagttcaaatttaacttaaagaccgcgtaaattagtcgttttcggcaacgttggttctaatttcggcttcttgagaaaagcgtctttacaaatccgttagggaagaagtaaaattgataagtaatttaaaatgattctaaattagagaacgaaatggggagaaattggatgagtaaaaaggcaaagcaaaatacgttagcacaaaaaattaacgtaattcgggccagcgtaatgggggccaacgacgggatcctatcggtagccggaattgtgttgggtgtggcgggggcgacgaccaatagctttgcgatttttatttccggcatttcggggatgttagccggaacggtttccatggcgatgggcgaatacgtttccgtaaattcccaaaaggactcgcaggaaaatgctgttaaccaccaacggcaagcacttgaagaggactaccaaaaggaacttgattttgttgccgaaaagtacgcaaaaactggcattcctgaggacttagcccaaaaagcggcccgggaaatgatggaaaaagatgcgctattaacgaccgtgcgtgaacgttacggctttgatatgcacaactttaccagtccttaccaagcggcgattgcttccatgattgccttttcgttaggttcgttattaccattactgacgattacctttgctaaacacagtattcgggtgccgctaaccgtagtttccgtggtggttgccctcgccattaccggttacgccgcggcggtgatcgggaaggcggtccggcggcgagcggtcgtccgcaacgtgattgccggactattaacgatgggcgcgacctacctgattggctcacttttcgcgcggtaaggggatgaatgaacatgaaaaagaaaactaaaatgagtatggataacaaattaaacatgttgcgggccggtgtgctgggtgccaacgacggaattttgacggtagtcggggttctttttagtgtggttgcggccaccaccaacccattcatcatctttattgccggcttgtccgaccttttgtcatgtgctttttcgatgtcagcgggcgaatatgcttcggtaagttcccaacgcgatactgaaaaagcggccgtgggcgaagaaaagctccggctaaaggctgatccggaagccgaatatgaattagtggcgaatttttacatggaaaaaggggttacggaagagaccgcgcaccaaattgcccgttcattaatggataccgcaccgttaaaaacggcggtcgacgtgcgttacgacatggatttagacgaatacctaactccgtggggcgcggcaatttcgtcactattttctgcggcgctaggcggggtctttcctttagtggcgatgaccctcgcacctagtgattttaaaatgcaggcaaccatcattgcgacggtgttttccgtagcgttgactggcttcttgagttctaaactgggaaacggcttgccgaaaaaagcggtcatccgtaacgtaattgtcgggattatcacgatgttcattcattactacatcggaaaattattttaataagctcaaaaaatcgcttccagacttgatttataaagtgaatctagcatttgaatgcccgtataaaggcattttgcggggttgtcaaagaaatcttatatgttatgattgctgtggttcaagattgaggaaaggaaggaatttaaaatgagtaacgagatcaagaaccctaagaagcggcgaaaattaatttcgtacgcaaacggccggtcgttggaggaaatcaacgggacggttaaggttcctaaaaatattggtttttggaaaactttgtttatgtattcggggccaggagcattagttgcggtaggttatatggaccctggtaattggtcaacatcaatcactggggggcaaaacttccagtacatgctaatgtcgattatcttgatttcgagtttaatcgcgatgttgttacaatacatggcggctaaactgggaattgtgagtcagatggacctcgcccaagcaattcgggcgcggaccagtagagcactgggaatcgtcttgtggatattaacggagttggcgattatggcgaccgatatcgcagaagttatcggggcggcaatcgcgctttatttgttattccatattccgctcgtggtggcggtattcatcaccgtatttgacgtattattgctattattgttaaccaagatcggtttccggaaaatcgaagccatcgtggtttgtttaatcatggtgattttggtcgtcttcgtctaccaagtagccctttcgcatccgagctggggcgcagtatttggcggattgattccaacgaccaaagcatttgcaacaaccccaacggtgggcggcatgaccccgttgagcggttcgctaggaatcatcggagctaccgtaatgccgcataacttgtacttgcattcggcagtttcgcaaacgcggaagattaaccacgatgatgaagaagacgtagcacggaccgtgcggttttccacttgggattccaacattcagttatcgtttgccttcgtggttaacgcactgttgttggtaatgggagtggccgtatttaagaccggtgccgtacaagacccgtccttctttgggttattccacgctttgaacgacacttcgacgttaagtaacggaattttgattggggtcgctaagaccgggattttatcgaccctctttgcggtagccctcttggcttcgggtcaaaattctaccattaccggaacgttgaccgggcaagtaatcatggaaggtttcgtgcacatgcggatgccgttatgggcccggcgtttgattacccggttgatctcggtagtgccagtattaatttgtgtaatgttaactagtgggaagggcactattcaagaacacgaagccctcaacaacttaatgaacaattcgcaggtcttcttggccttcgcgttaccattctcgatggtaccgttgctgatgatgaccgacagtcgcgtagaaatgggcgaccggtttaaaaacagctggattgtccgaattttaggctggatttcggtaattttcttaacttacttgaacttaactggattaccagattcaatcgcggccttcttcggcgaaaatgccagtgcagcggaaattagcatggctcacgacattgcctacgcgttaattgtggcagttttggcattactcgcgtggacggtaattgaattgtacaagggaaataaacgttacgaaattgaacttgcagaaaaagctaatgcaaaggaggcggcataatggccttcgatgtgaaaagaattttagttggggtggacgactctaaagacgctttgttggcttttgactacgcaattaatttggcgaaagatgcgaaccgcgaattggtgattgtttcggtgctggaaaacgacgaaatgaacgtgttccaagccctcgacaaggattacattcatggggaacgagctgaattagaacaacacattttgacctaccaaaagcaggcgcaagatgctggcgttaccaacgtccgttgcgtggtgacggaaggcgatcccggtgagacgattgttgaagaagtaattcccgcggttaaaccagatttattggtggttggcgcggaatcgaaaaagggcattgctcgtcgttttgggagccaagccgcatacatggcaaaatacgctccgattacggtaacggtcgtgcggtaatttaaattttaatcaacttaggaggacggcaaagcaattagaaccgtcctctttttttatgaacgggggagcaaagtgaattttgtaattattggactaacttttcttagcgtcaatttagatttcttttttatgctgttgtttttggtccgcaagtaccggttgtccgcagttttagggggatatttgctaggcacgtcgctgttggtgacggcgagttatttaattggccaaaccctttccgcttttttgccggaatggttactgggagtgttcgggttcttgccgatttacctagcaattaaggatgacgatgacgaagttaacgcgacccagtccggagcttcggcggttgggacggttttggtgacctacctttccgtatgcacgggatgcaacttggcaatctttttgccagttttaatgcacgtccagcttgctgaatttttcgttgccctgttattgatcttgggattgagcgcggtggccgtcctcgcggttaatttacttagcaaaaatccgctcgtcagccaagtgatggaaaaatatggcgagaaactgatgaaggtttgctacgtgttgatcggactgtacgttttctgggacagcggcttagtgacccatttaattcgtttggttggataactgataatggataaggaaagtaaaatcgaatgatgcacccgcatagcgcaaaaaaagaccccgactactggtcctagtcggggtcttggtgattctatgcttgccacatgattgcatctagagtataacacaatcatttgatgacttgctaccattttaagtaggatatttaatatgttttgaaaaaataattccggccaaaaacgattcgtattgaatcgcttttttagtttctaaggaagacaaaaatccccgctattatcgcgaatagcgaagattttggagcctgtggtggttgcacaaaatctggacgactacccaaattaaacaaagttaacttggaaagtttcccggcgggtaaccccgtcagtgcgaacttgtaggtgatcctgttgggcagtccgagtcacggcaaaacttggatggtagttaccataaaaatgaaaatagaatttattttctgaatctggtttcgcggtgaccaagcaggctgaatgatcggaagcccgtacaacttggttagcaacgttggtacgacaattaatttgaaccataaacctcgcctccgcctctagcttaacactattaaaggttaatggtgcaagctgctaatcattattagcaatttctttttgcaaagtatctaagaataggcgatttaagttaggtaactggtgatttttactccacaccagggtgttaggttccacaactgcgggcgccaagggccgaaaaacgaggccatccttggtagtgtaatgatcaattaatttatcgtaggtcagcgccattaccgcgcccgtttgaactagcagactagcgttaaagatgaggttgtacgtgccgacaaagttaagctggttaaaaagttccccgctccagatttggaaagttccccgttgtgcagcctgccgggaggtgattagcggacggccaaccaagtcgattggctggatcacgtccttttcagcaagttgggcatccgctcgcattagcactccccaccgattttcttcgggaagctggagggtgttgtaattattgaggttatgatagcccatgagaacgccgaattccaaaagcccggcatctagcccggctaaaatgtcctcataatcgccactccgcaaattcacccgaacttccggatattggcgcatgatttggtggagagtttccataaggggcgtgattccactgctttccccggcgccaatttcaatcgtgccactgatcacatcttgtttttggaggtgataggtagtcttattaaccaaccccacaatctgttgggcacggcccagaagatagtgaccttcctgagttaaggccaaatggtggtgctcccggcgaaaaagtttaaccccgagttcgtcttccaagtcagcaatttgtcgtgaaagcgcgggttgggaaacgttgagtaactcggcagcccgggacatgtttagctcttgagcgatggtgacgaagtagcgtaatacgcgaatatccatgatggttagctcctaactataacaaaatgttatcaaaaaacatgtttaataagtatttaacattactataaaaccccgctaaactatagtcaatcagttatttgagtagcaaggggatgagcatttggaatctaaattggatttaggtaccgccgcttatagtcaagttgacgaagtggtaaaaactaatcaacgacttttacaacagttaaatactcaggagcattcggctgctgaaatccgtcagctggtcagtcaaatcactaacgaacggattgatgacagcaccgaaattcggttaccgtttcgcacggattttggccggaacctgcatattggaaaagatgttttcattaatagcggggccatgtttgttgacctaggcggaatttacttgggcgaccacgttttaattgggcctaacgtaaccatcgcttcggttaaccaccggatggaaccgcaggaacgacggcatttgaacctgaagtcggtgtacattcaccaaaatgcctggctaggggctaacgtgacggtgactcccggggtagtaattggcgaaaacgcagtggtggccgcgggtgccgtggtaacccgaaacgtaccaaaaaataccgtagtagcgggagtgcctgcccgcgtaatcaagaagattagggattaggaggaattttgggatgagtttgcaagataaagtagtagtgattatgggagcttcaagtggaattggcgcggcaactgcccggcttttagcagaacgcggcgctaaactaaccctagctgcgcggcgattagcgcgattggaagaaattaaatcagcatatccagaggccttaatcgaaaccgtggaagctgacgtaaccgacatggctgcagtacaagcagtaattgatcatactgtggcaaaatttggtcgggttgacgtactttttaataatgccgggatcatgccggtaaacaatttgagcgagcttgctcaccaagaatggcagcaaatgctcgatatcaatgttaagggcgttcttaacggaatcgcggctgctttaccagtgatgcgcaagcaaaaattcggtcacgtaatttcgacctcttcagtactgggttacgaagtgttgcctggttatgcggcatattcaggaaccaaatttgcggtacgcgcaattatggaaggcttacgtgaagaagaacgccaaaatggcattaagacgaccgtaattgctccgggatcggtaaaaacagaattatttgattcaattaataataaagaggttcgtgaaagtttaaaggcggctcaaaaacagccgggtgcggaaatgatggcattggaaccagaagaaatcgcccaagcagtagcctttgtgattgacacgcctaagaatatggcggttaatgaaatggtaattcggcctacgggtcaagaagtttaggaggaattttgagatgaacatttttgaagaaagttttacgttaaataatggagtaaagattcctaagttagcattaggaacttgggaaattccggatgatcgagttgccgaagcggtgcggcaagccgttaaaatcggctaccggcacattgataccgcacaagcatatggtaacgaacgcggggttggtgaaggtgttcgaaccgctggcataaaacgcgaagaccttttcgtgaactcgaaagtggctgcagaaattaaagactacgaaggcgcgaagaagtcgattgacgaaaccttagcgaaaatgaagttagactacttggacatgatgattattcataatccgcaaccatgggtcgaagttaaccaatctaacgaccgccattttgcgggcaacgtggaagtttggcgtgctctagaggatgccatgcgcgctggtaaactacgggcaatcggggtttccagttttgaaaaggaagaccttgataaccttacagcacacagtgataccaagccaatggttaaccaaattttgactcacattggggcgacgccagaagacttaattaattactcgcaagctaacgacattgtggttgaagccttctcgccaattgctcatggtgccgcaatgcataacgaagccattaaacaaatggccgacaagtacaacgttagcgtaccgcaattatcaattcgctacgcatggcaattaggattggttgttttaccaaagaccgctaatccagaccatatgcgtgctaacgcagagctagattttgaaattagtgacgctgatatgacaactttgaagcaaatgcacgggatggattatggggatgccgacattttcccagtgtttggcggcaagatgaagggttaaaaactaccatataatatgataaaaaatagcgggagtcagagattcattgcgaatttctggctccttttgcgtatttttgtagttaagaacggaaaaagtaaaatagataactaaatctacagttcgtgttattatagtggtacagtaaggaataagtaaggaaaaaggagcgacgatgatggcaaaaaacttaactaaagttcgttctaaaattactagcaaaaaccaagttacaatcccaaagacggttcgtgacttattaaacgtaaaatctgctgacacgattgaatggcaaattgagcctaacggaacggtaatgattgttcaaagtaagccggatttatggcaagtggttgaccagcaagctcaaaagtatggaaaagttaatactccggaagttgactggggaacggacttagaaagcgaagattttgactgatgaagctaagccaaggtgatgtaatctggattgatttaaacccagccaagggaatagaaacgaaaaaaagacgtccttgtttggtagttagtaataatcattacaatcgttatttcaatacggtacttgttgtaccaatcagtacggcagaaaaataccgggtcgcggaaaagtatgtaaaatcgccgttatttatcccaattgatcagggcgatattcaagggacggcgctattgcaacacgttcgggcagtggatcccactaagcgctccaatgggcaagtgatggaaaaaatatcatcagctgaaattgaacaaattagcaataatcttcagcaatttttttaattagagcagaaaacgggagtcagaaattcattgcgaatttctggctcccgctttttagtgagaaaatttaaattatcaaactagttagttttcggtttagcttcaacccaactagatagcaagtagatgttgattgcagaaaaaatcagcaaagctatcagtacgtagaatgggctcaagtaaaattgaaggtcagcattagcgttaagtaaagcagtatgatgctgagcaattagcataaatacgctacttattaactccacgatgcgtccaaaaatatacaaaatgacgattaccaagataatttttgaaatccgttgtccagcccttggtaagaaattactgatcatctcggtaagtagatgaactaaagtaatcagggcccagaagtttaataccgcgaagataagggtcaggatgattgaaacggttagcataaaagttgaacctgaaaaaccatctacaaaggttttgattgtcatgtgccagtgaaaaatcaacgcaaagatgacaatgcataatccaaagtaggcaaaactaaggaaggtggtgatcaaatttgcccaatataatttaccatttgaaatgggaattaaccggtatgtactggcggtgtagacgcgttcgttacgaatggttaataaaatataaagaagcatactagctaatcccaaaacggattcaaaggtggcgaagagtgcgccaggggctgcggatatgcggatcatttcgtacagcgtaacgacgaccgcagctaatgcgctgaatcctagtacttggttagcaaggcggaatttttcttggaacattgccttggttaaatcaaaaaatttagtcatattcgacatcctccttgtagaaatcttcgtagtaggactcgatatccttaccgagcgtctcgcgaatcgtgtcggcccgttcttgggcaatcacgcgttggtctcgcacgatgacgacttcgtcaagtagattggcgatgtcggtaacgtggtgatcactgataattatcgtggcattttccggtttccagccaatgatgctactgataatttttttacgactcattccatcaatcccgtcaaatggctcgtccagcaaatataggtcggtttggcgtgcgagggtgatggcaatcacaaatttacgctgattccctttggatagctgattaagtcgggcgtctagttttaaattgagggtgtctaacaaatggttaaaacgggataaatcaaaatcggggtagatttgttgataaaattccgcaattttaaataacctttggttgtttgaaagactgctaacctgttcggtaaaactgacagattttttacgagttactatacgagtatcgccgttgatcatgatggaaccttgacgagggatgtaactgcccgcaattaagcgcattagggtggttttccccgccccgttagcaccaagcaaaccaacaatttcgccttgaggaagttcgagattgaggtctttcaagattgaatgcaggttacgttggtagcttaaatttttaatgttcagtagattttccatgatcatcatcctttctcttggcaatgtaacgagacaagtaggttaccatctcgtctggctctatttgtagtctaagcaagtgatcgtacaactgcgaaagttgggattccactacagtttggcgtaagttttgtaaaacagcttggtcttccgtaacaaagttcccctttccacgttgagaaattaaaatgccatcttgaataagttctcgcaaggcccgttgcatggtgtttacgttaaccgtcaaatcaaccgcaaactggcgaactgcgggaattttagatcccggggggaagtggcccacgatgatttcttggtaaatgtattgtttaatttggtagtaaatcggaatcttgtcatcaaaatccatgttacgtgcctcctttgtgtattactatgctattacacagtaacctaaaatgaatattttggcaagtgattagtgaagagaggacccaaattttgaatggatgtatttaacgcggacaattaaaaactagcaaaggcaagctaattggctacctttgctagttttttggtttgggttgatgcggtgagttatttgtggaaatctgcgtaaatactactaattaaatgaacttcttggtgttgtccatcatcataaatattgcgatatctaaacagagtgtaataattttgcggatcgttagcgacgtccttcatggcgcggacatttgcctccgtttcggggagggttcctacgaaattaccttcagaaacttccgtaaaattgtgaaaatcaggaacaactttgaaattatccgtggttatcaaataactaagcatggtgtgccgtgtaaacagtgaacggtcgttctctttccaaaagtcatcttcagtcaaattgatggacggaaaaaggttttcgctgatgtcaatagttttggtaggaacacctgccactgatgtgtcagtgtcagcatagtttgcgcgcaagtaataaatttcaggtagacgagtaggatcagcagttttaataggaagatcctttaccttttgaattaattgcggattagcaattttgtcgggattaataatgaaaacaccccattgatcgacactttggtgaagttgcgcgtaatcaacttgcattagttgagtttcatttgcgtcggcgagggacatcgttacgatagcttttgggttaatatattggagtcctttaccaacgtcagaggtaatctgtccatccctaaaagcgttaatttcaaaggaaaatacgtcgtaagccctaactgagccaagtaaatctttagtaatgtcattaaccgtgctatcttctggaagatagccatgctcaataagcatttctagcatgagcttgcgcacagtcgaattaggcatccaagtttcaatgtcgctgtcttggattttgagttgtttttccgagagtttcggcagttttggttgctgctgatttagttttggaataattgctgaagcattaggttcgttttggttgaattcagcagccgaagctccggtattagtgataattggggtaatgaatcctaaagcgattagggcggttaacatcgattttttcatttgaaacacttcctttcgttgctttttatctaatcaattatttctgatattctgcgtaaattatgctacctaaaacaacgtcctggtgttgcccatcattataatcttctgtagcaagtatccacgcataataattttgcggatttttagctactttattcatggcattcaaagttagttcagtttctgataggtttcctgagtaattgccttcgctaagctccgtaaaaatgtaatagcttcctataggaagaatcgtaaaaaagttatcttttcgtattaaagcgctagttatgccatggtaagaagattttgtgtgatcaatttctctccaaaagtcgttatcagttaagttaatagttggaaaaaggcttttacttatatcgattgttttagaagggattggagttagattcgtcccattatcagtgaaatttgcttttacatagtaaattgtaggattttgatatgactcacctttggcaggaagttttgcatcagatactttttgcattatttgttggttagcaattttattaggattcacaatgtaaatatcccactggtcaacattttggtgaagttctgcaaagtctaattttaataattgagaatcatctgcgtcgattatgtcgatgcctacgcttacttctggattgatatactgtaatccttcacttaagtttggagtgatttgaccgcctgcaaaggtattgatttcaagaataattatgtcgctaggtttaatggaacctaataaatctttagtaatctcattgactgaactaccttctggaagataaccacgcctaataaggaaatttaacattaactcccgtacagtcgggttaggcatccaagtttcaatatcgctgtcttggattttaagttgcttttctgagagttttggcagtttttgctgttgctgatttattttttgaataattgctgaagcattaggttcgttttggttgaattcagcagccgaagccccggtattagtgataattggggtaatgaatcctaaagcgattagggcggttaacatcgattttttcatttgaaacacttcctttcgtcgtaagaattttggtaaacgcttccataattacgtattaaatacataagtacaaagctgaaatggttataaatttttagtctaggttggtttatacagtacggaataccgcgcccatcggagacaccctccttcgtaaatatttattccctcttgtgaatggcttaataatatcatgtagcaaatttgaacactaataaaacgcctcgataaagtttattttaatttgcgaatgcaattgagagaaaaattagctaagcaaatattgctatataaaaacatctttgataaacatatctaagaaattaaagggatggggcgattggaatggctgtccatcttttttgattaggtttaataaacaacaaaaatgaattattttaaatggagagctttcggtgacttccttactatgataatatttattgaagatatgtgtatttaataacaccgggagggtagcaatgttttgtcaaaattgtggaacaaagaataagcctggagctaagttttgccgaaagtgtggaaccgcgttacgtcagccagcgacgcaaccaactccagtgacctcgcaaaatgcatcgacggcgcctcaaccagcacctaagcaaccggatcctaagcaaactgcaccggtcgaacctagcgtgactcgggaagaacaccaagcagcagtaaaacgtaagaagcgcacgggatggctttggattacggcagggataattttagcgattggattcgtgggcttttttatctacaaaaataatcccacaatcttatctggcgctacgcattcggatcaggcaaagattgcctcgtcaaaatcggcgtcttccgcgtcaacggcatctcagaaaaagacttcgtcggcgccaactaaaaagcatttggcgtttcctaagagcaccgtggaaggtactattcaggatgcgtttggtgacatttcgggagatactgccgtttacgtatcgccggttgattcggataccgaagttgactccaatgaccaaccgcaacgggcggcaagcgacattaagttatttgtcatgattgcggcttaccaacaagtcaaagatggggaattaagcttatcagatgactatacgttaactgatagcgataaggtagacggtaccggtaaactgcgggaaatggcggacggaaccaagattcccattaaggatttgatcggctacatgatggaagacagcgacaataccgcggcaaacatcatgattcgcaagttaggcggcatggcggccgttaaccatcagattgataaaatgggagccaccgacaccaagttagagcggatgttgatggacacggatgccttggaagatggtaaggacaactacacgtctgctaaggatttgggcaccgcgttaaagaaaatttataaccatcagatggtttcccgaaagtatgacgaagaaatgctaactattttgaagcaaaatgaaaatcatactaagttgccgcacgatttgccggctgaggccacggtttacaacaaaaccggggaatttgacgattacggagtggaaaatgacgctgcaatttttggtaatcaaaagggcgcctttgtcatcgtagtaatgtctcaagacgggcaacgtgacgagcaaattaacgcgatgaatagttttggttcagtaatgtataaaggattattagagtaggagtgaaggaaatgaaattttgtactaaatgtggcactgcaatcgaaccaggagatcaattttgcactagttgcggtaccccggtagcccaaatgcaggctccggaagcaccagcgaattcagcagcagcggaaaaggtgactgaaaagccagcaaccacccaagaaacggtaaccacgacaactagcgctataccagccgcaactgatttgaaagctgaaaaaacggcgaccaccacggcagcacctgaaagcgatgcggtagatgaaaccaaggccccaaggtctacgactcaggcccaagaagccccgacgaccgcagccgcaactgctaaagagacagccaacgacgcgaactcgacggcagcttccgcaaccattgataaagaaaaggttagcgcaacggtggatcaaaccaaagaatatgctaaaagctactggaactggctaaccacgtcggtcaaacatccgtttagttacccagaaaccaccaatccgctatacgggattaccacttttgtaatttttgcaattgttagtgcactaacactaatagtttcgggacgccaaacttttaacgcgttggatagtaaggttaaagtaagtgtaatcatggaaaatccttttactttcggggtatttctaaaattcctcgcaatttttgcggtgttatttgctttgatggtattggtggggattttagtcactcaattcttaggagcaaaggggcagacggttacttggttcacttacaccaataagttagcgcactttgtaaactacgccttggtactcgggttactagctttgggaatgctttttgtggctggtcccgaattggttgacgaagttaccactgacatgccggatattttgttccgggcgttgcttggaatggccttggcaggcttaaaccttggcttcattgccaccttcttcgaagaaaaattgaagtttgaatttgaccgcatttacgtagccatcttagctgaagcagtgttattcatcgcactttacctaggagtggaacacctcttaatccccgcaatcacccaggtgggaactagctttaactaagaaaaaatatttgtccctaaaaagtttcacattcttttatccgataggcaaaagtgctataaaagagatattcgaaaagaaagagggacaaagtatgtgcacgagtattgaacttactgcagaaaatggtgccaaattctggggccgaaccatggatttagcaatgacgatgttcggtgaagatgggggtgcggaaagcgtgattaccaccatcccagcggaagcgaaggttgctagtcaactgactgattggacggccaaatataccacgatgggagtcggagttaaaggcactccaatcttatttgatggaattaacgaagctggcttagcgggcgacttacaggtgctgtttgaaagcaccgccgactcgttagaaaacttgaaacagcgagggttaacgccgctcatgaacacggaatttgttacatacgtgttgactaatttcaaaagcgtggctgagatccgggaacattatcaagaatttggattagcagatcaagcaacccaagttaacgggcaaggatttactttcccgctccattataatttcgttgacgaaagtggcgacggagtagttttggaaccggtcgaaaacggagctttcaagttgtacgattcagttggagtagtaactaacagccctgaatacagctggcacactaccaacttgcgcaactacttgggattaaccgacgtagacgtgaaggatccgcggacttataaaaacggcgtaaccttaccaccaattgaaggcggaaccggctacggaatggctggacttcctggttcatacacctcaccagcacggtttgtccgtagttttaccatcgcgaatgcaatggatgatttcactgctgaccgcggaattgcccaactttacgcagctttccgtccggtaattattcctgaaggtatcgaacgcaagacggctgatgcaccaatttctgactacacccgctactggtcaggatatgacctccaaaaacgggcagtttacgttcaaaccgggttaggcttggcatttactaagcaaacgttgaacgcggatgcgcaagaaattagttataccactattgaccgtggtgactacgtgcacgaagtttaatggatttgaagttaaactaaaaaataaacagggcccagaattaattctgggttctgtttttctttatgcaaagagaaataatccatgatttaagataattaagttcttttggagaatggttttaaaatggcactgctgccaaagttttgccggttattttttaattaaatttcaatatttcgataactagcgacaattaatccaaaaataaaaatggaaattttcaaaaatctgaaaatttccattttttcccaatcatttactgatattaagcgcggtcgtggaaccatttactgcttgccaaagcaataatgtcgtttagcaagtataggcagtaggtaaagaaaagtacccaaacgggatgtccggcaatcgccgtcacactccataaagtgatgctcatgatgctttgcgcaaaccagaagtaatagctggaacggaagcgccgcaccgttagaatggccccggttaagccaatcgttgcgctaagcgaatcgatcactggacgtggactcgtcaagattacggtgtctaagccgtaggtaatcgcccaaaaaatgatgaacgtcactacggtttgcccgatgtatttgccggttagcaaacgtggagaaagtccttcgctactgttccagttcttattgagcacaaccggaatatccaagaggaagatgtaggcggtttgcatcaccacgtcgctgtagttgccggtaattgaggctacgtagatcagcatcaaggcggaaacgaatcccaacaccccattgatgggtttgccgttggtaatactcaaagtacacgtaaaaccaattattccagcgatggtggaagtgattccgagggcgttaaagttgtggtataggcccgttgctaaaagaaaaagggtaccgcaagctaacaatatgtagctcgaagtcatccacccgctcatctggtccttataccaatgcaagttaaacacccgcattggtgattgaggattgtaacgtaaatctgtgtcttgtgtactttgcaaaataaagtccttctttctatgatttgtattagcccggtagaaagctgattcaggcttaaaaaacttattaaaaaagcagtacccaaatagtatacgcggattaattccagaaggtaagacccgtaaaagtttactagaccaattctgcgataaaaggaacctgatgagaacgggcttgcagtgaaataaattactcgtaatcgttatgataaatttttttgcggggaattggtatagaactaggttgtgagaataatttttaataaattgatacgacataaaacgctcaacggttttctaggaacgacccgttgagcgtttttaagaatccaaatgtaaagtttttaaacttactttagctaactttacgattaaacataaaaaaatcatcagttgccaaaaacagttgtgctgttattgctacagatggttttcaggaaaagcattattaccttcatcaagtaaaccatggtcagaacgattgtggccaggcctgagcaattttttgggctagcggagccgctttaggacgattagtttttaaatagctaatgtaaaattccatagttgcagtttcgtcattaaccggaataggaacccgatcgtccgtatcacttagcgaagtggtgtattctgaatcgaacgaggagagattagtcgaaaagtaaggaaagttagagtacttagtgatttcattaaacgcaaaccgttgtgcttgatacatgaacttagcttcaggaattttctgttggataatggtttgccatgggccgatatcagtaagaactacaaagttgatgcccttcagttctttaaaagatatggaagcttggttagagtggtacataaatttatccagatgaactaccaacgattctttgcctaggtaaacagattcaatatctttattttgtatttcttggttagaaataattcctgtaaaccggttatttaataagcttttaattacattatcagtatccaatagattttgcgtgatatttaattgggccaccgaaagtctgttaagtaggagtagcggtccggggggcggtcgacgcaattttaattacgccttcttgatccgcaaaattccggatttttttaattgcgagttgctgacgttgcaggatttgctcaccctcttggacagctagttcgccaattgtggttagggtgagcttattaggttgatgatcaaaaagcgatactcctaaggtctcttctaacttttggagtccccgagtcacggacggctgggtaatatgtaaggtttctgcagttttagctagagtaccagttttagcgaaaacgactagttcttgccaaaggtaagtatcaatcataaaggctgcctcctgcttagtatgtcttaaacgaatactagcatgtaaaacaagcaattttcaattatttttttgcacgttaggataattacaatcagttttgaggaggagattgtaatgataaaaattccaaaggtgaaattaaataacggaattgaaatgccacaattaggttatggagttttccaaattccagatgctaatgaagcagaaaaagcggtgaaaaatgctttggacgtggggtatcgcttaattgatacggcaacggcttaccaaaatgaaacggcagtcggcaaagcaattaaagaaagtggtattaaccgtgaagacatatttgtcacttcaaaattatgggtatcagattttacctacgaacgggctaaaaaaggaattgatgcctcattgcaacgtttagggacggattatttagacttataccttttacatcagccctatggtgacgtgatgggagcatggcgagccatgcaagaggcttatcgtgccggtaaaattcgggcgatcggggtttctaatttctacggggatcagctaaaaaacctagaactaacgatggaagtaaggccagccgttaatcaaattgaagtaaatccttggtatcaacaagtgaaggaagttgcggttaatcaacgtgaagatgttcgggtagaagcgtgggccccgtttgcagaaggtaagcatgatatatttaaaaatgagcttatccaacaaattgctgaaaaacatcataaaacggtgggtcaaataattttacgttggttactacagcggaacattacggtgattcctaagagtgtccaccgcgtgcgtatggaagagaatattgcggtttttgattttgagttagacgatgcagatatgaatttaatgagcaccttaaatcggcatgaaagccagttttttgatcaccgtgatccggtaaccattgaacaaatctttgggaaaagtttgaaacaattacgataattagaagagtggtgtaattatgacgaatacaaataaaattaaattaaatgatggtaatgaaattcctgcaattggatttggtacttttcaaattcccaacgatgggaccacttatcaagccgtaactaaagctttagcggcaggataccgacacgttgatacagcagtggcttattttaatgaacaagaagttggacgagctattaaagatagcggcattccgcgcgaacaaatttgggtaactagtaagttgtggctacaagattatggatacgaatccgccaaaaaggctattgatttgtcgttgcaaaagctggaattagactatatcgacctttatttaattcaccagccttacggagacgttcctggagcttggcgagcgatggaagcagctaaaaaagcagggaaaatccgttcgattggagtttccaacatgacgccgaaaatttggcaacattttgtacctcaatttgagacaatgccagcggttaaccaagtggaatttaacccgtattttcaacaaaaagaattacgaaaaattttagaggctaataacgtaaaattagaagcatgggctccattagggcaaggcaacgcaaagttactaaatgaaccggtcatcgttaaattggcggaaaagtatcaaaaaaatgctggacaaattattttacgcttcgaaaatcaagaagggataattgtttttccaaaatcagttcacgatgaacggattaaaagtaatttggatatttttgattttacattaacggaagaagaaatgactgcaattcgcgcgttagatacgaaaaaaggtatgcatgatccggatgctccaggggtaaaggaaatgctgctgtcagcttttgacgtgcacgctgatcattaaaactccacgtaccaaaaaacttttcaagagttttctattcttgaaaagcttttttattttttagcccttaaggccgtgatatcaaacattagtttacaaaaatcaaataaccaaggccaaacaattattttcgcttataaaccaaaacggtaattggcgcaaaaacggcaacaatgccaattcccgcgcataaaactatccaagcctcccgcggccagtatcccgcatttaacatggcacgattggcgctaatcacgtgggataccgggtttatcgttactaaaattcgcatgaagtggggcaaggatttaaccggtacaaaggcgtttgaaaggaatactaatactaacatggtcattaatgacacactttcaactaacgtaggacttttagcaaccagtccataaagggcgaatatccagcttaaggcccagcctaaaaatatgtccaaaaaaataaccatgattaaccatcctaacccagcttccgggtgccaccccatcaaatacccggtcgttaaggctgcggtcgctgcgacggctaaccgtaaaataccagcaaagagctggccggcaaggggagcaacttgtggaatcggtaatgatttaagacggtcgtaaatgccagaatggatgtcagtactaatctgggtggctgaaccggcagctgcggaaattaaggactgcatcagaattccaggaactaaaatctttaaataagaacttacgctaccataaatggccccgctaaatagatacccgaaaagcaacataaacagggcgggttgaacgaccacgtcaagcagttcatcgggattgtgcagcgtttttaacaaattacggtaagtcatggtaccggtgcttgcaataatatttgtttttcgagtagttgtgttaaacattgctaaatcctcctaataagttagtttttaccgaccgtcatggcaaagaagacgtcgtctagcgatggtttttcaacggctagcgtagttatttcgatgttagaagcacgaagacggttaaggatatcggctaagccgttcacgtctcggagcggcgccgtgatttcattaccagcttggtgaaccttttcttgcgtaattgcagtgacgattcggcaggcttgctgggcttgaagcttgtttttcaccgctaggcgcaacttttccccgccaatttgggcctttaactcatcgggagttcctaacccgaccagtttgccgtggtcaattaccgcgatgtgatcagctaatgcgtcggcttcttcaagatactgggtggttaagacgatcgtcgatcccgaagcaaccaacttgcggatggtatcccacatctgggaacgggtgcgagggtccagcccggtggtgggttcatccaagaaaatgatttggggacgggcaatcaaactaactgctaaatctaagcgccggcgcatgccaccagaaaaggcagcaattgctttatccgcggaatttactaatgaaaattcttcaagcagttcggtagttcgctgcttagcttgctggcgagaaagtccgttcaaacgagcaaagaacgttaaattttcccgcgcggataaatcttcgtcaatcgaagcatattgaccagttaaaccaaaaaaggttcgaacggtctgaggttccgattgaacgtcgtgttccatgattctaagtgaaccgctagtaggttttaataaggtagttaacatccgtagagtagtggttttcccagctccattagggccaagtaaggcaaacacttctccgcatttgacgttaaaggaaacttgttttaccgcactctggttgccgtacattttatttaaattgttaatttcaattgcatatttgaggttgatgataaaccctcccttaatgtgtcgaatgatgttcaggggccccgacgaaaaatattataagggcacctgattaaatagtcaaggggcctgattatttagttttaatctgtcaaacggcttgatataatagggctatataagtgagagatgggtgagttatgttggataaactagtaaaaaaacaccaattagcggctaaattatttgaatttacggcattacaaaatatggctgacgaacaggcagaacgccatttgccagtgtttaagggacaaaataaaattttagtggccttaagtgagggcgataatatctcacaaaaagaactatcgcagcgattgggaattagtgtgcagtcaattgcagaattcattgccaaattactaaaaaaaggctacgttaccaaacaaaagtcgcccactgatggccgtgtacaactcatcaaattaaccgaaaaaggcaaaaaagaagcaaagaagagtttgttttatattcctgaatatttggattatttaaatgacgacgaacgagctcaactagcagcaatccttgataaaatgaataacggaattcgagaggaccttaagctgcacgggatccagaatatcggaaatcggattcggtttagtcaattgaagcgtcatattgatgaggatttgaaataactagaaacggacgaaaataagtgaaaaactcataattgttgaaagcaactcttcaataattatgagttttttcagtggcgggaagctaaaataaattgctaaacaaaaaagagccgaatccaaaattcagctctccattcgttaaccaagtctttacctgcgagacatttctcccagaaaagtttggtacttatcgttaatttatgtaaccgttaatggatccgaacggacttgaaccgtcgaccccctgcatgcgaagcagatgctctcccaactgagctacggaccccttacataaatactatagcacttttctgcggaaaattgatatagtatttatgaaagaaagtaaatttttatcgcagaagaatgattttttaaggaaagataaggagcctcaaaagatgaagagaagcactaaatacgtgttggccggactcggtgcggcactagtcggcgtgaccgctggaatgggaatcggtggttatgcaagtttcttagtaggcattaaaaataccgaaaaagcgaaaaaccgggcgattgaacgttcggaaagtgaagataatgatgccttaaatttggcgtggttcaaccagcagcatccggaaacggtacaaatgcttagcgaagatggactgcaattaaaagcttccttcattcgccaaccgcaacccaccaaacacacggtgatcatggcgcacggataccatcacgcccgtcggcaaatgattccttacgcgaagattttttatgaactgggttataacgtgttgatgccggacgcccgcagtcatggtgaaagtgaaggaaatctaatcggctttggttggttagaccggcgcgattacgtgcgttgggtgcaacgtgcggtaatgttaactaatgctgatgaaaagattgtcttgatgggaatcagcatgggagcggccacggtaattgcggctgctggagaacctgacattgcatctaacgtggtggcggtgattgaggacagtagtttcaaccggcttgatcaacagttccggcaccgcctcaagcgttactaccacttaccgcctcgagagctagcgctaattgctagtctgttaacggaaaaagaggccggatattcatttaaggaagccgacatcgaagcccaaatcaaaaaggttcgggtaccgattatgtttatccatggcgaagcggaccggtttgtgccaattgaaatgttggacgacctagtggaggctgcccaagtaccaagttgggtatatctggtcaaccaagctgaccacgtgcaagccttgaaggctgatccaaagcgttatcgcgaagaggtggcgcacttcttggagaagtttgtgaagtaatggtgagcaagcagatgaaatactactttattatcaataaatgggcgggagcccgccattcggctgaaacttggcaaaaaatgcaccatttactggtccaaaaccaggttgagtttgatagtgtggttaccgaatatccccggcatgccactgaattagcacaacaatttgccaccagtcatcggaaggggtggataattgtcgcgtttggcggggatggcaccctcatggaagttcttgaaggcgtccagcgtgttgatgcaacgattccgttgggatacattccagcgggatcgggaaatgattttgcccgggccgtgggtttatcccgcgacccgtatttggcgttacaacagttgatccaaactacccagccgaccgttttagatgttggagcataccaagaccgcaaggagccggtggtccactactttagtaacaacgtgggaattgggtttgacgccagtgtcgtttaccaagccaaccaaggacaaaaaatcaagttaagcaaatggcacttagaatcgaccgcgtacatttccgcgttgttaaaaacgctgattaaacaaaagggctttccaatgagtgtgacgatcgacgggaaaacccgacaatttaaaaatgcctttttggtttcaattacgaacatcaaatattttggtggcggggtgggaattgctccgcaggctcggttagatgatggcaaattagacgtggtgatcacggaaaaattaacgttactgcgatttatccgcctttttgacaagctgttgaaggacggttcccatttagcaatgcccgacgtgttctttgcgacgggacgggaagttctggtgcattcctttgctccggaacatggtcaggttaatggtgaagatttaccttaccaaccttttgatttaaaaatttggacggtcaaacagtccttttggttcacgttgcaaactaaataaattgttccacgtgaaaagctgttggataagatggacattttatacagttgaacctgctaaaatgaaccgaaaaagtactaaacttaaagcttagatgggtaaattttgaatttttagcaatttgaaagccgtaatggggtctgattttgtgctttatccgatagattttctttaaatttctgattttagtcattttaattaaaaaattgagacactatacaatgtttaaagtattaacataataatcgtagttaagagctacgcatttggcatggtagaaaaaatgaaacttctaggttttaaatttagaaacttcataccccattttctattaaacaactgcctcacattgagattattgatatctttctttatttttttgctagcacacctggagccggtctgggtgtgttttttgtgttttggttaagctgagatgattcagttgtcaaagtcaaaggaagctgttagaatattagtgtaaagttagcttacaaaaagtaagtccaactttcggttagctagcgaccttataaaaggagacgttcataatgagtaatcaagcaaacttaactaacgaagaaatttttgatgcaattaaaactggtaagaagatgctcttctttaccgccggatggtgcccagattgcgcgttcatcaaaccagcaatgcctgaaatcatgaagaaatacgaccaatacgattggatcacggttgaccgtgacgacaacttggaagtagctcaacactttggcattatggggattcctagtttcatcgcgttagaagatggcaaggaattggcacgctttggaaaaggcgaacgccacaccccagcagaagttgaagagttcattcaaagcattgcttagtatttttaaagatgaatatgcgggtctaaaagagcaatcttttaggcccgttttattttggaccaataattccctcgccttaaagccccttttggggtaaaatgcttctctagtgtactaaaaactgaatatatcaaaaatgtcagctatagtgaggtagcgcaatgactctaaatcaactggaagattttttgttttggctagcaattttaatggcggttttaacggtggttattactgcagtttacttttggaaaacgaggtatcggggcggcaattatttgcgtgatccgcacattccgttacgctattttatccagaagcaagttgatcggcacggccaaactacgggttacgaatgcttattgcgtacccaggacgccgcagggcaatggacgttaccgcaagattttaattcgttaccgttacgacgtgtgatcgatttattagaagacaccttcgtttccctgccaacggagccggtcaccctgtccatcaaactaacttaccaacaaattattagtcgggactttgaatacttcattcggtgggccatcacgaaaattgaaccgatgaatttggcggtagaaatctcgatcaaagccatggaaaaacgggtgaaccggcgtatattaaggcaacaaatccaaatggggcgaaattacgggatgcaattttccgttaataacgtgggttcggaactaaatgatttaaaaagtattgaatggctcttacctgaaattgatattttgaaggcttcgatgcggagttttcgtaaagaggacccgcatgaatggcttgatttaaaccttcagttttggaatcgtttggcacgcgagaaccatattaaattggttttagtagggattgaaaatgctacggatcaagcgttagcagaacaattacaaattgatgcccggcaaggctacctttttggcaagcccgaggacgttcatcgaggtgcagaaaaatgaaagataaaaggcaacaattatataccgacccgtattttgaaaaagggcactgggggctgaagattcggcaaactttagtcgcccttttgggatggattggggtaatcgttccagtaaccatcacggcaactgccttatgggcacaatctgatccacggattccccatctatgggcctatccagaagggatttttgagattaagttcttagcggcagttttgctatttgcctttgcgatggcagggctatttgcggttagcatgaccatcatccaaaaccggcggcgggatcgcctggccgaacagtggccgacgttcaacccgatcaatcagcgtaaacgggaatcacgtttagaaaagttcatgaccgaccgctttggagatgaagagtttcgcgaaaacgtaaaatactatgaagtagagcccgaacaaaatctggatacggacgaaattcatcatttatatcaggaagccaacttggatgatttaaataaggagtagggacatggcgccgattgtatttaacaatctgtttaaaggtagctttttagctactgcggctaattttgtactattaattttatgcttgtaccccgtagtgggggcgttcttttggtttaccggctcgttatcttaccgatttttgaaagctaacaaatgcgacgataattggcgaaatttgcctgcagaagagcaaccgatggtaacaatcatgatccccgcccataacgaagaggtaatgattgaagaaacgattacctacctatttgaagaaattaactatgataattttgaagtattagtgatggacgacggttccacggaccagaccgctgcgattttggcccggctccgggagcgttatccaagtttgcgcaccattaaaattaagaaaaataaggggaaggctcacgctttcaacatcgggatgtactttgctaagggcgaatacattttgagtaacgacgccgacaccattcctgaacccgacgcgttgatgaagtacatgaacttttttctgagtgatcgcgacatcaacacgtctgcggtaaccgcaaacatggacgtccaaaatcgaactaaaatcattggtaaagcccaaactgtagaattttcaagcatcgtgggagtaatcaaacgcagccaaaccgcggttaacgattcaatgtacgcctacagtggcgccaacaccatgtataagaaggactttttaattgacgtgggtggttttcgccaaaatcgggcgacggaggacattagcatcgcctgggaccaccagatgattggcgcggtgccccggtttgcgcccaacattgtgtttcacatgaacgtgccagaatcgatccgtgatctttatcggcagcgtaagcgctgggcacagggcgggacggaagtctggttaacgaacatcaagaagttcgtccggcaccccatcaaacaccgttaccaaatgtcgatgtttatcgattcaaccctttcgattatctggtcgtttttcttcgtgattacggcaattattttcgcaatcaccatgggcggcgcgtatctaactgggcattacgacaccgttttccgtggttttatgatggcctttatctttattgcctttgaaatcattgccggcttttttcagctattggcggccttgttactagatcatcacgcagccaagcttaagtacatcatctttgctccgttgtacatgcttttcttttggatgattaaccccattacggtggtaaccacgtttatcccagccttaaaaaccatctttggattgggatctgggacttgggtaagtcccgaacgcaaatctttacagaataaaaaataaggtggggcatgttttgcgttttattcgcgaaacatgttttttgtttgccaaaaaattgtacaaaatcaatgggacggtgcaaaataaaatgtaagggatttcatcaatttaacaagggagacgagtacatgacaaaattacctaaaaatttcttgtggggtggcgcagtagctgctcatcaactagaaggagcttggcaagcggatggaaaaggcgttagcgttgcagacgtaatgactgccggtactaaagatcacccgcgggaaatcactgacggagtggttccgggcaagaactatcccaatcatgaggggattgatttttaccaccgctacaaagacgacgtgaagttatttgcagaattggggattaaggcgtttcggacctcaattgcctggacgagaattttcccgaatggcgacgatccggaacctaacgaagccggcctgcaattttatgacaacttgtttgatgaatgtctgaagtatggcattgagccggtggttacgctggcacattttgaaatgccgtatcatttagtggaaaagtacaacggttttgcggatcgccgggtgattgacctgttcgttcggttcacggaggtttgttttaaacgctatcgtagcaaggtcaagtattggatgacctttaacgaaattaacaaccaaacgatgtacaacaacgactttttgatggcaaccaattcgggactaatttttaaggacggggaaaatcgggaagcggcaatgtaccaggcagcccactacgagttagtagcgagcgcccgtgccgtgaaactaggtcatgaaatcaatcccgatttccaaattggttgcatgatcaatttcacaccgctatacccattgaattctgcgccaaataacgtcatgcttgcggaacgactaatgcaacgtcgctactggttctctgacgtacacgtaaatggcgtttatccggcgaatattgaggcgtacctccaacggaagggctatcgtgcagacattaccgaagaagatcggcagctcttaaaggaaggaactgtggattacgttggatttagttattacagttcttatacggttgctcttccggcagggatggatttggatgccgacgagttgccattggaaaagatcgtggtggataatccgcacgttaaaactagtgactggggctggtcgattgatccggttggattacgttattcattgaactggttgactgatcgctatcatttaccactattcattgtagaaaatgggttgggtgcttatgacaaggtgacggaagacggccagatccacgatccgtaccgcgtagcctacttacgggcacatattgaagaaatggagaaggcggttgaactcgacggtgtggacttaatgggatatacgccgtgggggttcatcgaccttgtttcagcttccacaggacaaatgtcgaagcgctacggatttatatacgttgataaagacgatgaaggaaacggaacgctaaaccggtctaaaaaggattcgtttgcatggtatcaaaaggttatccaatctaatggagaagacttggcttaattaggtggttaattatcaatcctgtgagctaaatccgttcagtcactctctgattgtgctaaaatagcattaggaagggcttgcaccaagaacggagggcgatatttatgttgtattatgaccaacacgtacacaccgatttttcgtttgattcggacgaaaagatggaaaattacctaaaagtttccggagatgatttcgtttcaacggaacatttggaatttaataatcctgacgcggataaaaaagatagcattccgaactataccggatacgttactgaaattgaacgattgaagaaggctactggtaaacgaatctataagggcgtcgagattggcgtttcagccggtcaaattgatcgcattaaggattacatggctcatcacgcgttcgacttacgcttgttaagcttccatcaaaatggcgagatggatttccaagatgaacaggtcgcccatctcgatccgttgaaggtcacgcaggaatactatcaaatgatgtggcaaggaattaacgaatatcatgacgcggatgttttggcgcattttgattacggggttcggcgtttgaacttaacttcgggacagtttgctacgacggcaggcgtcctgcttacgaagatttttaaagtagcaattgaaaataacatggcgtttgagttgaacaccaagagtatgtataagtatcgcaatattggtttgtatgattacgctattgagatttacaaacaactcggcggcaagcgttacacaattggctcagacgcacatgacgttactaattacgaaaaccattttcaagatgcattagcaatgttggaagctcacgacattcatcacgtcaacgtctttcggcaaggtgccatgaccgtaataccgattgataatgttccagaagatttgtaaaaacttgaataaaggaaagtgtgttgttccaaataggttgggatggcgcactttttgttttcgtaggacacgatgatagtaaagcaaaggtaataaaatgaaaccgcttcgtaatctttttgcacaaaaattaaaataaatgtcacaaaagtgttgacgggtgccagctaacgatcgaatttgtcggctttacaggagaacggtggccggcaagtcaaaagctgattcaacgaaagcgggtgccccttgaataaccaagactttgatttaggcacggttaagcatttttttgaacacgattatcatgaccggggcatgatgaaatggcaggggttctatttatctgatcatactgccgctttaaaccaacagaaccagcagttgaatgaaatatacgttccaagaccgcaacaatccttagcagtaattaccgaggtattggcggacgcatatcagcgtcagcaaccagtgatcattcaactaaaaacggttgaccaaaacaaccgtcattggccagatatcaccaccttgattcatggttacaatgccaatgatattgtggttgatgctgatcggtttatcccactacaggaaattcgcaatgtggcctttaaaaatacggagaagctataaaattctagctctccgtatttttcttaacactttatttgctggctctgttttttctcattgctttattttagacaattttacttcaatgtaggcaaaagaattcacagaccattgccattaattgataacgtttttcagatctcctgataaatatgcttttatattatcaacagtcatatgcaacaaccgttctcttgtctcatatggtgcccaagcaatatgtggggtaatataacaatttttggcctgtaataatgggctatcactagcaatgggctcccctttaacaacatcagtggcgtaggcataaattttgccttcattcaaggcattcttgatgtccgcttcattagccaatttgcctcgggccgtattcaatataataaccccagttttcattttggcaatcgtatcattattaattaaatcaattgtttctggtgtttggatcacatgcagactaagcacatcagattgccttaatagttcatcaaatgaaacctgctgaatccatgattcaggaacctttttaggacgatgattatagaaaataactttcatagaaaaagcgtgtcctattttagcaactttttgcgcaatatggccataaccgattagtcctaaagttttaagttatggagcgatagaaaaataccaaatgaatatatcagttataaaagacgtccccaatcaagtcaatctaggcctcttttgtaatattttttgaaaccatttcatttgaaatatgaataatgcatgttaccatcgactatgtaatccttatttagaagaaattaatgcgacgtatggcattataatacattaggaggactgtcacatgtatataagaaaatcaaaattacaatatcatgcaaagcctgagaagagtaatcctattatcgcacgacgcttacaggagattttaggggggcaatggggagaaactacaggaatgttggcctatacgcttcaaggttggaacactgttggcaatgaaaaatataaagatttattattagacactggtacggaagaaatgggccatatggaaatgttagcaaccatgattaatgacctattacatgacgctcctactgatacgatagaaaaattggcgagaaatagtgatccagcgaccgctgcaatacttggtggtatggaccctcaacatgcattcgtcaatgggcttggtgcaggactatcggattctaacggcaatccttggagcgcaaatttcatcatttcaagcgggaatttactcgctgatatgcgcttcaatgttgtccgtgaatcacaggctcgccttcaagtatcacgaaacttcctgcaaacggaggataaaggtgttcgcgatatgctaagttacctcatggctcgtgaaacgcagcaccagcttcaattcttaaaagcttgtgaagaattggaagaaaaatacggtccagttgtaccacatggtactcaagacttacaaaaacaaggtaaggagtttacacatacactttacaacttctcagaaggagaagccgctcaagcactcgaaggagaaactgcccgtgatggaaacaaattccactatagtagtgaccccattatggcaggtggtgaacctgatttaacagctgccccagaaatattaagaaatacgccacctgaagatccaagcactgctgttgaagaagggcgcagaatgcttgaaggtgaacaaaatacaagtaaatagttaaaaaataaaaatatacttggcttagacttatgtgatatgcataagtctttttttgtgttgtcttttcatcgaaaggagatatgtccaaaagacaggaaaataccctcattatctaaggtagaatatgtaagaagtgtattttatgagatttccttattttgattgacctatattagaaaagatatgtttaaagttttaacttttgacttatataaaacaagatgataggctgtcctcagaatctgaaaatatcgcttttacaaaaaggagagattttatgcgcgcagtaacatggcaaggaaacgaaaaaatggaagtcaaaacggtcccggatcctacgattgaagaaccaaccgacatgattgttcgcatcacagcaacagctatttgcggttctgacttgcatttataccataacgggaaaccggtcatggaagaagactatgtggtagggcatgagcctatgggcattgtagaagaagttggttctgcagtaacgaaagtgaaaaaaggcgaccgagtcgttatccctttcaacattggttgtggagagtgtcatttctgtgctaatcatatggaaagtcaatgtgacaattccaaccctaatccaatgtttgatcaaggcgggttgttcggttttggtaaaatgaacggaaatcaccctggaggtcaagctgaatacttacgtgtcccatttgcggatttcacttcttttgttgttcctgatagtgatctaccagatgagaaggtattattcctatcagatgtactgccaacagcatattggagtgtagaacatagtggtatgaaaccaggagatacagtaatcgtattgggttctggccctatcggattatttgtacaaaaatttgccaaaatgaaaggtgctaaacgtgtaattgccgtagataacgtcgatcatcgtttgcagcatgcgaaaaaaatgaacggcgtagagatcgtgaatttttcagatgtttctaaagttggtagtgaattatatgaaatgactaagggtggtgctgaggtagtaattgattgtgtaggaatggatggtgtaacgccagtcaaagaaaaaactaaagatattcttacgccgcaaagcggttcttacgcaccaatacaaacagcaagtgaagctgtgaagaaatttgggacgttgatggtaactggggtttatatgactccagcaacgaatttcccgttccaagatttcttcactcgtaatgtgaatattaaaatgggacaagctccggttatccacttgatgccgaaaatctatgacatgattgaaaaaggggagttcgacccatcggatatcattacacatacaatgcctttggagcgtgctgctgaagcatacgatatttttgacaaaaaagcagataataacattaaagtggtattgaaaccaggtatgtcttacaagaaatagtgggtctagcaaataactagctctaaatataaaaaacgcgatgaataatcataaaaaggaggaattttattatggcaaaatcagttgcagttttggtgactaatctagtcgaagacgttgaatatactgaacctgtagaggctcttaagtctgcaggacacaaagtgacaacgatcagctttgaaaaaggcactgttgaaggtaagcatggtactcagattaacattgataaatccattgatgaagtgagtcctcaagactttgatgcattgttcatcccaggaggattttcaccagatcaattacgtgcagaccaacgatttgtcgaatttaccaagttctttttggcaactaataagttaacagcaagtatttgccacggtccacaattaatgattcaaaccgggctagtgcaaggtcgtacaatgacagcatatttaactgtacaacctgatttgtattatgccggtgcacgcattgaagacaaagctgttgtgatcgatggtaatctaattaccagtcgcgaaccaaaggatatcccagcatttaatgatgccttcctatcagctttataatgttgatattgataagcattcaaacctatagcttgatgagtttgcctcttttaaaataaatttttaaacagttaccgttaaagtaacttattcctcgtgttagtaacacgggggatttttatatagacgtttttaaacccccgttgcgcaattaaactgaacttatatttctaaaacatactaattaataaaaggctagttactgaccaatttttggttagtgactagccttttattttattcataagcgttgttgtaactgataagtaatatcttcgtatcctggcttccccaacaatccaaacatattgcgcttatatgcctccacgcctggttggtcaaatggattaattccattcaagtaaccagaaatggcaacagctacttcaaagaagtagatggcttgtcccaaagcaaattcattttgcttgtccacctcaataatcatgttaggtacaccaccgtcaacgtgggccaacaaggttccttctgaagcagtactaacgtagctcatcttctcaccttgcaagtaacccaaaccgtcgtcagaatccatttctggaatcacaacgtccgtcactggctcagttacgcggaacaacgtctcaaacaagttgcgacgaccgttttggatgtattgtccgaaactgtgcaagtccgttgagaagtttccagtcgctgggaagatacccttgccgtccttaccttctgactcaccttgcaattgcttccaccactcaccgaattgaaccaacgttggatcatagttaatcaacaattctgttgtataacccttccagtacaagatgttatggtaagcagcgtattggtaagccggattatttgccaaatcggcatcagcgtattccgcttcaccagcagctgctccagccatcaattgctcgatgtcaccaccagtagttgcaattggcaacaaaccaacagccgtcaaaactgagaatcgtccaccaataccatcaggcacaacgaactcttcgtaaccttctgtatcagccaatgtcttcaaagcaccacgttttgcatcagtcgttgcatagatgcgctcacgagcgcctgcaacaccatatttctcttccaacatttgcttgaacacacggaatgcaatcgctagctcagtcgtcgttcctgacttggaaatcacgttaactgagaagtcacggtcgccaattaccttgatcaagctgttcaagcaagctggtgcaattgagtttccagcaaacaaaacttgtgggaagtcacgttgcgttgctcgtctagcaagtagttgttgaaatattcgttcaagaagtcaattgccgcacgagcgcccaaatatgagcacccgattccaataacaaccaaaacctttgagtctgattggatcttctttgctgctgcttgaatacgagcaaactcatccttgtcgtattcagttggcaagtgaagccagttagtgtaggttgaaccagccccagtccccttacgtagcatttcatccgcaactgtaaccattggttgcatcatggaaatttctgcatctaaaataaatttttctagatgttgggtcttaaattttaatatagaattattcaagattagcatgcctcttttttaattcgaattcggaaatattaaatttattcatatagttcatgacaaataaatctccatataaccaaacagattgttcaaataaacttcccattggctgttgtgttatgtcgttattagtaaacttacttttacctgatagtatagtgacatagtctgcttttttatagattgtattatgcgtgtttgtactccatagccaaactttcgcaccaatattttttgcagtatcaacatattgaattaattgactcgtttctccagatgaagaggcaataattaataagtctttatcctgaatagcaggtgtagttgtatctcctacaaaaaaagtctctttacctaattgcgcaaggcgcatagcaaaagcctgtaatgctagtcctgaacgtccaaatcccgtcaaaaaaattctattagttgaattgataaccactaataactcatcggaaatatttttatctgaattattatttagttcataaagtatgctttcccaattcataacaaactcctatattatccaagcaatttcttgaattcagctgcggctgtggctggatcatctactgtagaaattgctccaccaataattaatagatctggattagccgacttaatttcctccgctgctgttaatttaattccaccagcgattgcggtctttgtattagaaacattgttcttaatgatattaaaggtttcaaagggatcttgacccaaggcttgtagatcataccctgtatgagtgccaatataatctgctccaaaagcatctatttcacgagcacgggttgcaacgtcttggaccccaatcatatcaaccaacaactcttttccagcttcatgagctgcttttacagcgtccttaatagattgatcttcggcaacacctaaaatcgttgtaatatcagctccgtaagcaaatgcctggttcacttcatatgaagcgacgtccatgattttcaaatcagcaagtaacgtaatctctggaaattctgcacgaattttttttagtccttcaagtccaaaattaattaccaagggggttccatattcaaaaacatcaatactatctttcgtcttttgaattaaatcaatggctccttggacatcttctaaatcaattgctaattgtagtttcataataaaataacacctttctttttaagaatatatatacattatttaccttactggtaaaatttaatagagggcacttcaaagtaacctagtgtctctttatatttattgttcataaaggagtagtatgatgtcagattattttcgaaatactgttatgaaaaaacttagtaatggtgattttgattgtactaaagaatttacagtatcaatgtttagcggtaagcataaattattaatattatggatcttaataaatgatgggccacatggcttttcatattttatgaaaaatctgaagggcatcagtaaaaaagttttatcaaaccaactgaatgagttaatggcggaccaaattgtttataaacgagaatacttaactggtaaagtaaaacacactgaatatcaactaacggatataggagaaactttaattcccatcatagttgctttaaatgactggggagaaaatagactaaagcaggttactttagtgaaaacttttaataatgatttatagatttttatctgctgtttaagatgccagcagcttgcccacattaaaataatcggtaaatgtaagtgtataataaaattttggcggattaacctgctcaggagtcaatagattgggcttttgatcaacagtcaccacagttttgggcttgcgataacgtttttgcatgcgggatttattccctaattcacgcatcaatttgagtgtcatatactcagatactttcggcccgtcggtttgttgactataagcagcaatacgacgataaccataaaatttaaaggttctccaaacgtctaaaatataaggttttagagattctctacgctttgcttgtcgactgggctaccaatggagccagttgtaataggtactaggtttgattttaagtgcacttaaaatacgcataagcgagtatcctagtgctaaaaattggttaacaagcggcaatcccacattacggactattttttggctagtaagatggccgctcgctttaaaatttcgttttcttcctccaaaatagcgagacgcttttctaattgcttgacccaaagagcaatagaatcttttgaaggcccaaatacctctgccaatgatttaagttaacgtccttcttggtgaagtttaaccagtgaatctttaaaatcttgtgaataacgaattgacataaaaatactcctatactttcattttacggactgaataaaaatagtccatttttttagtataagagcattaaaaacttgaaaatatcctgtattaatttgtgtaagcattattaaactatattatttagtaagtgatataattagaacattttagaagcaaaaggagaatagaaaatggggattatttggaccttaatagtcggtgcaataattggagcagtagccggagcgcttactagtcgaggtgctgctatgggttggattagcaatatacttgctggattaattggctcatggttaggcgaaagtttgttaggtaactgggggcctagtcttgctggcatggcattagtgccttctatcataggagcagttattctagtaattattgtttcttggatcacaactcgaatcaaacattgaaataaaagggaaattttgatcatagcagaagaaaataatgaagtaaaaaagcaaaataaaaaagatgatcctaaatctaatgataaagaaaatatttttgatcataatggtcagactgcagattataagaaggcagactagaatcatgtgctcctgtgtcaatatttggtacatatttttctagagtgtcgttccaattcttttagtattgaaccagcctatatagtttgaaactctgagtagtaaatcttcaaaacttgaaaagtatgtttgaaagataaattctcgttttaataacgaatgaaaagcttcaatttgactattatcgtaaggatatccctttttggaatatgaatgggaaatttgatgacgctctaataaatctttcacttcattactggtgtactgagatcccatatctgaatgaagataagctggcttttgatgatgttctagcgcttggttaatcgtatctacaactaagttggcatccatttgacatcctagcttgtaggcaagaaccttatgagccttaggctcataaatcgagctaagataaacccatgtacctggccgcaattccaaataagtaatatccgcacgccacacattagcggtaggattatctttgattagattaggacgttgtaaataatcaacatgggttccgggctttttataacgccgattcatcaaggaatgaattttcatttcctgcatcaagcgtaaagtacgcttggcaccaatcttaatgcctaatgcattcaacacgattgtgatgcgtggataactataagcgtggtagttatcttcccaaattgatcggatttctggttttaaactgatatcaatacgatcatgttgactcaaccgataagttttccaatgataataagtgctacgcggtaattttaaagcagaaagaattatcgataagcggtgtgtgcgtaactgattttcaataaaagtaagccctctaattcggcctaatgctttcccagtaacaccgccgcagcttttaaaatctccaattcctccttgagacgatgattttctttttgaagttgtttaaatttcttggaggtaatctcagtaccatcatctaatgccactgattttgcatttttgatccaattgtgaatcgacgctgctgacactgcatattcttcagcaagagaccgcaccgatcttttctcttgatggtgcattttaatgatactggttttgaactcttcggtatatcgtttcataaaaaaactcccatcttagtatttatattatggcataagtgtctaaacatttatgtaccaaatactaggataggagcaatgggattttagattactacgcgagccctaaattgcttttacagtgtttgggcttttttttaagcgaatatttttttgaaattagaaactttttaggaatttgatgaaaaacagtatagaaaattaaagaaagaaaaaagaaaaatgacgagtaaaaaacctaatttaaaatttttgaattattgtgtttatgtaatatctttgggaggctttttatttggttacgacacaggagtaataaatggagcgctagcttttatgagccgtccagatcaacttaatcttaacccttccttacaaggcttagtatcgagttcccttgtaattggtgcttgtattggagcattaggatgtgggaagatagccgatcaaggagggaggaaaaaaacgttacgcttgattgcaattatttttaccatatcaacctttctttgtgcattagctattaatttctggttcatggctatttttagatttattttagggattgccgtgggagcggcatcgagtctttcaccaatgtatttagctgaaatatcgccagataatttacgcagtgcgaatgttaataagaatgctatttttattgttcttggtcaactcagtgcctttgttgtcaatgctattttaggaaacatctggggtgactgggggcctatatggcgtattatggtcttatctgcggcaattccatcggtgattttatggatttattcatttcgaatcagtggaagtccgcagtggcttttgttcaaaagacgagttaataaagctagacaattatttcgtcggttagggttcagcaatactaaacagctcgtaataagtggaactgaaacaattgatgaatctgatgatcaagagtttagctggtcggttgctttgaaaaataaaaaattactttatttattaactaccggaatagttattgcgttgattcaacaaatttctggtgttaataccgtcatgtattatggcacgattttacttgaaaatgtgggaatgggggccggaggttcactttacgcaaatgttttaataggtgtggtgtcagttattgctagtatctttggtacgcgtacgattgaaaaagctaatcatcataaaatgctagttattggtttgattggcaatgtcgttttcttagcactattaggtttgattatgaaaacaacgatgttttcgcagaccataacaaatgtattggtactgatcgctttgactttattcttggccaatcatcaaggtattgttagcccggtcacatggttattattagcagaaatgtttccgggaaaagttaaagcacaatttatgtcagtcgcaacagcgacaacgtggattactaactttattattagtttaatttatccgcagcttattgcattgttaggaacagctattgttttcttcgtctttgcactaaccaacggttttagtatcttgttatccattatatttgtgaatggtcgtaaaatgaaaaaagcatatgaaaatgctgaagtataaaaataaaaggggtattaattcacatggcaaacttttatgttaacacaacagaggtcgtgcacaaacttcctaataatgatcgaccaaaattttacatgtttggtgttccaagctacacgaacatgggggatcaagcagtttcgttagcagaacgaaaatatattgaaaacgaattccccgaatatcaatatattgaaattattgaagaagacgatgactatgccattcccattgtccaagagcatttacagtcctctgatattattgcgtttactggcggaggaaatatgggcaatttgtaccataatcatgaggaggcacggcgtaaggttttttcaacttttgtgaacaatctgacaatttcatttcctcaatcaatacattttgaagacaatgaagatggtgagattgaaaaacaaaagagtcaagaggcttaccggaaaaatcctaatctcgtgttagtggcacgtgatgctcaaagttttcatcgtatgcaatcaacgtttgataacccagtcattttcacacctgacatggttttatatatgaattctgtcaactggaagttcaatcgaaatggggctttattcgttttacggcatgattcagaaaaagttgttaaaaaaactacgattgacaatataaaagatattttaggaaatgaacgccctgtaaaaagagttgataccgttctagacgaaccacaaaagataacacctgttactcgggaggcattatttgattcagaactagaactattctcgcaccaggaaataattattacagatcgctggcatgcaatggtattttccgttttaacaggaacaccttgcttgttatttggaaatagttatggaaaaggaaagcatgcctatattgattggttagagcacgtcgattggatcaattacacggacgaagctgacgtagagcgtatagaagaactgttacaacagctaatttcgcaaaagcgacacgattacgacgtaaaaaatgattttcgtcaattacgtgatttaattaaaaataatatgcacaataagaactaataattattgattaccaaaaattgaatatcaaaattattggtaataaaaagaatagaaaatgtatgggctataatggatgctcttatactaaaaaaatggactatttttagtataagagcagttgggattgatttgagatttttgacccagcccgtaaccgtttgtacagccaagtgatattcattggccagcgaattagcagagcgaccctcgttgtacaaggcaacaattgatgatttaaattcagttgagtatctcttagctttcataataaaaaaaacttatacttgattatctcggattatgccctagaaataaagcaatccggattttcagtatatgagcaaaatttttttataggttaacccaaatcaatttgatctaacatcgtttcgcgactagcttggtctaatccaagataagtcagggtcatggcctcactcgaatgattcaataagtgcatgactaaactaatattgtagtttgattgcgtataaatgcgataggcgcctattttacgcatggtatgtgtgcccagatagttggatgcctaagagatcaccaacgcgtgccatcaccttgtaaaactgcttcttagtgatatgacggtctggatgggctgttgagggaaataaccagtctgaattgatattctgttggactagccaatcatgatattgcagcaagtcttgttgcacgggctttaaatataacgtgttcgctttacctgtctttttatcatgaataagggttatgcttgttacaaggtcatttaaatgatgttataaaaactaatggacaataaatttgcgttaaaagaattgaattgtatataattgattgagggggattagagtatgaaaatatcagaatattgttgcaataatcttgtacaaaaaataacatccaaattgggaattagattcaaaaattatttctaaataattttaattacttaattattttagatcctgatttgtgattcgatcacataattaaattattgaatggcaaggtgaataatgaaacattttagtaatattattattggatttggaaaagcgggtaaaacacttgcaggaacacttgcaaagcacggtgaagaagtattaattattgaaaaagatcccaacatgtatggcggaacttgtatcaatgttgcttgtttaccgactaaaaacatgattattaatgcccaccggggtatagaatatgaagtcgctttaaaaaagaaaaatgccctaacagcaatgctacgtaataaaaattaccataaggtggctgatttacaagaagccactgttttaacagctactgctgaatttttggatgaccatacggtacgagtatctgataactcagggcaggaaactttaattgcagatcgtatttttattaatacaggagcaacaccaatttggcctaatattgatggattgcttgctagtaaacatgtttattcatccacagacttacttgtaaaagataaacaattaaaggaattagttattcttggtagtggaccgattggcttggaatttgcatcaatgtatgcacaatttggtagccatgtgaccatcattgataaatcatctaagattttaggacactttgagcctgaaattgccgaacaagctaaaaatgatttagaggaggatggtgtatcctttttgttagaaagcaacttaactggtgtaaatgatacactaaatggtgttacattaactataagcacaccaaaagggattaaaaatatacaggccgatgggttattagttgctacgggacgtaaagctaatgtgaccgatttgcacctagaaagaactagtattaaaacaggtagtcacggtgaaattttagtcaatgatatactagaaacagatgctaaagatgtctatgctttaggtgatgttaacggcgggccacaattcacgtatatttcgttagatgattggcgtattatggctaatcatctatatggcgataagacacgaagtcgtttaaatcgaccagtatttgcgaatactatttttctaaatccggctattagtagtgtcggaaaaacagaggcacagctgaatgaggcaggcattgattataaagtgctgaagatgccagcagctagtgttcctaagacacaagtaatcggtaatccaagaggtaactataaagcattaatagatccacagacacatcaaattttgggtacaactatttatgctgaggaatcatttgagacgattaatatcattagtctagcgatgcaaaatcatctttcagctgagactttgcgcgatcaaatatacacgcatccaacaatgacggaggcattaaatgatttgtttgatcaaatttaataaatcatttataacaaattaaaacaaaaatactcaaggtcttatctaaatgcctaacttttttatggcacttcagtataccctagtggttttttgttttggtacatgatacattgcaccaatgggtcacgccgtgatatggcaatttatcattgtatgatcaccttcagtgagagcatgtcatgcagaacgctatcctctggggcaagctggtgtgagattaaccacataaaatacaacgaaaaaagatgatcttatacttaaaaaatggacaattttttgagtataagatcatttttgtctgtaattattttgatagttgctggttggctatttttttgtatccaaaaaccaataatcacgaaagtcaccaactagttttgaatagggatagccaattattccttggctttgtagcttattcgataaatattctttcaaaatccaaggatcttcaggtgagacgtgatctagttctaatatttgattgattttttgtacagaagtatttaagtcaatggctacatgttcaatagtcaaatgacttaattttagattttgacgaagctctttactagtattgatacgctctataaaatttaaagacattttatttctctctttcgctattaaaatcatgctgacgagaaggctgagtcagccattcacaagagttgttaattattcagatatgaatttttcgccagtcgtatatgcaccgtgttttaagaaaataacggtagccaatcctgctataccatcatcaatgagtgcccatttatagcttctttgttagccaaaatcaatttggtctaacatcgtctcgcgactagcttgatctaaaccaaggtaagtcagtgtcatggcttcgcttgagtgattcaataagtgcatgactaaaccaatattgtaatttgactgtgtatagacacgataagcgcctgttttacgcatggtgtgcgtgcctaaatagttgatgcctagtagatcaccaacatgcgccatcactttataaaactgtttctcggtgatatggcgatcatgatgggctgtcgagggaaataaccactcagaattgatgttttcttgtaccagccaatcatgatattgcagcaagtcttgctgaacaggctttaaatataacgtgtttgctttaccggtctttttatcatgaataaaggctgtatttttgacagagccgtctggattatagacatctgatttttttaatgtcatgacatcactcacacgtagtagcgtggccttaccaacttgaaaaacggtgtaatttcggcgaccagcacggaaactatcgagaagtgtatcttgtaccatctttaaaacgttggagtctttgatgggtaggacaatttgttgcgccatgattcatatatacctttctgaaattaaattattaaataaataattaattaaataaataattaaattgtttatttattgatgaccaggaccgtatttctaaacttcttttatggtttattatatcacttaacaaaaaaacagcccccattatctaatcactagataatgagggttattttaatagtatttttgaggggttatttttataaactgggtcacgagataattcaataaattgcgaatgacgaactctgatccctcgataaaataaccatcctgtcgcgtatactttagttttaattgccgacgagtcagaaaatgagcgacctcttttaagtctgccgaagtcgttgtcctgctgacaccgctgaagtcgtaaatgtgaaccagtgataacagttcatcactgacgagcatgtagaggcaaatgagcagaatgcgttcttcttcttcacgataaacatatggttgtggctcctctgttgcttgcaagttgaaaaactcagcaacttcacttggtgtgacaaattcgcctcgcggtgttcgcgtaatcttagggagctgatgatcagtcagttcttgattaatctgcgacagcgcataagccaattgccgacgagtaatgttaaacttctttcctaaatcaccacttttcaaatttggatgacgaataatctctgaaaggatctgcaagttgcgtttcttcaaacagctctcacctccaagttcaattttaattgtacgagataaacgctcattgtgacggcgctttcatttcgacttttgtgcaccttcctaaggtttggaatgtgcaaggtgtacttcctaagtcaaaaacactgatatggtagattgcaaatttaatccgaatttttggacaaatttgtcagcataacctgatacggtgtttgacagtcgaatattttaagcggtcgctggttaatttggagtaacgtcgtcattaactatttggttgataattacctaatctattaactgaaagcgtgcttataatgcgtttctcaaacatcaaaacataaaaaagcacctatttctagtctttttcacgaaaatggttacggtgtaactatatatttttacatttttgaattcgcctactactttatctgtgaatcgtaccaccacgacgtccatgtttatgatgttgacgtttctttttatctaactcgtattccaattcctcttgtgctttcctttgtttgttcagctcataatcttgggtatttgaataaagcacgctcattaaggcatctgataataatgtactcatatactttattggagtattttcattataattaacggctctgtacccttctatattctcttttcggaagtcatcactccttaaattatgttgttttactgcctgcttagcctgttcaatttgcttagcagaaatatttttatcttgtcctgcttcaccaataaacaactgttgtgtgcctctattgttcaacacacgtaacaaattagcgtttttaatcccatctggtttaacctgtccgcttaaataagcaagtccttgtacatgctcttgcgttgtaaatttttctggtggattgttttttagacgggttatatcctgtttctccagtggttgaagctcaggattgtaataaataactgccgtatataatcgctctttttcagtcatttttactttgtttaagtctatatcaggaaaagacttagttagaacgctgttgtattgtgtatcaaccacttttttaacttcattaattgctgaaagttctttaatgcttcgctttaatacgttttgttcattttcttcaaaaccgtttagtaaagcaccttttgttagcttaatatctttaaagcggtagccttttttagccaaaatatcgctagtattttccttgactcgctgttcttgcttttcaagcattaaccaactaacgaatggacgcttagtaaatgttagaatttgttgatttataatattagttcttatcattgccaagcgatcttttaattcgtttcctgcaaataccttttgttcactatctgtttctttaattagttcacgtttttctgccattgttacccgttcaaaatcaatatcagggtaaagttttctaactgttcgattaactactttatctagcaactgattagcttctgctaatgaattttcttgttgattaatagttattagttgctttgtcatattctgtccaattacttgcttaatcatagtgctatttttccaattaaatagcatacgttgtttttcgtctaaattttctaggctaacaaatgtttttaattctttacttagttgagaaaccatacgtttctcatcaaacgaataatgacgttgtagggtttgtatacgacgttcattatgaattttatcattcacattttttacttctgattttgcttgacgttgtagcttaacactacggttaaattcttggcgattttctctctgtgaattaaccccttcatgttgcgttgcaacttcatctattccctgttcttcatatgacttttcactaatacggtctagtaaatttttatcctctaaaactttattaacagcggtagcccaattgtgacgccattcagttattttttcttttttatcccaatcaactaaccaaattttcttctgtcttggaaagccacttttagtaaatgttttatttccatttttatctaaaatatattgtgtttttgcctttaatccccatgttccgtcaggattaaacgggcggtttgttagcataacatgcgcatgcggattatctggattatctctgtgaatagcaacatctgctaccatgcctgcattaacaaaattttcttgtacatacgctgtcaataattctttttgttcttccgttgataattcgataggtaaagcaacattaaattcttttgcgtaacgtgaatttgctttacggtctttgtcttcaacttcattccataatttttgcctatcttttgcccaatcaggggcatttttcggggttaaaataaatacttctggtttaatatctcgtggataagaataagttttcccctctttatcagaaaacaacttttcgccacttcgataactcgcactagcaaccgcactacgcatttttcctgcgcttatattttgaaaactcatatgaaaaattgccatgctgttgtctcctttcttttgagggtttggtttttggtttttgttgtcgccatcagcgacttctgatacaggttttttaggggttttaacacgacatagattttctatgtgtaagtgcgcattgacctcgtttcactcggcctgctgattctcctaaatttacttatagtgtatgccttccgcttcgctatttcaacttttatcctttgacttaacgtttcctatatgatatagtttcggtgattatttctaatatgattgaagggatcgttatgtctcaaagtaacttagaaaaacaagaagctaaattaaaagcccttaatcaaaaaattaagaacgaaaaaaataagattgaacaaaacctcggtaagcaaatcattaaatcagctaatttggattatgctaacttgtctaacgatcggattaagcttttagccaaacaattttctgaatttttaaaggaaaatcccgtagatcatcaatcataatagatggggtataccatgtctaatcaatatgaaaaactggttgagcaacaagcgcgtttaaagcaaaaaattgagcgagaagattttaaattacggcaatctaaatactatgaaaatcggcaagcccgcaaagcccgttctcgccgattaattcaaaaaggggctttattagaaaagtactttcaagctaataacctctcggtcgaacaaaccgaagaacttttaaaaacatttgctgactatgttaacgcccataaaccggataaattaaaaaacgatcaacctaataactaggccgatcgtttttattttcaggattgttttttggcttaatttctggattgtgtttagcaaagtcttttaactgtttttgaattctttgtgtaagctctgctttactttctttgtgcttccttttacttgatcgctgttgaattatcttttgacccttacctcttctttttgattttaggtcaagcgtaaaatctgaaattttattttgatctagcttacttaaatgaccgatttctttaaagtttaaaccggctttgggaaagcgataaatattaccaagatcgacccaggaaggtttcttcaacccagcggattgccaatcttgaatcggataatattgttgcttgatataagccgacttcttttcatactgactagtaattttaaaagcctcgaccgtctgttctgatacccgacgaattaaaactggtcgagacttgccaccgttagcttctacaaaactaacgtataggctgactaagtcattagtcctcatctggatcgttgagccaatcagcaacctctttagcgtctttgaactcggtgactggtgtcccttcggtcgcctttaaaaagcgtaaattagctctttcttcttcacttaaagacgcattaaaaggtaaagcaccattagcaacaatccgcttgtaaaacatgttaatggccgtggttggatttaagcccaattcgcttaaaactgcttcggtatcatcggccaaatctttatcaatcttgacttggacccgtttcttttccttaaatgccatgattgtctcatctcctttcttttactactaccatcatactaccttttgagtaccttatcaatagataaagccctggcctcaaatcgcttgagcttggcgttgatctaaaggctgaacttttgaactggttagcctggttagctctggcactcatttaaaagcccctattcttctgtttaagccatttaaatctaacttaagtataaagagaggttagtaagtcttaaaactgtttagaaaggattttgtagtcttttaggactagtagtacgaccccctgttatcgttgtcggccgacttttcttcttcggggtgtttggccgcgtattctctagccgcttgtttgttccaccaaataccaaatagattttgcatggtgccgtacaggtagttttccacgttcttgatgtgtttctcattgcttcttagggcgttaaagtaacgtctcaaggctttagtcatcaaaggtttaagttcttcgtcgtcaagcgggattagaaccccaatatcctgatgatctttctcaactcggtacttagcatttaagataatgccaatgaagcgacgcatctgttgcggggtacggcaccaaaaactaagcggtattcatcatgttacagcacccaagtaaaagctacgaagataaaaacattcaccatcaaaatatgtaacctagaaaaaaggcctccagtgttaaaccgggagccttttttagtataccaatttctacttcacataaggcggcttatcccaagtaaccccctcactccctgataaaacaacgatccgttatttcgcctttgtgaaactgtctaaaaatgaagtggtataggttgcagattgactttaattgggtaaaccgtctttgtgaaattttcttagtttatccctagaccattcccacttatcattaaccaagtatctcaaaaatgactagcaataacttgcgcaaaaatcataatcaaatagcttataaaaaataaaactagattaaccttagttagccgttattacgagcaagtattacaaaatatgctacaaaaacaatggttataccaaaataccaaagccctgtccccaaaaataaacactccccatttaattatcttttgtttttgacttgacaggttacggttttccattcagtttagagggagtgacgttttgagcgcagaattgttccctggaatcagctatttggaataactgaaccagagtacaattctacgctaaggtttccccttagttcgtcggtcgttaacgcccgtcgcttgtctgtacaattgcggtattgctaccaccactcattataaacctacgttttcggtttagcctactaaaaaacgccctagtaggcgttggtaatacgtatttatgtttgttcgatcaccaactaatcagtggcaccaagccgaagcttcgttttaccacccgcgccgttaatggtcgcgctcaccattcaccacccagccgtacagatggccttgttgtggtatagccagacttattgaagccgcactggcaaacgtgtccccttagatttagaccccagcttgtcccctagggctttaaaaatcgcaccggccatgatataatagtcattaaactagatgacttttatgtggcgctcaccgattcccgtcggtgggtgtttttttatgttcacttgcaagtacaattgtatttctctcaataaaagaaatcaacactttttttaaaaatgtatacatttttacattagtacaaatactaatgtaaaaattagtatttgtatactcgttcaaaacgcctctattgcagtctacatagagatcatgtatacatttttacttttacacacttgtatttgtatacatgtactaatttttgtgctatgctttaagagcattacactacatatttatgaggtgatattttggacagtaaagtcataacattttcaaactttaaaggcgggactggcaagacaactaatagtacaatgactggtatcgagttggcacgtcgtgggtataaaacactattaatagatttggatcctcaagctaacgccactaatttatatttaaaaactaaaaataacgtcggcggtgaagtaacttcttttgatgaaaccttgatgaccgcaattaaaaacaaaaacctcaaaccagctatcatcaacgtaatccaaaatttagatattcttccatcctcagctgacttttctttatatcctagatatatggagaatataatttctgactacaccgatcgtgtaaaatacttgtctaccttaataaatccgtggaaagatgactatgactacttgttggtagacgttccacctacaattagcctaatcacagataccgcattatatatgacagactacgcgattgtcgttcttcaaactcaggaaagatcgcttcagggtgcccaggcattcatcaaatacatgcaagatcaaattatcaatgaattccacgctccgacattagatttactaggaatattgccggttttgctgaaaaatggtgctcctgtcgataagagcaccttagctaaagcaattgatatatttggtaaagaaaatatttttgacataacaattaaaaatatggaacgtttaaaacgatatgatgtaactggggtgacatttaaagatcagtttgataaagcagttcaagacgtatactccaacgttactgatgaaatatttagcagaatggctggtgaataggaatgagcggattattaaacaatcccaatctaaaaaagcaaccaaagacagacccacttgatcgtggacaagatatcaaacccaaaaacacctttactacagatgatcttaaaagtaataatggcaaaccatcaaaaccgggaaaaagcgttgcagattctgttactttttatgctaacgttagaatcaacaaccatattaagaacaaagcggaagctttatctggaattggtctatataaatctcaaaaagatgccattgataacgcattagactatctcatttattctttagacgctgaagacaagcgaaaatttacttttcaattagatattttggagagtagagacgcccgaactaggggaaaataatattgcgcgctcagacgacacgttcagcttttagacgtatactttggtccgtttaaatgaagcagaatgcacaaaaaaagccacccacctcgtgatgagatgagtggcttttgggttgtgtcaaccttgagggattaacttaatcctaacactatttatttttaagttcacgtacatcgtcttcaacattgtctaagcgtttgttgataacttcatgctcgcttctgctagtaattaaatcttcacgcagcgtattttgcgaatcaaacagccgttcaattcgctggctgctatccttcatactttgagcaatgtcttgcagccgatctgtgaagtgcttcataattgttagacaaagaagtctaacgattgtgaggtacttttttcatggttaaatatagttctgttttaaaagctcaaattataaatgaacatctcagcgacggtacttccggagcggaactagcaagaaatcatcaattacccaagcgacaagttaatcgatggcttcaacaatatcatctgaacggcattgaaacacttaagcggtacaaaactcggcgtaagttctcgggagaatttaaatggtatgtgataaactactaccaaactcatgatgagtctttagccgaggttgccggaaaatacaacgttttagcctgtcagattagtgtttggcgaaaaacgcttattcgagacggctattctagcttagagcctcatcccaaaggtaggtcaaccaaaacgaaacgttctaaaaaacagattcgtcaattagaaaaacagagtgaaatcgagcgtttacgaagcgagatcgctcaaaagaatcaggaattctatgacgcaatgattcaccgatatctcatccagagatactaagccttcttctctcgaatggagcccaccagatcatctgtagctggagcgttcgcaagcaatgcgcgaacatcatcaagattcaccttaacattccaaactaaaacaccaactaacttatcggtatctatgaaatagacaagcgatccatgcgttcgccgatcaaaaatcaattgcaatttaggatcaatattaccgattgcttgccaggaaatatcaaaaatcatggaatagaagtatggggtatgctgatagctcatgtgagcacccgccatattacggccaactaattcaccagaaagtcgggcatggtccacgtgctcaatccgttgccgacccaagatgtgatctggataagaggcaatatctccagcagaccagatggctgggtcactagtattgagatactcattaactttcacaccaccatcagctaaatccaaacaactgtcttcagctaaactaatccgcggcgtaacgcctaacccaacaatgatcgtatcggctgcgatcaccgtaccatcctttgtcaatagagtcaagtggtcaccttggcgttgatatgattggacaaactgaccactcatcagtgtgacaccattgcgtttgaacgtggcttcatactcagtccgaatagactcaggaaatttaccctcacccagcgctttttctggaaaaatcatcgtaacttcagtctcattttgggtcagtgacgatgcgagctctgtaccaacatatccaccaccaatgatcacaactcgcttgttcggaccactaaatttacgtaacttgcgataatctgaccactgtctaaagactagcacatgtggatcagaaggtccctggatttgtctaggttctccgccagttgctagcaatagctgttcatacttgatttgctcactatcggccaatgtaatgaccttatcttgccgattaatagccgtaaccgttgtcttgaacttaaaagtcacattgggataattttcagcaccaatctgaatgttctcttcagtaaattcatcatctagccatagttttttactcagtgccggtcgttcatatgggacatccgcctcttgcgaaataattaagatctcaccctctgaatcttcctgtcgaattcccttgatggcatagccagcaaccactccgccaccaacaatgacgtatcgatagctgtttgtctgatccaaatcactcatctaattacctccataactttactttttctaggatcattgtaatataaaaacgccatgattcgaaaaataacgatcagaattgtcaatcgttgcttgcttttatcagaataataattttatttacataccgctacaaagctatcaaatatcactatgatccagatttagaattgcggataacacagcataaaataatattattttaattaaaaaacctcaatttttaaggtaatcatttttgattttaatttgaagtaacaatattcgaagagttgtcatttttcttggtcatttctcggattttagtggagttagaagtttcaagtggtccgctctgctatgattctctcatgtaaacatcatctttgtatattgaatttctttcgatatctgataaaggttgaacgtttaatacctgtttttcgagaaacatccacatcactcatgcctgcctgataaagcttaaaagcatgttgcaagcgggatcgtcttgggtgtattggggtttgcggccatgatatttaccctgctgtttggctaagataatcccttgttgctaccgctcaatcaaccgttctcacattttccttgcttcgaattaagtcaacaattagtaaaactgctattcctaataaaaaaatatggtaaggagcacagtcgtttgcattccagttaataaatgatgccactctaacttaattcccatcattttttcaaaatggttttgctgaccatgaaaagcccttcttaatttgtcactcataaagatttgccgataaattgctgctacatatgcaccaggcgttagtttgataaggaattgtgcaaagttaggaagaattccaaatggaatgtaagtaccaaccaagaatcccgaggccgtcccaacaatcgattccaaagctccaagtgaatcaaaacgattaataagctgaatgaataacatgttaataacgactgccagtaatgaactaaaaagagcaacgcaaattactgccggcattgaagcccagggaatagtcaaactgtccgtaattgaaaagtaacccatcattaagaaaaacatcattaattgcataagaaatccaattaacgatgcacttaacatgtaacttatttttatttcaaaatgagaaagatctgttaaataaaagtccttaataacttcacgttctttatctttaactaattgacccagcgaggtaaacgttgttgtaattgcagtcactgataaagtgccaccaattaaccaaagatcaagtagttgatgagaattaggaacctcctgccaactatttatcatcgaatttttcaaaaaaataatatataagacaaatgaaatcattgccgccaataaagagaaaaatacccctggacgattacgaaaatataataataaatttctttttgtcaatgctatcatatttagcgcatcctccttccagttaatgccaggaaagcatcatccatagtgccgtcttgataattaaatgtcttaataaaactatgaaactttaataataatgtgagtgcttcgtcagaattagccattaaacaaatggttttatgattaatctgtgtatgaattattttacttggtatcaatgccattaattgatcagcttgttcagaaacaatcacgagtttactgctagaattttgtgttttaatttcatcagcggacccgctggcaattatcttgccatgatcaataatataaacctcatctgcattgtctgcttcttcaagatagtgagtggtcaaaataatagtaagattgtcattctgctgcaatgattgtaataacccccagattgccgagcgagtctgaacatccaatccagtagttggctcatccaagaaaagaacatcgggctgattaagtagagctcttgcaatatcaactcgtcgccgttgcccaccagaaagttgaccgtatttttgattaataaattcagttaagccgatttgctgaatcaaagtatcaatatgattagatttggcttttttgtaaagcttatttcgaatgcttaaattttccataactgtcaaatcattatctaaaatactttgttgaaataccatgctaatctttatgtctggtttcatcctgatcattccactggttggatttatgatccttgtgagcattgatataatggttgttttaccagcgccattgggtcctagtagagcggttaagctgccttctttgattgctaaatcaatatggtcaaccaccacttttgattgataagctttagtaagaccctttgtttgaatgatcattatgtcatcttctttctaaactaatataacgtaattatctcatgtaaatactatctttgtacattgagcttctttctatatctaataaaagtcgtccgtttaatcccggtgtttctggcaacatcgatgtcactcatgcctgcctgataaagcttaaaagcatgttgcaagcggggatcatctttggcatattgaggcttccgaccatgatatttgccttgttgtttagccagggcaatgccttgttgctggcgctcaatgatccgcttacgttcactttccgcctggtacttatacaattcaatgatgaggttagtcatcagttgacgcaaattagggtcagtaattcctgtcatggacggcaaatttaacacatctagggtggcccccttattttgaatggtgttcatgatcttagttaaatcctggttgtttctgcctaagcgatctaattcagtgaccaggacaatatcaccctcgcgaatataggccagcattttttgcagttctggccgattagtgttagccccacttaatttatccgtaaataatttatcaacgtcttttaaagccgctaactgtcgatctaaatgttgctccttggaactcacacgcgcataaccgattttagccatttccaattctccttttggacagttctaatgaacacttgtaattcctagtatagcacagaaataaaaaagaccattagggtacaccctagtggccgtttttgatccattatcaatggctttttaaattagggcctagtacttttggaatggaaatactttccaacaccaaaaattctagacccgattatttttgttaaacgagatttctatatataatggaattataaatttactgttggaggtttttatgactgatttatttgcagatgggactatctctatccatggagctcaagaaaataacttaaaggatgtcagtttagatattcctaagcataaaacgactgtatttgctggtctttctgggtctggtaaatcctctttagtttttgatacattagccgctgtttcccgacgtgaattgaatgaaacttttcctagtttcacccaacaatatttgcctaaatacggtcaacctgaagtgaaccgaatcgacaacttaccagtggcaattgtggttgaacagaagcctattggtcgtaattctcgatctactctggcaacctacaccggcatctattccgtcttacgtttgatgttttctcgaattggacagccttgggttgggtattctgaatggttttcctttaacctacctcagggaatgtgtccaaaatgtcagggattaggctttgttgacgacatagatgaacgtcaattaattgatcctaataaatcactcaatgaaggtgcaatgacttttgccggttttcaaccgggaacttggcgttggaaggaatatggcaacagtggattatttgatttagacaaaaaaattaaagactacaccgatgaagaatatgatttattcatgcacgctccgcaacaaaaattaaaaaatccaccggcaaattggggccgtacggcattatatgaaggactagttccacgtatgcttcgctctgttattcatagtgcctcaggtcgtcatcatgaagctgccttatcaaagattgtcactcgaaaaccttgcccagtatgtcatggaacacgtctgaacaaaaaggctctaactggtaaaattgctggcaaaaatattgcagaagtcagcgatatggatttagtaagtgtcctaaaatttttggataatatctcggaccccaaggctaaaacaatggtgcgtgaactacatagtaaaattcaagctttggtcgacatcggtttaggttatctttcccttggccgtggaactgatactctatctggtggagaagctcaacgaattaaaattgccaaatatttgacgagttccctatccgatttagtttacgtactcgatgaaccaagtgtaggactccatcctcacgatattaaattaattaccctatccttaaaaaagctcaaggaacatggcaataccattatcctagttgatcacaaccctgccattatttcgacagcagattatgttgtggaaatgggaccacaagccggcaaaaatggtggtcaagtaactttcactggtacctacgacgaactattacggtcagatacgattacgggtaaaatgttacgagaaaaaatcactttcccaaagcctcgtgaacctcaatcttggctaaatgttaatcatgtaacttctcataatttaaaagacgtatctaccagaatccctcaaggtgtaatgaccgtgatatctggaccagcaggttctggaaaaagtactttagtccaagctttcaaacaacaagtttctgatcaagactatattgatttgagtcaggattctgtaggtttgaatattcgttctacacctgcaacttacttgaacattttaaatcctctacgaaagcttttcagtaaagccaacaatggcgtttcaacacgactatttagttataacggtaaaggtgcttgtccccgttgcaaaggtaaaggtgtgatgatcaccgagatggcattcatggatccaatcgttcaagaatgtgagttgtgtcatgggaaacgttatagccaagaagcactacaatacacttatcatggcaaagatatttctgaggttctaaatctttctatcaacgacactttagagtttttcaaagatgtgccagatatctacaaaaaggttagtctactccaccaagttggacttggttatttgaatcttagccagtcgatgaccactttatctggtggtgaagtgcaacgtgttaagttagcaatggaattgaatcataccggccgaatctatttcttagatgaaccaacaaccggattgcacttacaggatactcaacaattgatcgatttatttgaaggattggttgataagggcaatacattaattctgattgaacataatctgaaattaatttcacgagccgattggttagtcgatatgggacccgatgctggtaaattcggcggtcaagtttgttttgaaggtcatccaaaagatagcctaaacgataaaaactctcggactggtgctgcattagcagctataatttcttaaaagattcaaaaagatcacctcatttaaagtgcaacacaaaagttagacaaaattgaatatttttaaactgctaaggcatgttccctgtattcgcagggagtcatgccttttgttttctgtgatattcgtcgattgttaaaccaatcgacgtaattctttgtgatttccttgaattctccaatatctttacactgtggaaatccattaagacattctgttttaagaagatgaaagaagctttcaattggcgcattatcaagacagtttcccttacgagacatgctttgtataaattttttttcagagagtttatcggtatagtaattcaattgataatgccaaccttgatctgaatgaattattggttttattccttccggaatattttctgtgagttcatcgagtgtatccataattagtttactgttaggactattacttacttgaaatgctaaaacttccttgcttgcttcgtcagtaatagctgaaacgtaagcccacttagtatcggccaagcgtacttgtgtaacatcggtatgtaatactttgaaaggtacggtttcattaaaatgctgatgtagaacgttacgggccacttttccaactgtacctttataagatgaatatctaccatttctgtggcggttataaataaagtgctccataattgttagacaagaaatctaacagttatggagcactttaccactgcctttaaagcggctcgcttttttatttacattcatattttaccatcagtgattacccatagcatagcaaattatgaaacgcctatttgataactgatcatctaattgagttaatacttttcaacttcacgtgaatctattattcgcaaggtactcacatacattatttcaccgtatatgagacttggtctgtaatatcacaaatttcagaaatcttggtaataatggctagaataaccgaagcggagaaatttgtttcgattacggtaccattttcaagcgtggccggtgcgttgtgaggcctaaagagcattcgacttatctgatcgttttctttaatccgatcataattaagactatccctattccaaagatcattgaggaagattttcaacatttgtttccatgtttttactggatattcgttttcattaattgttatttgaacaggggctttacccgtcacattaactgtttgatcaattgtgtactcaccagtaatttcttcttcattaacttctttgatgtttggcatcggaaagatttggattaactcatctgttaactctttagtgcggtcgataattgcttcttttccccattgattatacgtttcagcaacttctcgagtaagagaaacatttgagtccttataaaattcttttttctcactataaggcttattactcatctcctgattatatttagttaaagtcaggttaccaagcgtaccaccatactgttctttaaccttatcagcattagcaacctgaagtcgccattctgcgttcaatcgttgtggcatgatatgctcaacctgtgcatcatcaaaattaattgtttctcgagtcctatgttcttcaaggatcaccaatgataactttgctaaatgatttctttgatgataaaggtccacttccatcaaactttccaataactttcgatcgtctggaaagtttgcctttagcaaccgaagtaacctgaggcgtaggttaccaccctctttagataaatcacataggcctacgacaattttatttaaacgatttgttggcatttgacatgcctttaatcggaaagataactttccaaaatatgtgctaactgaatggcttcttcttgattaatttttgctgtatctactaaatccactaatagcattagataaggaaatacaaccttactatccatcacattgatatgctctaatatcttattaaaccgatcatcagcagatttgtgattcaaaatttgatcgtagtaactagcaaatttaaagaggtcagcgagagcttgttcggaacttaacccatttgaaatgaagtagtccttatagctactatatgcaccattctttttaactgacgtatgtgttttgacaaccaaataatgccgaataaattcagcaaatgttttagtagcaaacatacgctcaattttaacccaataatttttatataatatcgtttgttgctgtgaatcaagtctcattaataggaagtttcgaactagatcagaaggtaataacgaaactcccgtcgaatttaaactctcaaaaataacttgtggattttcttcatttggatcgctacttaactcaatgtaaaccatattaaaatggttcatcgcttcatacagtttagaactatcgatgtcactgcttttaatcagtttttgaaaaaggcgataattatcgataacttttgaaggcttatcaaaatctaacctattcattactgaataaaatgcttcatagtaatgttcaaccggttttagtttaagatgattattatcatccagatatttattagttaaatactcttcctcaatttccgcttggtcgtgttcatcagcaaccgacaatgcttttaatagtaaagttaagcttgttaagcgctgctgaccatcaataatacgatatatatgactcatcttattaccggtttcggtaacataaacaattgcaccaataaaatgatcagtattagtttgcgccgcaacggttaggtctttaaataattgtttacattgttctctatcccactcataatttcgctggaaaacaggaatttcaaaaattgttttaccattccccaggaaatcaaataagtgtatgctatcagctttcatactattcttcctccccaaattcgcgttgtactatttctggcagcgtaccttcttactgattctttaattttatatttggttaaagagctaggctgcctgtataatagatccagtagagaagttaaggcggtggctatttccaatcggaggtggtgcttatggtgttaaacctttaaagcccataaatcctaacgaaaggagtagcctaagtgtccgttgcggacgctttacaattaatgctggctttcggtacctttaccgtggccttaattgcatcgattgttgagctgatcaaaagtcagcaaaaaaaataaccgccttagcttggcacagctagcggttatttttagtcgttaattaatgccaccgtcttaaacggctctacatgggaagtcctgttctagcggggcttcctaaagacatttttttaccataaactctcctttgtactcaatttgtagaaaaatttacaatttacacaaaatatgtgctgttaaaaacaaaattttaagtaacaatttcgcttatatgtttatttagctacagcaaaaaaactcgcaatatgcaaatatgcacgttccgagtttttattctttctgtattaacaaagcgcgtatttaaaaactaccttacttattatctaacatttcctttatacataaaagaattaaccgaacagttgggattttttaatttaagctacaattagttagtagaagttactaacctagccaacgtatttctcaattgccttatcaatattttcccgtacttgggtaactcgatccatttcgctttcttcgacgtgtggtaatggataacgggcgcggcccacggcaactcctctttgcgccagaattaacttcattacgtcgtaaagatttcctttaaacgaagttaattgtgaaattaaatcattgacgcataactgaatttccaacgccttatctaattcgccttctcgaacacagcggtcagcttctaaaagtaactctggataaacgccgtacgttccgccaattccagcatctgcgcccattacccgaccgccaacgaactgttcatcagggccgttaaaaatgatattttcttttggagtacgcaatttccacatattgatgtctattaccggcatggatgaattcttaaccccaatcacctgttccttagccatcatcttcttaaatagtttctcagacaatgcgtatccagttgtttgaggaatgttataaatgatgaaatcaaggttggttgcctccataatacttgtccagtatgcttcgattgcggcctctggcagtacaaagtagattggtggaatagctgccaacgcatccacgcccaattgttccgcgtgtttagctaattcaatgctatcccgagttgatggtgccgcaacgtgggctataattgtcatttgtccgccgactgctttcattacgttttccaaaactagcttccgttcttccaccgtttggtaaatacattctcccgaagatccgccgacgtagagtcccttcactcccttggctaaataatacttggcaagcttttgcacccgttccggactaacattaccttcgtcatcgtaacatgcgtaaaatgcagggataattcctttatatttatcaagattttttgtcatttcaattactccttttaatttttgagattaactttttgatcaatcgttttaaacgtcaacccggtaatgtcatgttgatgacccggtttgaggaaactaaatatatatcctaaaatcatcgcacctaggaagcccactacactaacaaaaagggcgttgattccgtgagtttggataaagtagcagattgccgtagtgacgatcatgccgagggttgctccaaagccgtttgcccgttgactgacgatacctagagcaaagattccggcaatcggcaccccaaagagtccaaacaacgaaaggtacgtatcgatcatgtccgaactgtgtaacttaatcaacactagcgtcactagcaagccaaaaattccgcaaatcaagatacttagccgtgtaatccgcatactcatccggtcgctcttgtccttcatgaaccgcttttgaatatcagttaccaaacaagccgcggtactatttaaactcgaagcaatcgtagcttgcgaagccgcaaagatggccgcaataatcaacccggcaactcccgctggaatttcagttaatacaaaatatggcaccaatgcagaagtgttaaatccggttggtaaactaccaccgtgttggtaaaaactgtaaattacggtccccatcccgtaaaatagcggaatggtaattaatgacaacagtgcgttggtccaaattgacttagcaatgtgcttattgtcagtcgaagtggtgtaccgttgaactacgtcttgactggccgtgtattggtacaaagtgttgaaaatctgtcctaagaggatgattggcaccgttgacttagtaacgctccatacaaaatcagccttagttagaattttccctttattgacggcatcttgcgcaacggtttgcaatccgccgtgggttccgtgaaccgcaaagaaaataattaaaaccgcgcctactaataggaggattccttgaattacgtcgctccaaattaccccttccattccgccatggtatgtataaatgatacacaggatggtgattaaagaagcgattaggtacgggttaatgttgataatggattgcagtgccacggtcggtaaataaattacaattgcaatccgcccaatgtgaaataacacaaacaaaatgctgctaaacacccgtaaaaacgggttaaaccgaaactccaaatattcgtaagccgtggtcacccgcaactttgaaaagaatggaatgtagtacttaattaataccggagtaatcaaaaaaatggctaaatttccaaaggcataagcccagttggtcaaaaacgatttttctggagttgacatgtaggtgatcgcacttaaagttgtcgcgaaaatactaaatccgaccgcccatgccggtacgttactagtactagccttaaagaactcttccgaattttttgaactcttcttactgaaacttaaaccaattactaacataatgattaaataagcaattaaaaccagccaatttaaaacaccgaatccttgtttaaccatattacgcagtacctactttctacgaattccaaattaaatgattttcacgtagtttaagtagcggcattatcagccagtaagcctgattccttcagaattaacgaccaatcttttcaaaaattgcaataaaaaatgccacaaaaactcgcactacatgatgtggtagtgtgaaacctttgcggcagttgaattcgcattaataactattacagatagagattataaactgttccctgttaattgtaaaccctttcaaagaattaaatttactttttgaatttcttcgtctaattcttcatcagtagcaactccgtattccaaaaataccggcacttcagaatttaaagcttgcaccatggattgccaattagttgcaccctcacccagacggaccgtggttaaatcggtaatatctttcaaatgaaacacggtaatccacttctttaaagaatcaaaagcactttgcggatcttcttttatccaataccagtttcccgagtcaaacgtataacctaactcaggaaccaacgccaacaatttaatcaagttatctttaaaaagttctaattgtccatcctggtttggttgattttccaccgttaccactccagaatacgcgcggagtgttttttgcaattttgctagacttgaagcgggtgtattttggcagtcgcccaaactaatctttaatccttgaatttggaattcgtttgccatgactaaatagtcaaaaatattttcgtttaatcgtccttctgtaaataaggcttcgggaatcgaatagtaaaattgccaatcgttttccttacacaatcgttgaattgtagctaactctaaatcacggtgatcttcttgaaaaaattcaccccggacttcaattgcggcaattggctttccaattaactgctttaggcattcgctttgactacgcccattttcaagctggtttaaaaatactgcggtattaatcgatacttttttcatttaccttctccttatttttcttcaagaacggcacaattgcaccaattaattgcgcttggttaccttgttgcgcaatttttagtgtggttcggttaaaatctgggggtaataatgcgggtaattgcttgttaaacagatcaatcaaatattgtccctgtgcagaaaccgccccgccaattatgatgtagtccggatcaaataaaacaaccacttcagcgattcccatagccacttcgttagcccaccgttcaataattgattcgtaagttgcttgaccctgtttagccttttcaaaggcatcaattaccgttacacccttatcggctagttggcgttccaaaactaacgttgaagcccgttgttcataattggtattcgtttgcggatcaaataacgtatatccaactgaattgccctgtccatgcgctccactgataatttttccattacgataatgcgctccaccgattccggtacctaacgccatgcagtacacatcttgattcactaattgtcccgtaaaaacctcgcctagtaaagccgcgtcgacatcattaactacgctgaccggtaagttagcctgcgcagccaaactagttttaatgggcgtaccaatataatccggaatggttggacctgcgtattgaatactgccgtcccggcccacaattcccgccgtactgaccccaattccagcaagttcgaacctttcttgaatagtttgacttatctgcagcaaggtttttaaaatatgtccgtttcgattttgttctgtattaaccttccctatatccgtaaaatttaattgttcatcaattaccgcgtatttgatggtggtgccaccaacgtcaaacgccaaaaactttttactcatctcgggttcctccaatttaaccagcattcatgataacgatttcatattaccatccgtttattattttcacaatctaaaaaaacgaaaatattttttgttaccgtcacaacaacgttttttcgccaaaatgaaaaaaattaccggatttggttattgcaatattttttaactcgagttatatttactgcggcggttgaattagcaattaactattacaaattaatttttatttcagaccctagattaagtagcgttgtttttaagaaatcaaatttgataaaagtgaagtgtcagtatatgaaaaatagatttttagacgctgtcaaaggacagttaatcgtttcttgtcaggctttaccagatgaaccgctccacagttcctttatcatggctcggatggcacgggcggctaaaatggccggcgcagctggtattagagcaaattcggtagtagatattcaagcaatccaagacgaaactggtttaccaatgatcggaatcgctaaaaccgactacccggattctccagtattcatcacccccaccatgaaagaaatgcgggcagttgcagctaccggcgttgaagtagtggcttgtcaagttacgggacaacctcgtccgcacgacgaaaagattgctgacatcgtcaagcaatttcgagctgaatttcccgacacccttttgatggccgatactgacattatggaaaatgctctcatggcagatgaattaggttttgacattattggtaccacgatgcgcggttacacccccgcttcaaaaggattaaacattgccgacgatgactttgcttatctcaaagaactcttgcaaaaagttcaccatccggtggttgctgaaggaaaaattgatactccagcaaagctgaaacggtgcattgaattaggttgtcattcagtagtggttggtggcgcaattacgcgaccgctcgaaattgcaagtcggtttattgacgcaatcaaataattaccaaaacttgaaacgtggctaaaatttaggcgaaagtgacccttaactaaacgttccggttatttttaaatggctgggaaaaaaataaagaaatgcttttcaaggatgaaaaaattgttttgacttcaatagcggcaaaatacgtaccaaaagctaaaaggcttcccgagaacccacaattcttaggaagtcttttttagtttcccgactactttcgtcattcccggataaaagcgtataattaaggctattagcatagaccaatgaggaggttctcaatgaatattcttgaggcggtagaacaaaaatatccttcgttatccaggcaagagcgtaaaattgcgttaaaagtaatccagcacccttcccaggtaaaaaaaatgagcatcggcatcctcgccaaaaaagctgaagttagtaccgcgacggtgacccggttcgttaaaaaaatgggttgccaagattttagtgaatttaaattaggcttggcagaagcaacgtctacaattactgaggacgtcggcaatgccccgctacctgatcaggtaactaatttttataaccaaatgatcaccggaacctggaaaaaaattaaccaaactgctttagacgaagccgtgcaattaatcaaaaacgccccccgaatttttgtgttcggcctaggtagctcgggttacaacgcccaagaactatcccagcggctcctgcgcatggggatcaacgcctttgccccagccgatagtcatacgatgtacatcaccagcagtattatgcaaagtgacgatttagtaatcgtgctttcagtttctggaaactcagcggaagtcaacgaagctactaagctagctaaagaacaccagctcaaagttattgcgattactgcttttgatgacagccccctagctacgatgagcgattgtaaattatttgtccagtacagcgattttgtggataacacccgctttattaactcccaattagggattgtttacgtaattgacgtcttgtcgaccatgctgctacacgacccagactacaagcaacattaccaacaaaccgtagaagcaattttaagtcgcaaattgcgttaattaattcataaccacaaaaaaggtaaggaattgaattcgtaaatgaattctagttccttacctttttaaatttcagctaattttaattttggctaaccgtcatacttcggtctacgcgggaacgaccggtcgtataatcaaaccgcactcccggttgaacgttccaaatgaaaacgttgaagttaaggctaccgtccgtcgaaattgcttccgaatggtagccgattggcatcaaatcgttgcctttaaataccgtagaaacccggtaaatcacccgtttgtttttcgccaaagcatcgcgtacccgttcttcaaaaatctgcatagtttgttggttactgaaggcggtctgcgtagctaagttcttggggttgtctaaggagcctaatttccgaggattgaagttaccattttggtcaaacttgccagttaccgaataggctaataagtggccccggttttgaatttcaacgctacgtccgttgattcgaacccgtttttgatgccaaccggtaggattccaagtttggctagtccgggtacttgattttactaaattagcccggcttaggtatccggttgcctgagtcgtccggttcaaacgatccaaattaccataatcaatccggttggtcttccaatctttcgggtttaacgtactccggttatggttgacatatatgtaagctggatcccctgatttaaacgttaattgcgacaactggctgtcagtcacgcttttcgtggtctgggtattttggggcattacttggttaagcaagttgttcgttacttgatgaacgtcgttaccttttagaaacatccccaaaatggccacaattaaaattaaccaccagttattagaacttcttcttttctttcgtttactcataattcccccattaattttaaaaacaaaaaaagttggggttggacaccttaatcttccagcctcaacttattttattaaattactttttggattactttctgagcttcaaggccagctcaatcgaacgatccaccagtactgattgggaatcaactactggataagaatggtcgtgcgccatttcttgagcgtaagaaagttccgtgcaacctaagataactacttgggcgccccgttcttccgtcattagccgtaaaatctggtagaacaattgggcatccactttattttgggccttaatatcttcaaaaattaacttgcttgttaagtcttgaatttcaggagttggcttaacaacttcgtagccttccgcaattaattcccgatcgtaaattccatccgtcgtggttcccggggtgccaataatgccaatccgtttagcagctggaaactcttttttaatttgcttaaccgtttcacgcggcatgtgcacgattggaatttcagtcgccttttgcaaatcatcataaaaataatgagccgtgttgcaagcaatcacaaaaaaggctggatttaaccggctctgttgttgaatatcttccaacaagtcgggatacgggttgggctgcgagtggtccattaaataagtggagcgatccggaaccgtagcatgattaactaaaatgtagtttaagtaatcttggtcccggtgcgccggcgtgcgggcgttcaacaaccggatgtagctttcggttgcgggcgtgcccattcccccaataattgtgaaaaagtccttcattccacttaccccttattttctttaaaatactttcggaaattcttgacgtagttatggttcatccaccaaattaaaagactgcgtttgaaattcatgtcttcgtcataaacggcggtaaatccgtattgatcgcggttaatcaaatcaagtgccgcctttttttcttcattatccttagcatatttcttgaagaccttaactggcacacctagccaaagtttccggttttcaatgacgtcgttagcataaaccggctccatatctgccaaagtgttgttaacataatcgtcaaccacccaacgggccaaattatatccatttaaggtaacaaagaagctactccgcccttggcgaatgttaatttcaaatagcttgaacttgccatcacggtggtcatacttcatatcaaagtttgcgtacccaacgtagtcaatactttccaagaattttttaacggtgtcgtaaatttcttggttaaattcgggcaaaatggccacgtaattaccaattgcggatggtgccgggtcttctagcaacggatgacctaaacacatcatctttacctggtgattttggtcaacgtaggcgttgagcacccgcatgttactatcgtcccccggaatgaaatcttgcaaaatcaaatcggaagtgtagccattgtcgtaaattttagcaatcacgtcgtctaactcggcttgggactgaatccggaaagctttcttccgcccttcaaaatgaatatccaaccattcaacactgtcggccggtttcaaagctactgggaaaccaaatggtgaagtgaacgtttcaccactttcgtattgggctttcgtgatgaacttggttgccgggtaaggcagattatattgatcacaaattgaataaaaacgttccttattgttcaactgtttcaatagatcgtaatcaatgtatgggcaaacaaaggtctgcgaaagttcttctttatgcttagaaattaattctgcgtaaccatcgcccattcctaataagattactttttcatccgaatcttggtactttttagcaattttccgcattgattcgataaataccggatcttcagaaaaaccaggaataatttcaacgttcacaatgttagtaaaccgggtcggtgctagcgtagcactagcgtaagcctgtacccgtctccccgtgatttcataaaaagcacgggccattccgtaggcgttaaagtcactccctaaaagaattggtgtaaagttgtttactggtctttccattaactaattccccttttcacttcttgtgcaacgcccatatccgttggccaaggcgtgtcaactccccgtactttttggtacggatcttcacccttcccagctaacacgacgatgtcatgagggccgctttctacaattgcttggcggattgcttcgcgccgatccagcacttggtgaacttcgaccgttccaggttcaatatgggccataatttgggcaatgatgtcttgtggatcttcaaatcccggatcatccgtcgttaagtaagctacgtcagcttgttcactaagggcttttccaaagccagcccggcgtgaaatccccttatcaccaggacttccaactaccacgatggcctttccgtcgtgatactggtgtttaacaaatttgagtaacgcccgtaagctcgcgtagttgtgcgcataatcaacgaaaacgacgccgtgtcctggaattgctaaatattccatccgtcctggaattacaatttcacttaacggttttaacgccgcgtcgcggtccgcacccgcaagtgcagccgcaataatggcggccgtcgcattactttggttataatccccagctacatttaagtcgtattctcccgtaattgctaaagccggcttggtggaactggtagccgcaattgtaaaccgattattaattaaatcatcttccgcatttttaatggtataatccaccccaccattggcaggatctgcactaaataagtaaatctgcttcggatccgtagtagcttttgcagctccatatacgtcctcaaagcgattagtatccgcatcaataatgcaccttttggagttcaccatcaactgtaatttgcagtgaaggtaatcttcaaaatccttatgctcattgcgcccaatgtgatccggtgtaatgttgagaaaaattccacaatcgtatttcaaaccataaacccggtcacgtaagtacgcttgtgacgatacttccatgacaaggtacttcatcccattatccacggcctgacgcatatcgtggaataaatccatcgattctggcgtcgttaagtctgacttgaactgatcctccggccgaggacctacaatccggtcaatggttgaaaacagcgccacttgttgcggatactgctggttcaaaattgcgtgggcaaagtacgctgaactagtcttccccttcgttccggtaatcccaatgataaacaagtcattttgcggaaattcgtagtaagtagccgaaagaaccgccatggctctcgtaacgttggttacaatgattgcagtcatgccggttccttcaggatattcgcgttccgctacgtacgtggtggccccagcttctcgagcggctttcaaatatgctggttcaaagtttcccttacaaaagaacatatctccaggtcttacttttcgtgaatcgtaggtaattcctgaattgacagtcgtcgttgatgattcaatttttttcaataggtgatgttccgcaagtacagttcttacggtacctaattctaacttcatctgctcatccccaactaactattcttgcgttttgtgtactaattccacggtcttcgcagtggtatcttctgggaagtaaacttcataccagaggatgaacgtgtaaatcgtgaagatcttttgcatgctggatttaccgttaacatgttcttctaagatgtgcattaatgcttctggtttgaagaacttcttcgcaacgtctgaattaaaggcttcttcgatccgcttacggtacttatcttccttaatccagttggcaattggggatgggaagccaagtttttccttctttgcaacccgttctggtagttcagcttcggctgctcgacgaagggaaaccttggtttcatccttgtgaatccgagtcttaattggcatggttgcggcaaacttagccacttcccggtcaactagcggagtccgaacttcgagcgagttcgccatactcatccggtcagccttatgcaagatatcaaatggtaaccaagtattgatatcgaagtattgcatttgggtcatttcgtctttaccgcgcacctcgtcaaagatgtgttgggtgtaggcacctgaatcaacgttgagttcaggtttagctaagatttcactacgttcttgttggttaaagacgtagttaacccggtagtagcgttcacttaatggttgtgccccccgcattaagaagcgccgaccgtggaaacgtggtaatcctgaaaccatcttagccaagcccgtccgaataaattgcggaactagtttttgatagcgttcgaaggtgaaagcttctaggtaagtgttgtaaccaccaaagaattcatcggcaccttccccagataaggcaaccttaacgttttcccgggttcccttggaaaggtagaacagttgcattgccgatgggttagatagtggttcatccatgtagtacatgatggttggtaagatatcgaagtaatcgtcgccatccatgtacaacggcgtattcttttggtgaatttccttcgcaaattcggtagagtagctcaattcactgtatttggaatctttaaaccctagcgagaacgattgaattggtttcaatttagcggcttccgctaaaacataacttgaatcaattccgctggaaaggaagcttcccacttctacgtcggcaatcatgtgggcatctaccgaatccttaacaatttgccgaatctttttcgcatcgtcttccaccgtttggttttcgtcaatgtgatcgtaattgaatttgaaataagtgtgcgtttccgtcttaccattcttgtgtaagaagtaagttcctggtagcaacttataaacgttgcggaacatggtttcttttgacggaatgaattcaaaacttaagtgaattggcaacaattcttcgttgaattcctttttaaagtttgggtgatccaaaaaggccttgatttcagaagcccataggaaagcatccccgtcatcatagtagtaaaggggtttgatcccaaaatgatcgcgcgcaccaaaaacttcttgcttttcagcatcataaattacaaaagcaaacattccgcggagcttttgtaaaagttcggggccccaagcatcgtaaccatggatcaatacttcggagtctacgtcggttttgaactcataacccaagtcctttagttcttgtcgaaccgtcttgtagttataaatttcgccgttaaaggtcaatactttagttttagtgttattttgcattggttgacgtccgtgggcgaggtcgataattgataaccgccgaaaacccatcgaaacgtgttcatcttgaaaataagcttcatcatccggaccacggtgtttgatccggtccgccattgatttaattgtgtctttattgacattagtttggttaacgtacccaacaaatccgcacattttgcaatccccttttattcttcaatctgtctatgtacttatttccctgtttttacatacacttaatttaaaaatgcccgcatatgggcgaaatatcatgttttcatcatattccagtaatatataacattttagcaaaaattgcataccaatactactatcgttaacttttcttaaccgactgcccggctttctccggcactttctttgtcgcttgaatttttagtcaaaaaaaataaagtgctttagccagcttctacatcgaccaaaacactttaatttaaattattttgcacaaattttgtacatccgtcactttaacacctaccaataaggcttatctatgcccggaacaagattcgaacttgcacatagttgcctatacagcgacctgaacgctgcgcgtctgccaattccgccatccgggcttaacaaattaattttacactaaacaactataaaagtgaataactgatttaaatcaatgagggattatcatttaataagttttaaattattttcaacgtgtatatcattaacagttccaatcacttttcatgtataatacaaataagcaaaaaaataaggtaggtaattgcttatgggggaaatccatcttaactgcattgtccgttgccggtgttccacggacttaaagcagccttttgtggggaaagttatcaaaatggatgacgatgaggccgttgtaacgatccttgaatatgatccttgcgaacgctatgtggcgtacgaaatcaactacactactcgggtaaagccgtgtgatttacgccccgtgtccattaaagtacaccgctcgaagtcaaactaaatttgactcttgcaaaattaaaaagtgaggcccatttcgttctttacgaaatcacctcactttttaacattttatcgggtttattacttttacgagtagtcaccaatcaattaactgttacttatcaattactactaccgtcccgtaagcatgtaccaccaaaaatttaggtgcaccgtttagttccaccacttcactgttatactttaagccaatgatgccatcgccaccactcaactccgcttttttcttaattttctccttggattcgtcaaacaattgatcaaacatgttgtacttatcaatatcttctgaagacagcatcaaactagccgttgcttcaaccacgtctttaattgtgtaaccagcattgatacctgttgtggtaataaacattatggttcctcccgttttttcgcagcttcctttttttgctcttccacaaattttttcattcgtaatctaacttcgattatggtggtagtaatcattgaaaataagaatccaactacccaactaataaccagtggtgcgccacttaaatgaaaaaactcggttgcaacaactaaaattaccgccaccgctaacggcaacgtaattcttaatgacttcatttttttctctccttgcgttgtttaccatcggttagatgcttggaaaagtattgtacataccaggataaaattatcccgacaatcacaatgataattaatttgttcgtttggctcaaatcagataaccaagttaagaccatgattatcgttgacagaatcaacaaaatcaaagaagttcgataatacgtttttttcggcattttaatcccccaaaataaattgatgaatggcttccgcaactccgctagtgaaatcaccttgggtaacgtgcttagccacccggcgagcatccgcagtagcattcgccaccacaactggcaaacctacctggcttagcatggcgatgtcgttgttattatcccctaaagccatgatttcatctttttgaattcctaaccgttttgctaatgctaaggtagcctttcccttgtctacgcccccaaggttaaattctgtatatcgatttgaagaaaaggtggcgttcaaatcaaagtctacctggcctaacacttccttacggattgcttcccgcttttttggatcgtggttcatcgtaataattttaacgatgggttggcccgccaacggttctaacgttttgtacgggtactcctcaaccttaacgcctcgcccggtcatgtacgcagtatcctcaggatcgggattgtatacgtaaacgtggttcaaagtgtaaatgtgggtagcgtagtctaaccgttgtttgaccacgtcaaaaatttgagttgcctgagttgccgacaatgcgttaacttgaagtactcggcaatctttattttccacaatcgctccgccattataagaaattacgtattcgtccggttgatcgcgcaatcccaattgctctagtaatggctgaactgattgaaatccgcgtcccgtgttaggcacaaattttactcctaatgcagtagcttttttgattgcttgaatattaacctctgaaacgccagtggggcccactaacgtttcgtctaaatcactaacgactaattttatcatagtttatccttcaatccattcgtttactttagacgcataagcatctaaataatattatttttggttttgtagtgccgccttgtcagctaattttagtcggcagatctaagttagctgagttgtttgggtctggctcttgaatgcttaacctaaacgggctcctgaacccaatctcttccggctaacctaattgcgtgatcaatcgccaagagcgcgattaatcacgcaattctgttagtcctcaaagattacccgggttcactcgccctctccatcatatcccaccttggtagcgcttttcaaacctttctttaatggtcgacggggtttattttttacccggatcaaaaccagcaagcagtttttttatcaaaattcaaggttgttttgccccgaaattctttatacaatatgttgtggctatctggaaatttaggaatatttagtactagatttcggcggcaaaaaacaaaaagaggggcattttatggtgataattacagcaggaatgatcggcgttggtaagactactttgacgggaaaaattgctgaatattacgggacacaggctttttatgaaccggttggcgataatccagttttaccgctctattattcagacccaaaaagttacggatttctactccaaatttactttttgaacaaacgttttcaaatgattaagaaggcgttggctgatgacaataacgtcttggatcgctcaatttacgaagacgccttgtttactcgcgaaaataacaaggaaggtaacattaccgacactgaattcgaagtctatatgaaccttcttgataacatgatgaacgagttgcaagagctccctaaaaaagcacccgatttaatggtctatgcagaaaccgactttgacaccatcctctaccggatccgtaagcgcggtcgtgactacgaacaattcgacaataatccagaattagagtcttactactacaaaatgtggtcagcttataaagaatggtatgaagaatacgatgcaagtcctaagatgaagattgatttacaaaaatatgatttatcaaacgacgacaacaccaaaatcattctcagtcaaatcgaccgtaagctaaaagaaatccgggttgaggaacctgttcataaggcaatttagtttaagtaaccatcttaatgtataccattattacgtaaaacattttattcagttactaaccaaatttccatcaaaagctagaaaggcatctaaactaatttagagcgcttttctagcttttatttttacttccaagcatgtgaaataattcctataccatttcgcaatcacttattgtaaacgctaccaaatgtgcttataatttagttgtactaaaatcaaaggaggaatcaccatgtctaaaccacgcacccgctggtacactaccgttagcatagtcgttatgtttctgttttccctcaccgtcacttcggccaaggcccaatccaaccccgccgatctagacggtcaatctgccaccaccattaccaaacaactcaaaaatcaccaatacgatgagcaaacgttaatgcagtatacatatcaaaaaattaaccagcaaaatcccagtctcaataacgtcatttaccaaaatccttccgacgcactaaaacaactgcattccctacaaaaaactgatcgacaacagcctttttacggcgtcccgcttttaattaaggggttgggacaagcatatcaaggttatcccaacaccaatggactgcctttcttaaaaaaggaaacttatcccaccaccaaagtattcgtcaaaaaattacaaaaaatgggtttcgtgatccttggagaaactaattatccagaaatgggcttaattaacatcaccaattctaatttaaacggggtcgcccacaacccgtggaatttactatttaataccggcggttcttccggtggtgcaacggcaagcgtagccgctaacgaagttccgattgcgactggaaacgatgccggtggctctctacgaattccagcttcctggtcgggtgtaattggtttgaaacccactcaaggattgatcgttggtgactcaaccactccttcagtcgttaactttgcggacactcgggatatcaccgatacccaaacccttttaaagggactcacgaatcccaaacaagcccaaatgttacaaaaagttcctaagaatttgaaagatttaacaattgcctactcactaaaatctccggtaggaactccggttagtcaagacgctatcaatgcggtacaacaatcggtcaatttcttacggcaacaaggatttaaagtcgtccaaaaagatagtccggttgacggagtaaaaatgatgcagacctactatttaggcgcacttgaagacggagccaacgccagtgaaaaattaggccgaccactgactagccaagatgttaaggataagctcgtcagtcccatgacttacgccctttacgaagcaagccagaaagctcctaagtctactaccaatactttcataaaggaattagctctcgttcatcgccaaatgactgcgttccacaagcagtatccaatttacttaactccaacaacggccaccactgcgccactgaatagcgatccagcttaccttcctaagtacgttgatcaaatgatgaatattaaagatctgcccttccagcaacaaatgcagttgatttacgattcctggctccatggcttaactaagacgccgtttactcaattagctaaccttgctggggaacccgcactcagtttgccaacctacgtgagcccgtccggtttaccattaggtgtgcagttacaaggcagccaaggcagtgatgccacgttgcttgcaattgggaagatttttgaaacggaacatcaatttaaattcttaaacgctaactacccaactagtgatgcgtcatcacaacaaaccaccaccactactaaatcttccaatgctaactcactgaaacagctacctcaaaccgatgagacctcagtagattggccaatctacgtggggctgattctattagggagtggaattatggttggctaccggatttaccgtccccgtcgttaagttgatttttaaaattgaattttaatggcttagcagcgaaattaatgttcgctgctttttgctatgtatagggtatttaacattcttaatttcaatatctatcgtgatttaaagcatactaaaaagcaacggcggaaaatcgcttttccatcccctgctttaataatttacttaattattttttacaatgaccacgtctggtgcagcattttccactacgtagctagcagtagaacccaagattacttgagcaaccgtgcccatccccgtagcacctaacacgatcaaatcaacgtcatattctttaggtagcgtgtaacttaacattgatttaggactcccctgtttaaagaccacttcaatgtcttctgcaggcaacccctgttgttgggcatcttgctttaatttttcgagggtggttttccattgacctaacgtatcttgtaaatcaattcctgtttcaataacgccaaagcctaatgaaacacttgcggtgttagcatgttgctttttcatcacacttgcaataatcagttttgcatggtttgacttagcaatctccaccgctcgattaaatgcagccattgattctggagagccatcgtagccgaataaaattttcttataatccataatacacaccaacctttcaaagtctattataccaatttagcgctttcagcatagttttttatttgagttttcccgaattatttattaaagactttgcgttatactaaaaccacgaggtgaacaaaatgcttaaaatcagtcgacaaactttaaaaagccactggcccgtgcgccaaaaacagagccataagggcacttatggtcatttattattaattgctggaaatgcacaatacggcggggcgggaattttagccgcctccgctgccgtttacgctgggggcggtttagtaaccttagcaaccgctaaaaataattttaccgcggtccgcgcaactttagcagaaatcatgttgatcgattttaccgactttgatcaacttagccaatccttagcaaacgcaactggcgtcgtgattggtcctggtttgggcactgattctactagtctggccgtccttaatttcaccctggcccatattgccgaaggagtaccgttaattattgacggatcggcaatcgatttagtagcccaacacgatttgcaagtttcccaccacccgacaatttacacgcctcaccaaatggaatggcaacgcctatcgggaattaaaatcgcggaccagtcggtggagcgaaaccaagccgtggtagatcaattaaacgccaccgtcgttttaaagcattaccacaccgaaatttacgcgcccgccgcgccggttgcccaaataatggctggcaaccccgggatggcaactgggggctcgggcgattccttaaccggtattttgcttgccttaattgctcaagctaactcggtaaatgaaggggttcgcttgggaactttcttgcatagttatacggcggacctcatttacgaacatgaagcagtcgtgctaccccatcggttaattcgccggctacctgccgttttaaaacagctaacccaaccataagttttgctaaataaaaataccagtggttaggaatctctacgcaccctttccaacaattttctcaattagttggttttgcgtttcgtacctaaccactggtattttattattctgtttttaatttttcaatttcttcatcgcttagttcccgataggttcccggtagcaagccttcttctaactgtagcggtccaaaactaattcgttttaggctaacaacccgctcgccaagactgccaaacattcgccgtacctgatgatacttaccttccttcaaggtcacgtgaacgagggtttgctcatccagcgcggaataatttaggatggtcaggtcggctggctttaattgggtaccatctttcaaaaccattccatcggcaaactgcttaactgccggatcggtaatttggccggtcaccacggcttcgtacgtcttttgaacgtgccgttcgggcgctaacagttggtgggctaaggggccgttgttggtaatcaataataacccttcggtatccttatcaaggcggcctactgggaagagatccttccgaaaatcaactttattaaataaatccatcaccgtcttttgcttgcggtcttccgtggcagtcaccacaccaaggggtttattcatcataaagtagaagtactgctgataagtaatcacctgttctcccaaacgaacttggtcaaccacagggtcaaccttcacccgtccagatttagccaccacgtcattaacaaaaacggccttttccttaattaatttccgaatctgacttcgagtacctacattcatatcgtgcaaaaacttatcaactcgcacaggatcccccctacttaattttaagcattcttcgtaagcccgcagcacgtccgccgataatttcatcagctaagcgacttttaaggacacaaactacgtaaaagagcccgcctaacgtagccgccactaaaatcacgatcagtgcttgaaccttattagccggattcatcactagatacaacccgttggtcactacaaacgcaatgaaaaaggtcccaaaagaataagtaataattttcccgataaagccattgatcttatcataatctaacccgtattcacggttaatatggcgtaagattaaccagttaactacggcaaatccaattgcggttgaaattagcgaacccactgccgagaaaatggctaccatcggaaattggaaaataaatttaacgatcattcccaccacaaaatacttcacagctaggacgttttcgccaattccttgcatcacggcagaaattaccgtaaacaatcccaagacgattgccacgtaggagttgaactgcaaaattgcggtacccacgtcgctgagatggtaaaacaaagtgtaggccggttgggcaactgctgccatccctaaggcggacggaatcattaaaaaggaaaatagtaaaattgagtccgccacttgtcggctaatttccgcccggtccccccgggtcttggcttccgataaaatcggcactgacgtaaccgctagtgcagatgccaacgaaattacaatcattactaatttgttagcgttaaaggcgaaaatcgcaaacatattatttaaaacggtggccgaataatcactgaccgaccgcataatccgaaagaaagtgtattggtcaatcaactgaaaaattgtgattgctgaaccaataataataaacggaactgcttgcgcgataatttctttgtataaactagttgtcgatatcgccaggccgttcacactatgttgggataaataccttagccgcctgcgatacttaacaaagtacccaatcaacaccagcaaaccgcccaaggcaccaataaaggcggcaaacgtggattgggccactccataaacccagtcaccatggtttttgtacataattaagtacgcagttaccaacatataggccacccgcgctagttgctcaataaattgagaaaccgccgacggccccatttcttggtatccctggaaaaatccccgggttaaactcatcgtgggaattaccaaaacggcccaagctaaggcgtggagcacggtagttacgtttggatccccgtcgtttaaaaagggtgctccaaagaacaaaattgccgcacaaactacccccgttcctaccgatagtagtaacccccgcttatacaaacgctgacctaacgcaaactcgttaatggcgttatagtgggcgacctgtttggaaattgcggatgggattccggcaattgccgcgatcaaaaagaagctatagatattatagcccttggtatacagggcgtttgcttgatcactataaactccaaaccaaattacccacgggataatataaatcgcacctaaaattcgcgaaaaaatactgcccgctgtcatccaagccgacccttccagcatcttagctttggaagaagaattaccactattctcccttaacggttgcgagcctaagtattgtgattccgcggtatcaaattcagatggtttatccattttaaaacctactttcactagtcaatctatattattttaatacacttagcgacccccgacaattaaatttcaaagacaattaccttttgaataggaatacaaatcgatcatagatttgaaaactagtttttctttaatcgccagactttttaaaaagacttttcaactaaaaaggggttagaatccaccctgaattctaacccctaatttagtttttaaccacgtcacaaatatagcttcgtttcacaataaactttattttgcaacgatgttaacgatcttattcgggatgacgatcacctttttgatgtctttttccgcagtccattgttggatgcgttcatccgctaaagcaattttttctaattcagcttggtcaaggtccttttcaacctctaccttactccgtacttttccgttaacttgtagaatcacttgcacggtgtcttgtactaacttactttcatcgtaagttggccatgcttcgtaagtgatcgtttcgtcatgacccatgatttgccaaatttcttcggcaacgtgtggaacgattggcgaaagcaacttcacaaggccttccatgtataccattggtaatgcgtccgccttgtacgcttcgttaacaaagaccatcatttgcgaaatggcagtattaaagcgcatgttttcgtagtcttccgtaaccttcttaaccgtttggttgtaaatcaagtctaacttgtggtcgttaatcatcgtgatccggtctcgcaaatgattattatcgtcaatcattagccgccaaacccgctcgatccacttccgactaccattcaagccttcttcactccaagccacggattcggtcaacggacccatgaacatttcgtagagccggagagtatctgcaccaaaccgttctacgatgtcatccgggttaaccacgttgcctttggacttagacattttttcgtggttgcttcccaggatcatcccttggttgactagtttttggaacggttccttagttggcactactccaagatcataaagaaccttgtgccagaaccgcgcgtatagcaagtgaagcaccgcgtgttctgcaccaccaacgtacaagtctaccggtaaccattccttgagtaaatcttcgtcggcaatcttgttttgattcttaggatccacgtagcgtaagaagtaccaggaacttcctgcccattgtggcatggtgttggtttcccgccggcctttccgtccattttcgtcaaccacgttcaaccaatcctctaagttagcgagtggactttcacccgtaccagaaggtttgatattgtccgtagcaggtaaccgtaacggaagttcatcttcaggaactagcgtagtttcgccgtcttcccaatgaattaccgggattggttcgccccagtagcgttgacgagagaagacccagtcgcgcaaccggtagttaacctttttatgaccagctccgtgttcttctaaccaatccaacattttatcgatagcttcttgcttgtttaaaccatctaagaaaccagaattaatgtgtgggccatcgccggtataagcttcttcatcaaggttaccgccgccgataactggcacaatgtcaatcttgaactttctagcgaattcgtaatcacgaggatcgtgagctggaaccgccatcaccgctccggtaccgtacgaagccaatacgtaatccgcaatccaaattggaattttctttccgttaacggggttaactgcgtaactaccagtgaagactccggtcttgtccttattcaaatcggtccgttccaagtctgacttagtcgcgaccgcttgcttgtattcttcaaccgctgccttgctttcaagggtggtcaattggtcaactagcggatgttctggcgaaataactaagtacgttgccccatacaaagtgtcggcacgggtggtaaaaatttcgatcttttggtcactgtcttccacatcaaagaaaacgctggccccaatcgaacgaccaatccaattcttttgcatttccttaatgctgtcaggccaatctactaaatctaagtcatcgatcaaccggtctgcgtaagcagtgatttttaagatccattgtttcattggcttccggtaaactgggaaaccaccgcgttcagtctttccgttcaccacttcttcgttagccacaaccgtaccacccattaagtcgggcgcccagttaaccaacgtttctttttcgtaagccaacccctttttgtagagttgttcaaaaatccattgggtccacttgtaatattcgggatcggtcgtgttaacttcccgtgaccaatcgtatgaaaaacctagggactggatttgacgtttaaagttcttaatattgtgcgcagtaaagtccttcgggttgttccccgtcttcattgcgtattgttcggcaggtaatccaaaggcatcccaccccattggatgtaataccttgtatccttgcatccgcttcatccgggacataatatctgtcgcagtatagccttcaggatggcccacgtgcagtccttgcccagatgggtatgggaacatatctaaagcatagtacttcggcttttgttcactttcaaccgttttaaaagtctcgtgtttttgccaatagcgttgccacttaggttcaatttctttatgattgtaagccatattttcctccattaattatttactggttgcttccggattaatttaaccgtgcttggtagccattgctagatgaattggcgaattttttaaaataaaaaagcctaaagactctcaaaaagaatctttaggacgaaaatttccgcggtaccacctagttttgctaacgcacactcaaatccataacgcggaacacgccatcccctacttaaagttcaaggacagatttacaaagacgagttcactaaagttactccggattcgcaccaaccatccgttctctgacagtaaacttttagctactacttctttaaccagtaatatttagatagcattatcataacagtaaccaccaacgattacaactagatatggtaaaattaatcttaattgttaaaggagaatgaaatgcgatttaaaaagtttggttggttaattttaaactggttacccctgctaggactgctgaccttagttatctcggtcagtaaccgttggaattgggtacatacatacgaccgttatctacaaaaaatcattcacggctggcaaagtccggggctaaccccgctggtcaaaatttatacccaattggggaacgcaaagcccttcatttttatcagcatcgtgatcttaggaatgctgctatggcggggatatgaccgcttagccgccttcttccttgcaaacgtggtgctcggcaacgcgatcaaccacctgattaagctttggattcggcgtccccgcccacattttcgtttaatcacgattggggggtacagttttcccagcgggcattcagtggcggcaatgctgctatttggcagtttaattttcatcactacccaaacggtccgctcccataaatggcggattagctggatcttaacctgcataatcctgatgctccttctgggattatcacgcgtctacctaaacgtccactatcccagcgacgttacggctggactactactgggtttggtaatcttgcaaaccacccactggatattttatcgaaagaaggaatcccaacatgcttgataacgcaatgcagtacagccaccggttgttggcagaggtcgtacaacctggtgaccacgttgttgacgcaaccatgggcaacggtcacgacacccttttcttggccaatttagtacaatcacaaggacgagtgttcagttttgacatccaagcagcggccttatccgcgacggaagcacggttagaaaagcagttgcctgatcaccaacacgtgcaactaatccaagatagtcacgaccaattagcacaatacgtggataccccgatttccggtgccgtttttaacctcggctacctgcctggtggtaacaagcaaatcatcacccattcggcgtctaccattgcggcagtacaacaatgcctgcaactattaaaagttggtggtcgggtcgttctagtttgttattacggccatcccggaggtgccgctgaattagctaaattgcttgagtttactgcaaatttagatcaacaccaatttacctgtttacgctacgaattcattaaccaagtccatcaaccgccaatcctattggcaattgaacgtcgaaaataattctttatataaaaatgggaaagcatcccttctgcaactttaatatcgttgctagaagtggaggactttcccatttttgttatttatttttttgagtacgcggccgactaaacgcattaattacgattgcaacaataatcaaaatgaaaccgcaaatgtagatattgtgtaacgcgctgtataaaatgtcgcgcaacgtcggtaataaatcagccggtagctgtttagcagtttgtggattaattacctgattcatcatcgtcatgttaatccgaggatggtgggcaatgcccatgttgatcgtgccgttcataatgatgccaaatacagacatcatgatggtctgacccaacgtttttgccaaggtattaaacgaggtcgccaccccgattcgatccttcgaaactagttgctgggagattaccaaagtcgatgtaatcgtaatcccaaacccaactcctaaaatggctgcgataaagaagaaggcgacgaacggtgtcgaagcaggaattactgctaataagaagcttccgattgctaagatagttaagctgattcgcaaaatttggttagcctttagtttaactagcatcttgccagctaaaaaggaaccaaagatccataacacggagctaggcgttaccgcaaatccagctaacgaagcgggtaatcccaaaatcccctgcgtccaagttggtaaatagacttcgaacccaatcaacaatcccgatactagcatggtcgcaacgttttgaataacaaacgtccggtcgttgaacaagtcgaggaaaataatcggatcttccgcacgtcgttcctgccgaataaagagcgcgccggccaccacaaagatgataaatgacaatcccaaaattaatttagaagcggtgctttctcctaacaactggaagccgtacattaagcccaatagtgacaacattagccatacgctgccccaatagtcgatctttttgcggtgaacgctaacttcttctttcaggtaaagctggattaggataattgtaataatcccaattggcacgttaataaagaaaatccagtgccaactaaggttatcaacgataaagccccctaatagcggagcaatgattgaggcaattccccaagcagaaccgttaagtcccattaccttcgcgcgcttttccaaagaataaatatccgcgataatcgtgttggaaactggcataattgaaccggccccaattccctgtaaagctcgccaaataattagcgtagtcatcgagtgggctaacccacttaacattgaaccgattaaaaaaatgataatcccaattataaaaacgcgtttgcgtccaaaaatatcagataatttcccgtagatgggggtaaaaattgcgttcgtcaataagaagattgaaattacccaattcatcaaattaactccgtgcaagtcccccacaatggttggcatcgcggttgaaacgatcgttccttcaattgccgacataaaggtggcaacgaaaatcgcaaccgtgaccaacgcaacgtttgtttgctttttcttcatcataacctcacgtttaaaatgttcatttttatttatagtaataatataaaacaaggctgggaaaaattcccagcctctccacaaatttttgtgcacccttttaaacgattactttaaagaaacgccattttaaagtccgtgatgcaccgggttttttcccgtttaaattattgatttatttttggaaaaatgcttttaactcagcaaccttatcagtcttttcccatggaagatccacgtcggtccgcccaaaatgaccgtaagcagccgtttgcttataaattggccgttttaagtcaagcatttcaataatgccggctggacgaaggtcgaagatttgccgtactgccttagtaagggcttcttcagaaactttaccagttccaaacgtgtccaccattactgaaacaggttcagcaaccccgatggcgtaagcaatttgaacttccgccttcttagctaagccagctgccacaatatttttagcaatgtaacgagcagcgtaacttgcagaacggtctaccttggttgcgtcctttccagagaaagcgcccccgccatggtgagctgccccaccataggtatcaacgatgattttacgaccggttaatccggcgtctccttggggaccaccaattacgaagcggccggtagggttaatatagaagttagtcttttcatcgagcagttcagctggaataacttccttaataattttttcgataacgtctttgcgaatttgctctaaagttacgtcaggatcgtgttgggtacttaacacgaccgtgtcaacccgcactggttggtcattgtcgtcgtattcaacggtaacttcggccttggcatcgggacgaagataactaatgacctgttctttacgtaacttagcaatccgttgcatcaaatgatggctaagcatgattggcaacggcattaattccttagtttcgtcagtagcgtaaccaaacatgagtccttggtcaccggcaccaatccggttaagccggtcttcgtgtccttcgcgtgtttcaagcgaatcgtccaccccttgggcaatatctggcgattgttcatcaatggcaacgattaccgcacagttttcgccgtcaaagccatattcgccaccaacgtagccaatgtccttaatcgttttccgaacgaccttttggatatcaatgtaagcagtcgtggagatttcaccaaccaccactaccaaacccgtggttacggtcgtttcacaagcaacccgagcatctggatcatttttcaatagttcgtctaaaattgcatcactaatttgatccgcaattttatctggatgtccttcagaaacggattctgaagtaaataaatgtctttctgacatgttaattccccctaaattaatttcggttacaaggatcttttggatatcgaatcctatcgggaacactagtaacttattaagtttagcataatcattctttcttttaaagttaggttgacgcttcatctagttttggatacgattaaacacagagaagataaggagtttttcatgaataagataaaaatacctaaaattaattatcacgttgaccggaaaagctatttaccagcgattttggcggttatcctaaccagcaccatttggtattttagcggtcattttagttcggagcctttcaaacataatttaacggtccaaatcatctttttcttagcaagctttatggctaatttcattacttttgaccaattaacgaataaaaccaatttacgactaattgctccactggccgtaattccagttgcgttctttatcattttattagtcagtaaggagcgttacgtttctcttctagggttgctaactttggtaccgtttgtctccgtttttttaccttttcaaggcaaaaatggcgtaggactaattagttttgcgtttagcattagcgttttaagtccgattgcctttttctatattcgtaacgcatttgttagcagcatgtttttgaaaacttgcttattattgtgcttagtttttttgatgattctattctctgttttcgtggcacatcccgaacagtttatctatcttgaaattgggctgctggtggtcatcaccattttcggctttgtactatttaaacaatggagcgcggtactttatccaatgattggcatattgggttggtatcttccccgggttaagcttccccgcaattttattttgctagttttaatcattttaatctgtgtcacctttttatttacggccggtcattaattaattagccattagtaatcagtattctggttgctaatggttttttattgtttaagataacttgtttatgtgaaaggctcaccttcctatataaagtattgcaacgtgcaattgatagatatagtaaagcagctgggattaatcgccgtgttttcgattattaatcctagttctttcatatctcacttggaacttttctacaatacaaaaaagccatccgtttaataaacgaatggcttttgcttaagtctctttcaaagacggtcctaacgagactcgaactcgtgatctcctgcgtgacaggcaggcgtcctaaccaactagaccataggaccaattaattgcgggagcaggatttgaacctacgaccttcgggttatgagcccgacgagctaccagactgctccatcccgcgataatattaatataaatatgacaaaaaatgacccgtacgggattcgaacccatgttactgccgtgaaagggcagtgtcttaaccacttgaccaacgggtcatacttataataagaactaacggagaaggagggattcgaaccctcgcgccgcttgcgcgacctacacccttagcaggggcgcctcttcagccacttgagtacttctccaaatgggcctaaatggactcgaaccatcgacctcacgcttatcaggcgtgcgctctaaccagctgagctataggcccatacttaaagcgggtgacgagaatcgaactcgcgacaacagcttggaaggctgtggttttaccactaaactacacccgcaaaataaatattgaattttcaatggcgcgggacagaatcgaactgccgacacatggagcttcaatccattgctctaccgactgagctaccgagccattacggtcctaacgagactcgaactcgtgatctcctgcgtgacaggcaggcgtcctaaccaactagaccataggaccataattgcgggagcaggatttgaacctacgaccttcgggttatgagcccgacgagctaccagactgctccatcccgcgataattaaaaaggaggatgagagattcgaactctcgcgtggtttgacccacctgacggttttcaagaccgttcccttcagccagacttgggtaatcctccataatacaaatatacgtttcactgcccttactaacaaaaatgctagatggaccttgtaggactcgaacctacgaccgaacggttatgagccgtttgctctaaccaactgagctaaaggtccaagttcgtatattaaccctatcgcggcggaggggatcgaacccccgacctcccgggtatgaaccggacgctctagccagctgagctacaccgcgatctatttaattaataaatgtttatcaacatttaatcgggaagacaggattcgaacctgcgaccccctggtcccaaaccaggtgctctaccaagctgagctacttcccgtttaaaacaatgcacccagtaggagtcgaacctacaaccttctgattcgtagtcagacactctatccagttgcgctatgggtgcaatacaaatgccgaggaccgggatcgaaccggtacggtcatcactgaccgcaggattttaagtcctgtgcgtctgccaattccgccaccccggcattttataaaagtagtaaatacttactacgaagcggaagacgggattcgaacccgcgacccccaccatggcaaggtgatgttctaccactgaactacttccgcatgatcgatatgccgactagaggattcgaacctccgaccctctgtttacaagacagatgctctgccaactgagctaagtcggcattacctttatataatgccatatattcaattatatgtcacagcacttttagtgctatgagccgtgacaggctcgaactgtcgaccctctgattaaaagtcagatgctctaccaactgagctaacggctcaagataatggaggatacagggctcgaacctgtgacctcctgcttgtaaggcagatgctctcccaactgagctaatcctccataattagcatggcaacgtcctaccctcgcagggggcgatcccccaactactcttggcgttaagaagcttgacttctgtgttcgacatgggaacaggtatatccttctcactatcgtcaccacactccactaacaatcgaatttgttggctttactggggaacggtggccggcaagtcaaaagctgattcaacgaaagcgggtgccacttgaataaccaagaatttgacttagacacggctaagcgtttttttgaacatgattatcatgaccggggcatgatgaaatggcagggcttctatttatccgatcatactgccgctttaaaccaacagaaccagtagttgaatgaaatatacgttccacgaccgcaacaatccttagcagtaattaccgaggtattggcggacgcatatcagcgtcagcaaccagtgaccattcaattaaaaacggttgaccaaaacaaccgtcattggccagatatcaccaccttgattcatggttacaatgccaatgatattgtggttgatgctgatcggtttatcccactacaagaaattcgaaatgtttcaacataaaaggacggaacggttacttaataattaaccttccgtttttttgatgcttgtctatttggctttatttgtatcctagctatattaaattatgaagcctaaatgctaatctgttcgcgtataataaactagtgagtaatttaaaggtgggggaaggaatgtttttatgttggaactgtcatttgaaaaagaagttgttaaaaccttaacgaccggaagtaatcaatgggtggaacgaaaagacctgtatggtgcgacgccggatcaattatgggctaattttcgtgataaattaaataacaataactatgctaaattgcagggacaccctttaactgataccgaatttaatcaggttaaacgggcgattgaggtccggacaccttacgaagcagctaagttactagccgccgaaaatggcattggcaaagttgaagttgaacgtgatgatgctaagctgggcacggtgacgctcgagttgttttggaaagcggacgttgctggcggtaaatctagttatgaagtggtacggcaagcagtgcgaccacggttagctggtactcaagatgtcgatcctgatcgccgttttgacgtaaccctattgattaatgggttacccttaattcaattggaactaaaaaaagccacggtcgaacttaaccaggcttttaatcaaattgaaaaatatgcgcaggaaggtaaatatacggggatttactcgctgctgcaaatgtttgtgattatgacgccggatagtacggcgtattttgcgaatgccgaaccggatcatttcaataaagcctttttgttcaattggcgaacgcgggataatcaccccgtggaaaacggcttagcgttcacgcgccaagttcttaatattcccatggctcacaaaatggtcagtgaatatacggtcatcgaccaagagcggcaaagcctaattctcttacggccttaccagatttatgcgattgaagccgtgatgcaccggattcacgaccatcaagatggttttgtttggcataccacgggttctggtaaaacactcacctcatataaaaccgctaaattagctgcgcaagatcccggtgtcgataaggtcatcttcttagttgaccggcgggatttagacgaacagacaaccagcaactttagtgcctatgccgccaatgatgatattgccattaacgaagcccaaaacaccggtgatttaatgcgtaaattgcaacaaaatgacggtaaggtcttggtcacctcgattcaaaaacttcatcgggcggtcaaaaaaacgcaagcccagctggcaaccggtaagcaatctcgctttagtaaaactttaaagcaacgggtgatcttctttgttgatgaagcccaccggtcgcaatttggtaagatgcaaaaggaaatccgcgcagcgtttgtcaatagtaactggtatggttacactggtactcccatctttaatgaaaataagaaacagctcaagggtgatctagcggttacgacggaggagctatttggtaaagtctgtcacgtttataacttgcgagatgccttagaggaccaagccgtgttaccgtttaacgtcgaacatgtaacaacaattggcaaagatacgttaataacccgggccctcgaaaaagaaacccagcgcgtcaaagcgcgtcgtgataagcaaggccgcctgctaagtacggctgatgaagcgaaaattcgagccaagattcaagcgatgtcagtcaaggacttggaagaaacgtatttaactccggctgactttgagaccgatgagcatattaatcaagttgttcaatatattttacaaaaaggcccacgtaaaacgagtttgggtcatggcaactataatgctattttgaccaccagttccattgaaatggcgcaacgctattatcaagcctttaaagccgcgaaaaagactactcacaatcagctagatcctgattggccccgaattgcgattacttattcattaagtgaaaacgaagatcagagtgcgcaaaaacatgaccaaatggccaccattttaaaggattataatcagcagtatcacactaattttgatttagccgatttgaatctctacaacgaagatgtcgcaaaacgggccgcccggcgtgaggcggtctttgctcatttgaaacccgatcaagaaataaatttagtgattgtggttcggcgattattaacgggatttgatgcccctcggctaaacacgctctttgttgaccgcaccttagcttatcaagaactcattcaagcttactcacgcactaaccggctccaaaaccgggaattaaaacaagaaggccaaattgtgacctttcgggtaccggcaatcatggaagctaatgaacgtgaagcttacaagttatatagtggcgaaggctcttttaatgtcatcattcgtcccacttatcagcaggctgtcttaaaatttcaaaaggctgtggtcgatttaaaaaccattgccccgacgccgacggcggccgatgacctgaaaggaaccactgctaaggtacagtttgtgaaagcctttcgccaagtgaatcagcaattgaattccttatccatgtacaacgatttcacttggaaaaatagtgaaaaggcttttggtattgctcagcccgaagtagaatcctatacgggtaaatatctgcggattaaagcggcggttactaaccaagatcctgatatagtccccgaagaattagctgccttagacttttccttagccgttggttcagtcgtcttggtggattatgattatttgacgcaattaattcaagattggattgatgaacagcaacagtacacgacacctgatcaagcccaagcccatatgacagattacctgcaaaatagtgccaaagtacaggctagtttgaataaattagcggaaacgcaaccgcaacaggcccagttaattcgcgaagccatgccttatattgagcaacaaatgcaacagtctcagcaacagagcaccccaaatcaagcgccagtagcgttgaatgctcgggagttagtggctgattacgcccagaaacaattggtcaaaaaaacgacgacctttgcccatacgtggggcttagatcaagcagccctattacgggtggcacgtgaacacaccgtgggtactgatgaatggcatcatgaacaagaattaacgcagtcagcgaatttagcagcggccttacaagctcaaactgccgctgggccgaagattccagctattttgccactataccggattaagtcccaggccgcttggcggcagtttattgaacacgatttagcaatttatctacaaaaataagtgaggttaaacaatgtcagaaaaaacaactcaaactagtcaacttgaaagcgccctatggaatgcggccgatgtcttacgcgggaaaatggacgcttctgaatataaaaattatttattggggttaattttttatcggtttctatctgagaaaaccttaacgacctttagtgattggtcaggcgaaaccgaaaatgtcacccggaaatatgctcagtatatggatcctcagtttgaattggaaggcgtctcggtgcagcccagtttagtggagtatttgcaaaacacgctcggctatttaattcaaccacaagcgttgtacaccaccctgattggcaagattcaagcccatacttttgcgttagacgatttatctcaagcacttcatgatctggaacagtcgacacaaaatctatcttcagcgcaagacttttcgggcttgtttgccgatgtggatttaagtagtaataaattaggcagttctttacaacaacggaaccaaactattagtgatactatgttagctttaaatgcgattgatcttatccatcatcaaggcgacgtcttaggtgacgcctatgaatacttaatcgcgcaatttgccaatgattctggtaagaaggcgggtgaattttatactccacagcaggtgtccgacattattgcccagattgtgacttatcagcgcaatgcaggtgacaaacaagttcgaactatttatgatccagcggttggttccggttcactgctattaaatgtcggacagcacgtgcaagaccccaatttagtgagctatcacggccaagaattgaacaccacgacctataacctggcccgtatgaatctcatgttacatggagtctcgtatgacgatatgcacttacgcaatggtgacacgttaagtaaagattggccggttgacgaaccttacttatttgatgcggtcgtcatgaacccgccctactcggcacactgggataacagtgataaacgcttgtctgatccccgtttccgcgactatggcgtcttaccacctaaatctaaagccgactttgcctttctgctacacggcctttatcatctgcaggaacacgggactatgggtattgtcttaccccatggcgtgctatttcggggggctaaggaaggtaagattcgccaaaagctcctgttagataaccggattgatgccattattgggctacctgccaacatcttccattctgccactattccgacgttgatcatgattttaaagaaacacaaaactaccgacgatgtcttatttattgatgcgtcccgggaatttgaaaagggcaaaaataaaaataagctaacggcagccaatatcaaaaaaattgtgacgacttatcaaaaccggcaagatgtcgataaatatgcccacgtggcctcaccggcggaaatcaaggagaatgactacaacttaaatattccgcgctacgttgatacgtttgaaccggaacctgagattgatctggaccaagtcaaagctgatctaaggcaactggacgaggaaatcagtcagaatgaacaagcctttaatgaattagctagccagttagtgaccacccaagtgaatgatcagtcaaaaccggaggcccacaatgaaggataaccaagctaaatatccgcaattaagatttaaaggtttcactgatccttgggaacagcgtaagttggggaaaatgggctatacttttacaggattaagtggaaaaactaaagaagactttgggcatgggaatgcaaaatttgttacttatatgaacgtttttagtagtcctgtctccaactcagaaatggttgaaaatgttgaagttgattcaaaacaacatcaagttgaatatggcgacgtattctttacaacatcatcagaaacaccgcaggaggttggaatgtcttctgtatggcttgaaaccgctgagaatatctacctaaacagcttttgttttggatatcatccaatggttgagtttgacccttattatctagcatttatgttacgttcaccagtgattcgtaagaagtttatgttactagctcaaggtatttcacgatataacatttccaaaaataaagttatggagatgttagtgccagttcctgaaatagtcgaacaacaaaaaattggttctttcttcaaacaacttgatgacactattacccttcatcaacgtaagttagatttactcaaggaacagaaaaaaggctacttgcaaaaaatgtttccaaaaaatggcgcaaaagttcctgaattgcgatttgcagggtttgctgacgcttgggaacagcgtaagctaatcgaagttgctgattatagaaacggaaaagctcatgaaaaagatatttcagaaaatggagattacattgtagtaaactcaaaatttgtttcgacaaatggagcagtaaagaaattttctgatgaattaatagcacctttaaaaaaaggtgaactggcttttgtgttgagtgacgttccaaatggtcgtgctattgcgagaacctttttgattgatgaagataacaaatacagcttaaatcaacgtattgctggaattactccacactcagacaccaattcgtattttcttcattcgttgatgaatcgacatcactattttttgcgttttgacgatggagcaggccaaacgaacttatcaaaaaaagaagttgaaaattggactgaactgtatccaagcatagaggaacaagacaaaatcggctctttcttcaaacaattagacgacactatcactcttcatcaacgtaagttagatttgttgaaagaacagaaaaaaagctttttacaaaatatgtttgtatagggtctataatttacaaataaccccttgaaaagaccgataaaacagcccctaacaaatcaacttggtttgttaggggctgttttttagattatacttaaaataacgcctgtaatggttggattctaatgcttaaaaaagaggtgactaggttatggtgcaacaacttgttttaccaatcaaagattctaacgtcctaacaagtgtccaggagacgctgttggatagttttcgagctggtcggcgtaattacaccatttttcaactgggtaaagcgaccttactacgggtcagtgatgtcatgcagctgaaaaaggttgatgtctttaacgccgatggtacgattaagcaaaatacgtttatccacgaccaaaagacgggtaaagctaacactctttatctcaaaccagtgcagactgtatattaatcttttggaaatattttttcattgataacaacgactgttttttcgctaatgcccactctatattcaaataataaatctactaattcatcaccatcaactaaggtaattaaattagctccttgacgcgatctactgacagcatcatttgtataggtagaagtcgttacaaatatccctctgtctgcattatgaccactaatggtaccagcaaaattactgatatctggtcctgtaaccggaccttttgtaaatcgcttagtttgtaacacaattttatatgtcatcaactcaggggttcttaaataacctatgccatcaatgccactatctcctgtttttgaagtggtatccattttaatgcctatttttcgcataagatttacaatcaattcttcaaacttatatggattcatttcactcaatcgctgtaataattgatctcgccataattcagaatcatctgtttcttctacaatgtcttcgtccagattggcaatattgacatttgaagatgatagtatttcatctttctttttttgattatttagcttctttttttgccaaacaggagtagatattgagtatacatcgtcccatacatcaaaattatttatatcaacgtcttctcccatctgtgtcaaggcccatactccccactgtggtgaataaagtaatccggctttctttaaattagacatagaccactgcaatctaaaatctaactgactttgaccattactagactttttctctctatctgcatctgtaaaataaggatattcagcagccttttctttgacaagagcagctttagttggccccccataagactgtaatgcttgtaaaatagccactacaccaaacttctccatatagttcaagtttttattagaattcacgaagctgagccaattcttaggcatatcagcttccaattctgttattttacgagtgattccgaaatgatcatacgctaaatctaccatgtttaatccatccttataaattttatttttattatacacctacgtttacagattattttaatgtggttaagctgacaccagcttgcccgacgcgggtagcgttctgcatgacatgctcccgatgaaatcgaccatgcaacggtaaattgccctgtcacggcgtgacccgccggaggttttacgagccggataataggcgctgtaaaataacagttttcccagaaggaagggaaaacgctactgtaatcgcttgtcgattacttgcctcgcagagcctgtccaaaatattattttggtataacaggctataccagatttttaacggtgttatactggtcttggaaaacctttttcgaggaggcatttttgatggcgcatttacaaaatcgcctctcaaaaatattgaaagaataacccctaatatctataatgtagatattaggggttatttattttcatatcataaaaataacttcttctattcgtcattttttcgataccttttagaacgattttgaccaggaaataaacgatcatgcgatccgactcgaatgccaattaagactagttcatctttatcaatcgtataaaccaccaggacatcgttagtttcgctgggtgttttgtttttcggggtatctcgtaagtgaaattcattataaccgctcattcgccgattaagctcatgatcttcaaattctggtggtaattgttgttgctcaagcaacaggtcaatggctgctcgaacttcatcaataatagatttgtctaaactggctaaccgttttagatcagcattaaaggttgcacgtggtttaaatcttagttttttcattatttaaactggccccaataatcatcatctgattcaacaatttcatcttcaggtaaaacatggcgtttaattaactgatcacgtgcaattgcatattctaacgaaccttctttcgcttttaatgctctttctagccagtccattttttcttgtgaaacaatggctactgcgcgactatttgaacgagcaatataaacggtttcgtcttcgtcattaacttgatctaaatatttttttaggttagcgcgaaaatcgctctgtgttagtgctaatgtcatatttaccaccctttcgttgtacttaatattgtactttaatttgtactaaaaatcaattttttaaggagctaaaactatgcaacaagttgtcttacccatcaaagattcaaacgttctcaaagaggtgcaagataccttactcaacaactttaaagctggccggcgtaactatacagtttttcaagttggcaaagcgacgctactgcgagtgagtgatgtcatgggcttaaaacaagcagatatttttaatccggacggttctattaaacaaaatgcgttcattcacgatcgaaaaacgggtaagcctaataccttgtaccttaaaccagttcaaacagagctcttattgtaccatcaatggctgcttgatcatcagctggattctgaatggctctttccttccattcaacacccagaacgccatatcacggaaaaacagttctacaaaattatgagtaaggttggcgatctgttaggaattaattatctgggtactcatacgatgcgcaaaaccggggcttatcgcgtctacacacaatctaattataatattggtttggtcatgcacttattaaatcattcaagtgaagccatgactttagcttatttaggcttgaatcaagcaagtacagaaaacatgttgaaccaaattgattttgggtaaattagtttgattttgctgtcgccaacggcgacttctgatacaggtttttaatgggtctaacacaacatagaataaattctatgtgtaagtgcgcattgacctagtttcactcggtctgctgataaccatgaaattagtttttgccgttgttgaattgactgtatttttaattcaatttatgtttgcacctaactaagattgttatgttttaaatatttaaaaagtgtggcagattacgctgttttaagccaaaattttttagtcgatttgtgcagataatctttataagcttggtaacaaattttgaataatgatactgtaaaatctgtaaatctaaactgaaagcattattttgatgttagaagtcattaagatggacgaaaagaaagtattaaaaccaattgatgaaatgcttgctgatccatggcaagttgatattcaagaattgtttgaagcttctgtcaatgaacctgacgagatcaaaaagaatttgtatgattcagtgtataattatgttttgcaaaaaagacaagaagatattattaatcgtcatgacttccttatttagccctctaagagcctgttgagggctttttgtttttgctttggtataaatatatataaacagtctcaaaaccgctaaaaacgaaaaataaggcccttaaaaacaaacatagcagttgaattcttgttaagattcagaaaaactaactgtttgctgtcaatggtagcggacgagcaaagcgtgggagcataaggaattgacagctcttaaccagtctttacactgaaatggcgaaagccaaagttttgtagaaactttgcttccgtactacgactagccaaccataacctaacacgggggcaaagggtcacgtcccttgctcacattatgtatatacaagatttatgtagataaaatatacgttttatttaataatcattaaattagttaatagcaatgttggtttccaatgattgttttctctctttttacctggtcgttctacaaatcctgtaaacgtatatcttttttcgtggtctaattcttgaagttttttctcattttttaatcctttagtgtttattatttgtaatttaacctaggctagccctataagtttatacatttataaatacatttaaatacattatagtacattaagggaatgaaaatgcagtcataccaagggatacagcatacctttataactatttagtgcggacattataactatttagtgcggacattataactatttagtgcggacattataactatttagtgcggacattataactatttagtgcggatttattaactgtatttgcattattttgcatttatggttataattgcattaaagttaaaaaggcggttaagacaatgaaagaaaaagttgaaattaaaaccaatgaattaactaaaaacttactaagccgacaagattatttggttactcaagggaacgacttagccaaagcattcggcaatttaaaagcttttgaacacaaattactagatttctgttttagttacgttacacgtgattcgaaactggacgacactttcaaagcacaagcttcagatgtgctgaaacactttggtttaacagattctggcactaactatactcgtgtaatcaaaggatttaaaacgctgaatgaagaaacaccgctttatttccttgttaaagatgaagatggttccgatagcgtactaatgacccaattatttaatttcattcgtatttctaaaaataaaacgattacatttaagttttcggagcatgtggcaccctatgtctttgatttgagggagaaatactactctttccatctatcagaattatcacgaattaagtctaaatacactctaatccttatgaaaatgtatcaagcccagaaaatgggtaatcagaaaacagttacgattactggtgaaatgaacgattggcaagattggttcctaggagttgaccgttcgagcaattggacagctggacgattcaaacaaaaagttttgaatgtggccgtagatgaattaattgaaacattaaatgtcactattgttttgaatacgattaaaaaaggtgtcaaagtcactggatatgaaataaccattaattctgactaaatccgcactaaatagttataattgtcgtttcaaactaagctataccaaagtcagataaaagctagttgacataatgatccttattaaaacttcgctacatgactgattatttttaagctatttttatcaaaataattggtatagccaaaatactacttaagagtgccgttatatcaatatttttaaaattcaaatttgtaaaatcttaaaaaattcatttttatataccaattgattaattgaagatattccaccaatgctttttaggtttgtcttcttgtttgtctaattgtacatttgacgtcttatttactgttttatcagtatttgtaggcgtcttttttgcctcactaggctgtataactacttcttcagtttcaatcttcttgtacttatcgagttcgattttcaacttatctaactctgcacgatcttttaaggataactgttgttgctggtcttgtagctgctggctcttatctagtttcttggatagatccgctttatcttgttctaaattatcaattatcttatttttaatctctaattctcgttttagggctttcagagcttccttttcctgtctgtcttgtatcatgcgtccactggcttgttcagttgtaacggacgtctttttaccagacaatatagacaactcttcttcagtgaaacttagcttgtctaaatctattccatttctctcggccctattatacaaagtttgacgagacccaatgcctaaacttttagcaagatctgtctttgtcttaaattgtctttttgtctcctgtacgtcttccacgcgtctcagctccttgtacgtctattaatacatacaattatacactatcaacacaaaaaagcccccttgatccagttaaggaaaaaggggctctatatcgcatgaaattaaattttattatcactatatatggtagattgcaaatttaatccgaattttttgacaaattggtcagcatgacctgataaggtgtttgccggtcaagtattttaagtggtcgctggttaatttcgagtaaggtggttttcaagccttgagcactaatgtgctcaaaataagtccccttaggataaaaatagcgtaagttccgattaaatcgttcattactgccgcgctcagctggcgtataagcatggcagtaataggtcttaataccatattgtgattcaagtggattgaagtcaatatttgagacagattttaagagacattcagaaccgcgtttaccttccacagctcaaataaatcattaatcgcgattaataacttatttgaaccctggaaagcattaaatcaggcggccatttggctcgtaagtgttgcaatttcaacttgtaagggggtctggtagcccagtaaactatgaattctcttcctattgtagaaagcatgcacatattcaaaaaggacggcagcgacagtttcataatcttcaaagaccggcactggataaacacattcctttttgagggaagcgtgaaaggattccattggcgcattatcatacgaacaacccttacggctgtatgagtggcggatatgtagtttagttaaacgttgattgtaatcatcgctggtatactgtgatcctaaatccgtatggataatcaggtccccagtaatggttcgatttttaaccgcgctttccagggtctttaagactaaatcagtatccatcttttttgagaacgaatagccgataatccgtcgtgaatgcaggtccatgatggttgataagtaacaccagccattacgcttcgtttgaatataggtcatatcagcggtacatttttgatttaaaccagtggtcgagaaatcctgcttaagcaagttgggacgctgttcaaccttggttttggaagccaaagctgcagtggttgaagttccagattcaattcatggtggatcttcataacaccgtatcgctgcttaaattccgcaaagatccgcagaatccgttgtttcaagtccgcatcttcggcccggcgttttgaaggtttgggggatcgataacgataatactgagctctggaaacaccgaggattcggcacatcttggttacctggtggtgatggctttcttggtgaatgtaatcaaaaatattggttacttctgcgcaaggaagcccagggctttttttaggatttcgttctcctcagacagcgaagccagtcgcttttccatcgctttgatttcgtctggcgatttaccggattgagttttggcctggccctggatccacttatgaactgttgaatagccaatgccatattctctggccagttgggcagctgattcgccttgcttatataggttgataatgttttgtttgaattctttgtcgtaacgagttggcatgtaaaaattccttccttttgagagacgatttattcattataccctctcttaaaagttgtctcaggaatcagcttacatccatagtcatacttattatctgttaacattaaatttctttcgatacctgataaaggtggttcgtttaatgccggtgtttctggcaacatcgatgtcactcatgcctgcttgataaagtttaaaagcatgttgcaagtggggatcgtctttggcatattgaggcttccgaccatgatatttaccctgctgcttagccagggcaatgccttgtcgctgccgctcaatgatccgcttacgttcactttccgcctggtacttatacaattcaatgatgaggttagtcataagttgacgtaaattagggtcagtaattccagtcatggacggcaaatttaacacatctagggtggcacccttattttgaatggtgttcatgatcttagttaaatccaggttatttctgcctaagcgatctaattcagtgaccattacaatatcaccctcacgaatataggccagcattttttgcagttctggccgattagtgttagccccacttaatttatccgtaaataatttatcaacgtcttttaaagccgctaactgtcgatctaaatgttgctccttggaactcacacgcgcataaccgattttagccatttccaattctctttttggacagttctaatgaacatttgtaattcctagtatagcgcagaaataaaaaaggccactagggtatgccctattggccgttgctgacttaaacttaattaatttatatttctcttaattaacatgtgttcctagtaattttttattgtctgcgttttccaaaagcttcttgataatatgttttaaagataaaacacctgactgtttcattaataattcatcatatatgatttaaacaattaaaaaagatatgatatttcattctaattaggagcacctttagaaaaggtatttgcaacagacgggttttcagaacatgatggcgccctacttgccgacacattagttgatgcggatttacggggcatttcgtcccatgggattcaacggttggcttggtacaccagcatgatcaaagaacacattattgaacccaaaaacaaagtgaaagtcctaaaggaaacgccgaccagcctactgatcgatgccaataaaaacatgggtcagattgcctcagcatttgcaatgaacagcttaatcgacaaaaccaagaaattggggatttcgctggctgttatccgcaactccaatcatttcggaacggccggctactatgcccgcttagccgctaagcaaggattaattgggattgccttgaccaacacgcgcccattagttgttccaaccaacgcgactgaggccttcttgggttccaatgccttcgcctttactttcccggctgacccccatccctttgtcttcgatggggcgacctcgattgtttccagtggaaagattcaagtgctcgccaaaaacaatcaacccattcccggcgactgggcggttgatgaccaacgacacgtggtcaccgatgcgcaaaaagtggaagacaatttggccaaagttgccttcacggaagatgagcctggcggcggagtcctaacccttggtggcttacttgaacaaaattccaactataagggatttggtaattccttagtggttgaattattaacgggcatcttagctcagggctcaatttcggctgataccaacaaaccgggtcgccacgacttcagtcagttcttcttaaccatcaatccggcattgtttggcgagcttgatgatctcaaacaacgagctactaagatgtttgatcggattcgccacctcaagcacgttcccgggactcatatcatgatccccggcgatcgtgagtataaacattatgacgagaatcttaagcaaggcgttgtgattgatgataagaccgctcaggagctggagacaattggcaagcaagccggtgtcgtcgttccccaggcaatctaattttgattggtatctccattaatgactaattctacaaaatgcttttctgcaaccaaaagcgttatagtagtggtggtaacaaaatgatttgagaaggtattcaattgaaaactgtattaattttaggagccgcaggtcaaatttccagttatttgattccagccctcttacaacaaactgattttaacttaaaactgtatgctcgcaatgccaacaatcgtattaaagtgactgatccaagccgagaaaccgtcattgatggcgacttcaacgacaaggataccttgaatcaggccctggatggcgttgacgcggtgtatttgaatgaaatgcgtgatctcgattccgttaaaaatattgtggcagcaatggatgccaaccacgtccgccaatttatcggagccaccgtccttggaattgaagatgaggtcaagggcgcctttggtcagtggaataccagtatgattgaaagctcaatcaccaagcggattaaaaccgccaaagtcatcaaggattctgatctcacttacacgttgctgcggttagcttggctttataataaagacggtaacaccaactatgagttaactgacagcgaccagccatttggtgggacccaagtgacccgtcaagccgttgcccaactgattgtcaacatcttgcaggatgagtcccggaagtacgcccgcgagagcttaggcgttaacgagccaaatacgaattgggataaaccgtcgttttattaatttgacaagattgggacgaaaggcgatttgatcccagaatttaagtaaaaaagtagcacattcaaaaccagaatgcgttactttttttggcttaaatggccgagatcagccgtttgccgcaagttttatcaatctaaaaatggcaagccaagttgcattgataagcaccttgctaactaatgtctcatccacttctgtgcggtcctatatgtcttgaaaaccggttgccaatggcgtcaagtccccggtgatttcccagaatggcggtcagtttacaactattacaaaatttggtcaactaaagctgagcctacggctgattctttattggaacaagttttaaaaaaattgtcattgctcggcgaacttaccaaggacgttcagctttaacttcctttattatcgttgacgctcagagcgtcaaaaacaccgctactgctgaaaacaaaggttacgacgctggtaagaaaatctcggagattaagcgccatctggcagttgatatcaatggctttccgcaggccattcacatgacgcgagcgaacgtctctgatcgagacggggccagtgcaatgatcgctttacatgccatgcatttacgccaggttcaaaatgtcttggttgatggtggttattcaggcgttaattttcagctcgatgtagccagtaatttaaacgcaaccgtgcaggttgcgaagcgcaatgagttgcatcgattcgaagtcatgccccaacgttgggtagtcgaacgatcttttagttggctagagaattgtcggcgactttggaaaaattgtgagcgtcaattaaccacctgtctgcaaatggtcgttttagcgtttttagcactattacttaagagattttagacagcttcttagagaagattaacgccttcaagtcagcatttgggactgtgatgtactacactgacatggacgttgttcaccgctttgaaaacgacttcgcactgtatgcggacaacttcgccgactgggcagaacaagcccaaggcaacgcccaatttgccgtttggacatcccttgccgaaaatggtattggcgctaacttgcaacattacaacccactaatcgatgacgaagttaaggaagcatttggcatccctgacagctggaaattgcgtgctcaaatggacttcggttcaattgaagctccagctgatgaaaaagaatttatgagtgatgaagatcgcttcaaggttttgaagtaatttaattccaataaaaatcggggccatcattagtcgattctgtgtgtcaaatcgtgacagctacggtttccccccttatattgacaaaacttggtacaaacggctgatcccggccatttaacgcctttcgtcccaatcttatttcttcaattgagccttcacaagttcatcaccgtgactaacgacctcttgctgcgtgtaatcagtctgaacaaccttgtcaccctgtgtcagcaagacaaccacggtatctttgtagcctgcctgctgaatcttgtcacggttaaattccagcagtaagtcacccttcttgaaggactggccagaatcaacatggttaatgaagccttcgccacgcatattcacggtaccaagtcccacatgaatcaagacttccaaaccatcattcgagcgtaaaccaatgatgtgcttggtggtaaacagtatcagcacttggccatcaaacggcgcgtatatcttgccttccgtcggttgaataccgattccgttacctggcaagcctttatggtcatgctcgtcaaccacatctgccaagttaacgctcacaccactaactggtgcggcaacggcaattgtagcagccttggcgccaggcatggtaacttccgtttgagctgtggtgttgtctgcagcttgagctccggaaattccttcagtcgctaatttcttctgcaattcatcaacaatctcagcatgcttcttttcagaaatctttaccttaaagacgtaaatgaacaatgcagcaacgtgcaggaacaatgcaatccagaaagcaaccagtttgaataatgaaatgcctccgggtgtcattgaagcagcggttgcggtaccggtcatcccggcagcaacggcaacccaaccaacaatggcgtttgaaatcgcaccggacatcttgtccagcattggacggatggccaaggtaacagcttcgttacgggtcccatttttaagttgaccatattcaatcgtatcagtcaacgtcagaataacggccatgaaaatgaagccttgtggcccgtaataaaggatcatggctgtgataaccatcggtaagttatcaactgacacaatcagcaaaatgtaggctaaaatcatgctgcacatgctgacagcgtagatggtctttctggtaacccacttattgatgatgggatacaacggcgaggtaaagaaaccggcaattgtcgggataagaccggtaatccagaataacccaggcttatccatgacgtacttgaacatgtagaacatcaggccggcagtggcggcgttaccaaatccataaattaggtatggaaatgcggtccacagcatttgatcgttatgagccaaagcccagaacatgtctttcaaacttgtcttttgtttagtaacggcacgcaaagcattatgtttttcatgcgttcccaaaccaaccacgaacgagcaaatgatgccgacaacggcgattaaaatgccaaatgccgtccagccgggttgcccttcgttgtgtgacccggtaaagacaaacgtaacgtatgtgacaacaggaacaataatgatggtcacaatgttttgaccaaatgcactgaagttagcagcggcagtaaataatgaccgttcatgactatcttcagtcaaagcgggcaccatgccccaatatgaaacatctctgaatgaataaaagatatcaaaggtgataaagatcgggataaacatgatggtgaaccaagttgcacttatccgcgataagccaaagatcccggaaaacagtaatgccagtaatagactggatatcgtcccggcaccaatcagccacggcttaaattttccccagcgggtattggtattatcaacaatattaccaataatcgggtcaatgaaaacttccacaagccgaataattaaaatcaatccggtaatcattgcaatgagcttgttggcttgtgcttttggaacgccggtaaacatggccgaggtaacatagaccataaagtaggtcccgaaggtaatataaaccgctgatccacctatattcgcaaacgcaaagttgaaaatcgaccagaaatttttccggcgatctttcttttgtacagcatccaatttataaaacgcctcccagcgtgccgatatccgccaaataaatgcgggtttcggtatgaaatatttgagaaatatttgcttacaaagcgagtatatcatgcaagggctttcaccaatgcctactttttaccctaaaatacccaaatttaacctaattatagtaaaataaactaaaagggagtgctactatgcgaattgcatttaataaacctgtggaaactatgccgctatattgtgacagtgtcggctatgactgggaccagccgccaattcaccggctaaatggctattacgcctaccattggctgcagacgcaaagcggcagtggcgtcatcacgatcgaccaccaaagcatttcattggagccacaacaaggaattctcctgcgcccaagagtcgctcatgaataccacccaactgggggaagtccctggaaagtatcgtttttgaccttcaacggcacgctttgtcgttccctggccgactttttgaaacttggtgattatctggtgatcaatcaagtttcgcctgaactaacaacttttattccggaagtcttgaatgaatttaacaacagccatccaattgcgctgctcgatcaatccgttcaaatctataagtttatcatgctgctcaaacaaaataatttactaaacaatcaccgctatcaggattccgccatcacaactccaattctcaaatacattgcaaatcactacgccgaacccatttccaatgaaaagcttgccaaagttaccagctattcggtcacctatcaaaaccgggtatttaaacgcttatacacaatgactccgcttgagtatctaaccgattatcgaatgcgtaaggccaaggaattgctgttaaccaatccaactctggaaattcgcgaggtcgccgcaaaagtcggctttcataatccatcacacttcattgatcaatttaaaaagttttatcgtacgaccccctcccactttcggaaattcatttaagaaatccgattcaatcaaaacggcactgtttcgttatcacttgagaaaacttttgtcctctcaaaactgaataatatctacattctctttcgagttacttgccacgttctacttggttaagtcctcgaccgattagtactagtccgctccatgtatcgctacacttccacttctagcctatctacctgatcatctctcaggggtcttacttgcccgaaggcaatgggaaatctcatcttgaggcgagtttcacacttagatgctttcagcgtttatctcatccacacatagctacccagcgatgctcctggcggaacaactggtacaccagcggtgtgtccatcccggtcctctcgtactaaggacagctcctctcaaatttcctacgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgacctgtctgtctcgcagtcaagctcccttctgcctttacactctgcgaatgatttccaaccattctgagggaacctttgggcgcctccgttaccttttaggaggcgaccgccccagtcaaactgcccaccagacactgtctcccgccacgattagtggcgcgggttagagggttcatacaacgagggtagtatcccacttgcgcctcctccgaaactagcgttccggattctacggctcctacctatcctgtacaagctgtacaaacactcaatatcaagttacagtaaagctccatggggtctttccgtcctgtcgcgggtaacccgcatcttcacgggtattataatttcaccgagtctctcgttgagacagtgcccagatcgttacgcctttcgtgcgggtcggaacttacccgacaaggaatttcgctaccttaggaccgttatagttacggccgccgtttactggggcttcagttcaaagcttcgcttacgctaactcatccccttaaccttccagcaccgggcaggcgtcagcccctatacgtcatcttacgattttgcagaaacctgtgtttttgataaacagtcgcctgggccttttcactgcggctgatcttgcgatcagcaccccttctcccgaagttacggggtcattttgccgagttccttaacgagagttctctcgctcaccttaggatactctcctcgactacctgtgtcggtttgcggtacgggtagttaaactctaactagaagcttttctcggcagcgtgacgtcaggaacttcgttacttaaatttcactccccatcaccgcttgtccttaagaaatcaagcatttgactcgacttcagacttacggcttggacacccacttccaatcgggtgcattccttagcctcctgcgtccctccattgttcaaacaagtttaactagtacaggaatctcaacctgttatccatcgcctacgcctctcggcctcggcttaggtcccgactaaccctgggaggacgagccttccccaggaaaccttagtcatacggtggataggattctcacctatctttcgctactcataccggcattctcacttctaagcgctccaacagtcctcacggtctgccttcgtcgcccttagaacgctctcctatcacgccacctaatggtggcatccacagtctcggtaatatgtttaagccccggtacattttcggcgcaggatcactcgactagtgagctattacgcactctttaaatggtggctgcttctgagccaacatcctagttgtctatgcaactccacatccttttccacttaacatatatttagggaccttaactggtggtctgggctgttcccctttcgacgatggatcttatcactcaccgtctgactcccggacataaatcgatggcattcggagtttatctgaattcggtaacccatgacgggcccctagtccaaacagtggctctacctccacgatcctaattccgaggctagccctaaagctatttcggagagaaccagctatctccaagttcgtttggaatttcaccgctacccacacctcatctcagcacttttcaacgtacacgagttcggtcctccagtgcgttttaccgcaccttcaacctggacatgggtaggtcacttggtttcgggtctacatccgcatactaattcgccctcttcagactcgctttcgcttcggctccgtctcttcaacttaacctggcatacgaacgtaactcgccggttcattctacaaaaggcacgccatcacccattaacgggctctgacttcttgtaggcacatggtttcaagaactatttcactccccttccggggtgcttttcacctttccctcacggtactggttcactatcggtcactaggtagtatttagccttgggagatggtcctcccggattccgacggaatttcacgtgctccgccgtactcaggatcctgaactgagggagtttgatttaacttacggggctgtcaccctctctggctggccttcccaggcccttcagctatcaagctctttggtaactcaaatgttcagtcctacaaccccaagaagcaagcttcttggtttgggctgttcccgtttcgctcgccgctactcagggaatcgaattttctttctgttcctgtgggtactgagatgtttcagttccccacgtttaccttcacacatcctatgaattcagatgcggataatagtcgattaaaactattgggttgccccattcggaaatccccggatcaaagcttacttacagctccccgaggcatatcggtgttagtcccgtccttcatcggctcctagtaccaaggcatccaccatgcgcccttcctaacttaacctaactttacctacggtaaagcgattaattgagtattgcgattattttgaactaatcttgtttaactctttaaaattacgcggttttctctcggtttaattatgattaattaaaattagaaaattatagatattattcagttttcaaagaacaaaaggaggctagtttatccaattttttagtggaggagtgactgaatatttcaaggaaaattgatttaaccggtaaaagttttggccgactcaaagttctagagacggtttcacggcgaggggctaataaaaacttgatttggttatgtaaatgtagatgtggagatatagtcgaggtggatagttattcgcttaggcatggaattattcgaagttgtggttgtttaagacaagaagcatcggcacatcgaattcgtcaaaattacaatactaaaaagtttattggtgaccctaatggatttaaagataaacttggtaaccctgtacaaatggtttatgtgggtaaacgaaataaaagtggggtagttggggtttcatttgataaaaatatccagcgttggcgagcaagaatggtgtataaaggagaatttaaactgaatggagtgtttgaaaattttacagatgcagtaactgcacgaaaaaaagctgaacaaaagtatcttaaatattaaaaatttagttatcgagcgctacagtgagattttctttgaaggcgctttattagcgtgcaagccaataataattttttattcgtaaatagattattgcgtgatttgataaaatataaggagaagctaatgtccaaaaataaactatggaatgttaatgaaaaaaagcgttataaaatgtacaaggatggcaagcaatggctttttgccggaataggattagttgctggtattttaggatctggatcgactaacactgtaagtgctgccgagcaaaaaacaataactaagaacctcaagaacgaagacgcagtattggcgacgaaaacaaatgctgttattccaaaatcagaggagaaacaagtaaaagttgctaattcaaataatgagtcagagtcaacatctgcaagccagatcagtacaaattacgcagagaaggatagcacctcgaaaagtttaaaagcgtttaatgaagatattagtcaaacagaaagtaaatcaaaagtaccgaatagtaattctgaaagcaattcattgggaaaaaaagatgattcaattaatagtactgaatctaaataccaacattctacaagtttgtctttgtcaacttcagaaagccaaagtattagcaacagcaatacaaaaaatgagcaagatgtttctaaagaagcaacggatactaaagatgatgtctttcaccagacaattttacatactgatgaagatggtaataatttattagatccagaagaaactgatcatcatgacggggagcagttagcaatcactccaccggaatttaacgatcctaattatattttagatcttgatcagtcaactttatatatagaaaatgcagaaatgtcgttaagtcagtggatggaggctgtcaaaatttttggcccctttcacagtgcgcaagagtttattgatgcaataaatatgagttctcactatggcaaaagtgaaggtgacattgtattacattatgtgtatcgtcatcaagaaaatcaaattgatttagtagttcatgacgaagaaacttatgtaggggacccacatttaagcgctgcagattttgttgattcagtaacgaattcggatggaagtagtgggaatatagatgatgttcaggctgatttcagtgaagtgaattgggacgtagcaggaaaatatactgtccatttaacatactttgatgctaaaagccttggaactgttgaacgagatgcaactctaacggtacttgataataattcaggctctgaatcaacttcaacgtcaacatcggataagcaagacagtgattcccgttcggcgtcgatgtcggataagaacgatagcgattcccgttcggcgtcgacatcggataagaacgatagcgattcccgttcgacgtcaacatcggataagaactgagagtagacctctcaaaactaaacaaaactttgactcgtgtgcggttccgtattattccttagaaaggaggtgatccagccgcaggttctcctacggctaccttgttacgacttcaccctaatcatctgtcccaccttagacggctagctcctaaaaggttaccccaccggctttgggtgttacaaactctcatggtgtgacgggcggtgtgtacaaggcccgggaacgtattcaccgcggcatgctgatccgcgattactagcgattccgacttcgtgtaggcgagttgcagcctacagtccgaactgagaatggttttaagagattagctaaacctcgcggtttcgcaactcgttgtaccatccattgtagcacgtgtgtagcccaggtcataaggggcatgatgatttgacgtcgtccccaccttcctccggtttgtcaccggcagtctcactagagtgcccaactgaatgctggcaactagtaataagggttgcgctcgttgcgggacttaacccaacatctcacgacacgagctgacgacaaccatgcaccacctgtcattctgtccccgaagggaacgcctaatctcttaggttggcagaagatgtcaagacctggtaaggttcttcgcgtagcttcgaattaaaccacatgctccaccgcttgtgcgggcccccgtcaattcttttgagtttcaaccttgcggtcgtactccccaggcggattacttaatgcgttagctgcagcactgaagggcggaaaccctccaacacttagtaatcatcgtttacggcatggactaccagggtatctaatcctgttcgctacccatgctttcgagcctcagcgtcagttacagaccagacagccgccttcgccactggtgttcttccatatatctacgcatttcaccgctacacatggagttccactgtcctcttctgcactcaagtctcccagtttccaatgcacttcttcggttgagccgaaggctttcacattagacttaaaagaccgcctgcgctcgctttacgcccaataaatccggataacgcttgccacctacgtattaccgcggctgctggcacgtagttagccgtggctttctggttaaataccgtcactgggtgaacagttactctcacccacgttcttctttaacaacagagctttacgagccgaaacccttcttcactcacgcggcgttgctccatcagacttgcgtccattgtggaagattccctactgctgcctcccgtaggagtctgggccgtgtctcagtcccaatgtggccgattaccctctcaggtcggctacgcatcatcgccttggtgagccgttacctcaccaactagctaatgcgccgcgggtccatccagaagtgatagcagagccatcttttaaaagaaaaccaggcggttttctctgttatacggtattagcatctgtttccaggtgttatcccctgcttctgggcaggttacccacgtgttactcacccgtccgccactcacttcgtgttaaaatctcattcagtgcaagcacgtcataatcaattaacggaagttcgttcgacttgcatgtattaggcacgccgccagcgttcatcctgagccaagatcaaactctcatattaaaatgatgagtctttttcaagctcattaattgtttgtttttgcgaattgacttcgcatgtttgttctcactaaatcaatttgatttgcgagtcctcacacgatcgtttgtcaaaattttgttcagttttcaaaggtctaccataacccttttacgagatatgaaaaaatcattttctgataagtctttggatttaataaacgattacaaaatgaatatatatggaagtgttttttcttctattagaagtgttctgtcttttgattggtttgatccagtacaaggatatgaattgtatcccttgatcaaattttttaaaaatttcgatatgtatctaactcccttcgaactcattacacctataaaacaaaataatcagtacgttgtttatacagcaattgcatactatatttatgacaagagtggagtaagtcccaattttaaaacggttgagaaaaagttatatcaagaaattaaagaaaatattgaaaattttaaggataaaggtacgagtaaaaataaaatcgctaaagatgcagaatttttttacatggttaatgatttctctaaatatcccggattttcaggacaagaaaaattgttttttcaaactaagttaaggacggcctcaagtaaaattcctctgatacaagagatttccaaagagagttattatgaatgggatacagactttaatgaatattctagaaaagtcttcatgaaaataattattggaaaagtaaataaattaaataattattatgaataaggccaaaacatatagaacagggcttgattgacacaagcagctaacggtgaaatataaatgatagaaatattggaacgtggaaagctgatgacgtggaggactaaattcctatgaagcggaaaatgtggaattcataaacattcttacatcagtgagagtagtggcatagtacctacgaagcagtgataataagctgtggagggacagccacaagtcatattttaatttcttcaaacatgatgtattccatagaatcgagtatgaaaaaataaacaccgacgccgaaaggaggcggtgctatggacaatgcatctgcggcaaagccaatcagacatgcccagtactacaatatgacaggagtctttgacaatctatatgaggcaagtaaatttggaagtgcctttccggacctaatgacaacaatattgtcccaaaataacattttgctaagctatagaaatatcaaaaacaatactggaagtttaaccggaacgaccataaagaatttagggttgaaagcgattcggaatacaaatatttgtactcctacgattgatgaacaagctaaaattggtgtgcttttccaaaaccttgataagacgatcactcttcatcagcataagcttgaaaaactccaagaacttaaaaaagggtatctacaaaagatgttttgctgattcttaatttgatcaaatttacgatcctatgaaaccccatgacttaatttttattgtgcttggtcaacacttaattcacctgtataatggattacgcaggaagttttaagggcggtggctgtcttttcccttgcgaggtgaggcccatgggaacatggaataatcttcaggaaggtttcacagtcaatgagcgtcttccagacactctcgttgatgttgctatttgcaatgtttattttagcgttgctaacgtacatcgacaaaaggaacaaataaaaaagccgccctgtgtaactttggccagttacagggtagcttaatgctgtcttattaacttcgccaccgcctttgaagcggcttgcatgggaagtcctgttctagcggggcttccctttttctgtctacattatagcatgactataatggactttcgactatttttaatcaactttctgccagtttttagggaacacacgtttgccttctgtgctacaatacaggtaaaagctaacggaagtgatgaaattgtttactgatgatgaaccgcatggcgtgttcttcttaattgataacaagtccttttatgctagttgcgaagccgtttcccgggggctaaatcccttaaaagtcccattagtggtccttagtgaagctgaaaataccaatggcggactcattttagccacgtcacccgaagctaagcacttatttcatcttaaagccaacgtctcccgtaaacgtgacttacccaatgaccccaggttgtgggtcgtgccaccgcgcatgaacctttatattcaacgtaatttgcagatcaatcagatctttcatcaatttaccactgaaaaagaggtttggccgtattcaattgatgaaagcattcttgatatgacccatacttggcggctgtttggcaattccgttcgcgaagtggcacgcttgattcaaaagacagttcggcaaaagctaggcttgtataccaccgtgggaattggtgacaatccggtgcaagctaaattagccttagacctttacgctaaacataatcatgaattgatcggtgaaatccattacgaaactgtgccggataaaatttggtcaattactgaattaacagccgtttgggggattggcccccgtatggcgaaacgtttgaaccgccttcacattcacaatatgtatgagctagcccataccaacccttatttactcaaacaacaacttggcatcattggtagccaattatttgctacggcctggggaattgatcgcgcacaagtcacggaaccaactaaggttaaagaagctagcctgggtaattcgcaagtattgccacgagattattttaaccaagtcgaaattgaaaccgtcattaaagaaattggggaacaggtggcggcgcggcttcggcaccaccataaactggcggggtgtctatcgctaagcattgggttttcctatgccgcagccgaagcagatggccgcggtggctttcaccaagctttaaaaattgacccgactaacgataatcaagttttgacgcaacagttattgtggttattccgtcagaattgggacggtcaagctgtccggaatattggtgtttatagcagtaaactaagtgccaactccggccaacaacttaatttatttgaaaccccgcgcaaccaaattcgccatagccggttaaaccaggtgattgatgaaattcaccggcaatttgggttcaccaaactagtttacgcgaccagtttattaaagggaggcaccgctatcaagcgggcttcactagtgggcggacataatggaggcaatagctatgaatagcgatatagagattgttaaggggcggttaaccctattgtttaagcggcgtccccaaacccgctattggttaatgttaactaatgatacctacgatcagacctataatctgttttttaacagtcaacgggctaatgagcgcttgcaatccgttcccttacataaattagcacactatgatttagctgatttagaaaagctgttaaaagcattacgacaagatataaatgattgtgaagtcgaacgtgattcactatcccgtgagtcttgattgtcagacgttgatgctgacttcgaatcactatcgttcttatccgattgtgatgtggagcgagattcactgtcccgtgaattttggttatccgattcggatgccgagattgattcactttcatgcttatcggatgtcgaacgggattcactgtcttccttatccgattgcgaaattgaacgtgattcgctatcttgagaatcttgatgatcagacgttgacgctgaacgtgattcgctatcatgtttgtttgattctgatttcgattcactgtcttgtttatcagaggtcgacttcgaatcgctatcatccttatccgattgtgaaatcgaacgggattcactatcccgggagtcttgattgtcggatgttgatgctgacttagaatcactatcgttcttatccgattgtgatgtggaacgagattcactgtcccgtgaattttgattatccgattcggatgccgaaattgattcactttcatgcttatcggaggttgacttcgattcactttcatctttatcagattgcgaaatcgaacgggattcactatcccgagagtcttggttgtcggatgtcgatgctgacttcgaatcactatcctgcttgtctgaggttgaggccgacttcgattcactatcttgcttatcggatgtagacgctgacttagaatcgctgtcttgcttgtcggatgtcgaggttgaacgactttgactatcccgcgaatcttgactatctgacttcgaagccgagcgtgattcgctatcttgtttatccgaggttgatttcgattcgctgtcatccttgtcggattgagaaatcgaacgggattcactatcacgagaatcttggttgtccgagttcgatgccgaaattgattcactttcatgcttatcagacgtggataagaatgacagtgattcgaagtcaacatcaacctcagataagcaagacagcgattctcgttcgatctcgcaatctgacaagaatgacagtgactcacgttccgcttcgacatcagataaccaagactcgcgggatagcgaaagtcgttcgatttcacaatcggataaggatgatagtgaatcgaagtcgacatctgacaagcatgaaagtgaatcaatctcggcatccgaatcggataaccaaaactcccgggatagtgaatcgcgctcgatttcacaatcagataagaacgatagtgattcgaagtcagcatcaacatccgacaatcaagactcgcgggatagtgaatctcgttcgacttcacaatcggataagaatgacagtgattcgaagtcaacatcaacctcagataagcaagacagcgattctcgttcgatctcgcaatctgacaagaatgatagtgactcacgttccgcttcgacatccgataaccaagactcccgtgatagtgaaagtcgttcgatttcgcaatcagataaggatgatagcgaatcgaagtcgacatctgacaagcatgaaagtgaatcaatttcagcttcgaactcggataatcaaaattcacgagacagcgaatcgcgttcagtttcgcaatcggataaggacgatagtgaatcgaagtcgacatctgacaagcaagacagcgaaagccgttcggcatcaacgtcagataatcaagattctcgtgatagcgaatcgcgttcaatttcgcaatcagataaggacgatagtgaatcgaagtcagaatctgagaaacaagatagtgaatctcgctcaacatctgacaagcaagacagcgaaagccgctcggcatcaacgtcagataatcaagattcccgtgatagcgaatcccgttcgatttcacaatcggataaggaagaacgtgtttggatactttgacattcgatttgattttagttaaattagatcaaaaacaggagtttttaatccatgaaaagctttgcacaccattatagtagcgacatctctcgtgaacaatttgaactaatccggacagatctagaaggcatacgtaagcggactaagccaagaaaggttgatttatatgatatcttttgtgccctgctttataccttgaaaaatgggtgcgtttggcgcgatttacccagcgattttcctaaatgggaaaccgtctattattactggttactttggactaaaacgccatctcctgctggtatcactcctctggataaggttttaaaaaaattgtcagccaacatcggttggctcagaagcgttcagtttatacatcgttcatcattctagatgctcaaagtgtcaagaataccgatcctgctgaaagtagcggctacgatggtggtaaaaaggtgagtgggattaagcgccatcttgctgtagatatcaatgggctgccgatggcagtccatgtgacaaccgccaatgtttctgagcgtgatggcgccaatgcgctactggcgttaaacaaatcacagtttgacctggttcaacgagtaatggccgatggtggttatactggtaacaactttgctcaatcagttcaggcaatgattaacgctgaagtcattattgctaaacagagtgaccttaggcacggtcaagtgaccccgcaacgctgggttatcgaacgcagttttagctggctaggaaaatatcggcgcctctggcgcaattgtgagcgaaagctgaacaccagtaagatgatgattagcttagccttcctgcgaatactcttgaaaagattctaaacacgttctccagcctcttttattaataattaatcattttcattaaaggtacttagcgtcccccactggatcctgtgaagttaaaatcttaggaccatctggcgtaaccactagagtatgttcgtattggcaagataaactaccgtccatggtggtaactgtccaaccgtctggagcagaagtatcacattgccaacttccggtatttaccattggttcaatagtgatggtcattccgttccggagccgcggaccgtgaccagcttcaccatagccaggaaccatgggatcttcgtgcattgttggttgaataccgtgaccaacaaattcccggacgtctccataacccatttcgtcttctacgtaagtttggattgcgtgaccgatgtcgccgatccggtttccttcaacggcttgatcaattcccaggtacaaagctttcttagtaacttccattaatttcttaacttcgtcactaacttcaccaaccgcaaatgcccagcaagaatctgccatgtaaccatccacgctgactacggtatcaaccttaactaagtcgccttcctttaaaatcaaatctttccgcggaaaaccgtgacatacttcgttgttaacactcacgcaagttgcgtattcgtaaccttcaaagcccttttcttcaggaactgcgccgtgttcatctaaataacgaagcgcgaatttctcgatgtcccagctagaaattcctggcttaataacatcgcgaagtccaatatgcattcctgctagaactgcgcctgctttccgcattgattcactttcgtgtttgtcggaggttgagcgtgattcactgtcttccttatctgattgtgaaatcgaacgggattcactgtcttgggaatcttggtgatcagagttcgatgctgaacggctttcgctatcctgcttatcagatgtcgacttcgattcgctatcatccttatccgattgtgaggccgaacgactttcgctatcacgagaatcttgattatcggatgtcgaggccgaacgactttcgctatctaacttgtctgaagttgacttcgattcactatcgtccttatccgattgtgaaatcgaacgagattcgctattacgagagtcttggttatcggatgttgatgccgaacgactttcgctatcgcgtgaattttgattatccgattcagacgccgaaattgattcactttcgtgcttatcagatgtcgacttcgattcgctgtcatccttatctgattgcgaaattgaacgagattcgctatcacgagagtcttggttatcggatgttgatgctgaacgactttcgctatcatgtttctcagattctgacttcgattcactatcttgcttgtcagatgttgacttcgattcgctgtcatccttatctgattgcgaaattgaacgcgattcgctatcacgagaatcttgattatctgacgttgatgccgaacggctttcgctatcatgtttctcagattcagacttcgattcactatcttgcttatcagatgttgacttcgattcgctgtcgtgatagcgattcgaagtcaacatctgataagcaagatagtgaatcgaagtcagaatctgagaaacatgatagcgaaagtcgttcagcatcaacatccgataaccaagactctcgtgatagcgaatctcgttcgatttcacaatcggataaggacgacagcgaatcgaagtcaacatctgacaagcaggatagtgaatcgaagtcaacttcagacaagttagatagcgaaagtcgttcggcatcaacatcagataatcaagattctcgtgatagcgaatcccgttcggcatcacaatcggataaggatgatagcgaatcgaagtcgacatctgataagcaggatagcgaaagccgttccgcatcgaactctgatcaccaagattcccaagacagtgaatcccgttcgatttcacaatcagataaggaagacagtgaatcacgctcaacctccgacaaacacgaaagtgaatcgcggataagaatgacgatgactcgcgttcggtctcaacttcaacgtcagataagaacgatagcgattcccgttcgacgtcgacatcggataagaatgacgatgactcgcgttcggtctcaacttcaacgtcagataagaacgatagcgattcgcgttcagcatcaacgtcggataagaacgacagtgactcacgttcaatttcacaatcggacaaagaagacagcgaatcgaaatcaacttccgataaggtagaaagcgaatctaagtcggcctcaacatcagacaagcaggatagcgattctaagtcagcatcgacatcggataaccaagactctcgggatagtgactcgcgttcgacttcacaatcggaacgactttcactttcttccttgtcagattgtgatgcggagcgactttcgctatcgcgtgaattttgattatccgattcagacgccgaaattgattcactttcgtgcttatcagatgtcgacttcgattcgctgtcgtccttatccgattgtgaaatcgaacgggattcgctatcacgtgaatcttggttatcggatgtcgatgctgagcgggattcgctttcttgtttgtcagatgtcgacttcgattcgctatcatccttatccgattgtgatgccgaacgggattcgctatcacgagagaaccttaaagttttaacgtgtatttttaagcttcaaccaatgattatttttcggctgtctttatttagtgaagtgggctatggatatgattttagtgtcctttaaaaagaacaaataactgctaaatcagcgatttaatcctactttcaaggtttatccgaaaaataaataattacgtaaaaggggtatacatttcgttgttaatagggtaaacttttctacatagggtgactcgtaggcgttgctaatggttatgcttacgtttaatttatttcaacctccgacaagcaggatagcgattcgaagtcagcatcgacatcggataaccaagactctcgggatagtgaatcgcgttcgatttcgcaatcggataaggatgatagtgaatcgaagtccacgtccgataagcatgaaagtgaatcaatttcggcatcgaactcggacaatcaaaattcacaagatagcgaatcccgctcgatttcccaatctgataaagaagatagtgaatcgaagtctctcgtgatagcgaatcccgttcggcatcacaatcggataaggatgacagcgaatcgaagtcgacatctgataaacaagatagtgaatcgaagtcaacatctgataagcacgaaagtgaatcaatttcggcatcgaactcggataatcaaaattcacgcgatagcgaaagccgctccgcatcacaatctgacaaggaagaaagtgaaagtcgttcagcatcaacatcagataatcaagatagctgacttcgattcactgtcttgcttgtctgatgttgaagctgacttcgaatcgctgtcctgcttgtctgatgtcgaggtcgaacgactttgactatcccgagagtcttggctatccgacttcgaagcggaacgggattcactatcttgtttatcagacgtggacttcgattcactttcttgtttatcagatgtcaaacacatgcgtatcgggcctatagctcagctggttagagcgcacgcctgataagcgtgaggtcgatggttcgagtccatttaggcccatacatggggaattagctcagctgggagagcgcctgccttgcacgcaggaggtcagcggttcgatcccgctattctccattgaacaacgttagttgttctgcggataagaatgacgatgactcgcgttcggcctcaacttcaacgtcagataagaacgatagtgactcgcgttcggcgtcaacatcggataagaatgacgatgactcgcgttcggtctcaacttcaacgtcagataagaacgatagcgattcccgttcgacgtcgacatgacgatgactcgcgttcggcctcaacttcaacgtcagataagaacgatagcgattcccgttcgacgtcaacatcggataagaatgacgatgactcgcgttcggcctcaacttcaacgtcagataagaacgatagcgattcccgttcgacgtcgacatgagatgagtgtatagtatatttctgttgtcgcgagggacaacgtcattgattcttcaaattaattgaaattaaaccttgacataaattgctcctcacgatatacttaaaaagttgtgttaaacgacataaacgttgttaacacaacgtgcatggcaacgtcctaccctcgcagggggcgatcccccaactactcttggcgttaagaagcttgacttctgtgttcgacatgggaacaggtatatccttctcactatcgtcaccacactctatttcggcatctgaatcggataatcaaaattcacgcgatagcgaaagtcgttcagcatcacaatctgacaaggaagaaagtgaaagtcgttcggcctcgacatcagataatcaagac

(The sequence listing continues in the following parts.)

What is claimed is:

1. A method of reducing itching severity in a subject in need thereof, the method comprising orally administering to the subject a nutritional supplement or food product comprising a bacterial fermentate mixture, the bacterial fermentate mixture comprising a first fermentate and a second fermentate of a bacterial strain comprising a 16S rDNA sequence with at least 97% sequence identity to the nucleotide sequence of SEQ ID NO: 1, wherein the first fermentate comprises more indole-3-lactic acid (ILA) than indole-3-carboxaldehyde (IAld) and the second fermentate comprises more IAld than the first fermentate, wherein:

(i) the first fermentate is produced by incubating the bacterial strain under microaerobic conditions in a first fermentation medium comprising 1 g/L to 50 g/L tryptophan; and (ii) the second fermentate is produced by incubating the bacterial strain under aerobic conditions in a second fermentation medium comprising 1 g/L to 50 g/L tryptophan, wherein the bacterial fermentate mixture is substantially free of viable bacterial cells of the bacterial strain.

2. The method of claim 1, wherein:
(i) the first fermentation medium comprises 100 g/L to 200 g/L glucose and 10 g/L to 125 g/L of one or more nitrogen sources; and
(ii) the second fermentation medium comprises 1 g/L to 100 g/L glucose and 125 g/L to 200 g/L of one or more nitrogen sources,
wherein the first fermentation medium comprises a higher glucose concentration than the second fermentation medium, and the second fermentation medium comprises a higher nitrogen source concentration than the first fermentation medium.

3. The method of claim 2, wherein each of the first fermentation medium and the second fermentation medium comprises manganese.

4. The method of claim 1, wherein the bacterial strain comprises a 16S rDNA sequence with at least 99% sequence identity to the nucleotide sequence of SEQ ID NO: 1.

5. The method of claim 4, wherein the bacterial strain belongs to the species *Pediococcus acidilactici*.

6. The method of claim 5, wherein the bacterial fermentate mixture consists of the first fermentate and the second fermentate.

7. The method of claim 1, wherein the subject is a dog.

8. The method of claim 7, wherein the bacterial fermentate mixture stimulates a canine aryl hydrocarbon receptor (AhR).

9. The method of claim 7, wherein the administering reduces itching severity in the dog as measured by pruritus visual analog scale (PVAS).

10. The method of claim 1, wherein each of the first and second fermentates is present in the nutritional supplement or food product at an amount of 0.1 to 1000 mg.

11. The method of claim 1, wherein the bacterial fermentate mixture is present in the nutritional supplement or food product at an incorporation rate of 0.01% to 10% w/w.

12. The method of claim 1, wherein the nutritional supplement or food product is in the form of a gelatinized starch matrix, extruded or injection-molded treat, extruded or injection-molded chew, powder meal topper, water additive, dry kibble or food, wet food, frozen food, liquid spray, peanut butter spread, or soft jerky chew.

13. The method of claim 1, wherein the subject is a dog, wherein the bacterial strain belongs to the species *Pediococcus acidilactici* and comprises a 16S rDNA sequence with at least 99% sequence identity to the nucleotide sequence of SEQ ID NO: 1,
wherein the first fermentation medium comprises 1 g/L to 50 g/L tryptophan, 100 g/L to 200 g/L glucose, 10 g/L to 125 g/L of one or more nitrogen sources, and manganese, such that the first fermentate comprises more indole-3-lactic acid (ILA) than indole-3-carboxaldehyde (IAld),
wherein the second fermentation medium comprises 1 g/L to 50 g/L tryptophan, 1 g/L to 100 g/L glucose, 125 g/L to 200 g/L of one or more nitrogen sources, and manganese, such that the second fermentate comprises more IAld than the first fermentate, and
wherein the first fermentation medium has a higher glucose concentration than the second fermentation medium, and the second fermentation medium has a higher nitrogen source concentration than the first fermentation medium.

14. The method of claim 13, wherein the bacterial fermentate mixture reduces scratching frequency in the dog as measured by pruritus visual analog scale (PVAS).

* * * * *